:::: {.flex-container}
(12) United States Patent  
Hutkins et al.

(10) Patent No.: US 11,752,178 B2  
(45) Date of Patent: Sep. 12, 2023
::::

(54) METHODS FOR THE ISOLATION OF MICROBES WITH ENHANCED PERSISTANCE AND COMPOSITIONS WITH SUCH MICROBES

(71) Applicant: NUtech Ventures, Lincoln, NE (US)

(72) Inventors: Robert Hutkins, Lincoln, NE (US); Car Reen Kok, Lincoln, NE (US); Maria X. Maldonado-Gomez, Sacramento, CA (US)

(73) Assignee: NUtech Ventures, Lincoln, NE (US)

( * ) Notice: Subject to any disclaimer, the term of this patent is extended or adjusted under 35 U.S.C. 154(b) by 41 days.

(21) Appl. No.: 16/852,236

(22) Filed: Apr. 17, 2020

(65) Prior Publication Data

US 2021/0069266 A1   Mar. 11, 2021

Related U.S. Application Data

(60) Provisional application No. 63/000,915, filed on Mar. 27, 2020, provisional application No. 62/881,911, filed on Aug. 1, 2019, provisional application No. 62/835,279, filed on Apr. 17, 2019.

(51) Int. Cl.
| | |
|---|---|
| *A23L 33/135* | (2016.01) |
| *A61K 35/745* | (2015.01) |
| *A23L 33/21* | (2016.01) |
| *A61K 47/36* | (2006.01) |
| *A61K 9/19* | (2006.01) |

(52) U.S. Cl.
CPC .......... *A61K 35/745* (2013.01); *A23L 33/135* (2016.08); *A23L 33/21* (2016.08); *A61K 47/36* (2013.01); *A23Y 2300/55* (2013.01); *A23Y 2300/59* (2013.01); *A61K 9/19* (2013.01)

(58) Field of Classification Search
CPC .......... A23L 33/135; A23L 5/00; A23L 33/21; A61K 35/745; A61K 35/741; A61K 2300/00; A61K 31/702; A61K 47/36; A61K 9/19; A23Y 2300/55; A23Y 2300/59; A61P 1/00
See application file for complete search history.

(56) References Cited

U.S. PATENT DOCUMENTS

| | | | |
|---|---|---|---|
| 9,629,908 B2* | 4/2017 | Benyacoub | A61P 33/02 |
| 2012/0034200 A1 | 2/2012 | Porubcan | |
| 2012/0207712 A1 | 8/2012 | Longini et al. | |
| 2013/0095204 A1* | 4/2013 | Jouni | A23P 10/35 |
| | | | 426/74 |
| 2017/0058270 A1* | 3/2017 | Garcia-Garcia | A23C 9/1203 |
| 2017/0106029 A1* | 4/2017 | Ranganathan | A61K 9/48 |
| 2017/0165302 A1 | 6/2017 | Henn et al. | |
| 2017/0368110 A1 | 12/2017 | Grant et al. | |
| 2018/0016647 A1 | 1/2018 | Van Sinderen et al. | |
| 2018/0153951 A1* | 6/2018 | Zhong | A61K 45/06 |
| 2019/0307802 A1* | 10/2019 | Vollmer | A23K 10/16 |

FOREIGN PATENT DOCUMENTS

| | | | | |
|---|---|---|---|---|
| CN | 111280252 A | * | 6/2020 | .......... A23C 9/1234 |
| WO | 2017156550 A1 | | 9/2017 | |

OTHER PUBLICATIONS

Kondepudi et al., Prebiotic-non-digestible oligosaccharides preference of probiotic bifidobacteria and antimicrobial activity against Clostridium difficile, Anaerobe, vol. 18, p. 489-497. (Year: 2012).*
Maldonado-Gomez et al., Stable Engraftment of Bifidobacterium longum AH1206 in the Human Gut Depends on Individualized Features of the Resident Microbiome, Cell Host & Microbe, p. 515-526, vol. 20. (Year: 2016).*
Result 2 sequence search result Bifidobacterium longum sbsp. longum AH1206 (Year: 2022).*

* cited by examiner

*Primary Examiner* — Taeyoon Kim
*Assistant Examiner* — Tiffany M Gough
(74) *Attorney, Agent, or Firm* — Tracey S. Truitt; Sandberg Phoenix & von Gontard P.C.

(57) ABSTRACT

Particularly effective prebiotic-probiotic combinations including a novel probiotic, *B. longum* subsp *longum*, and XOS and *B. pseudocatenulatum* with Xylo-oligosaccharides are provided, together with methods of identifying synergistic probiotic-prebiotic combinations. Additionally, kits comprising the probiotic(s) and prebiotic(s) are also provided.

17 Claims, 15 Drawing Sheets

Specification includes a Sequence Listing.

FIG. 3 (CONT.)
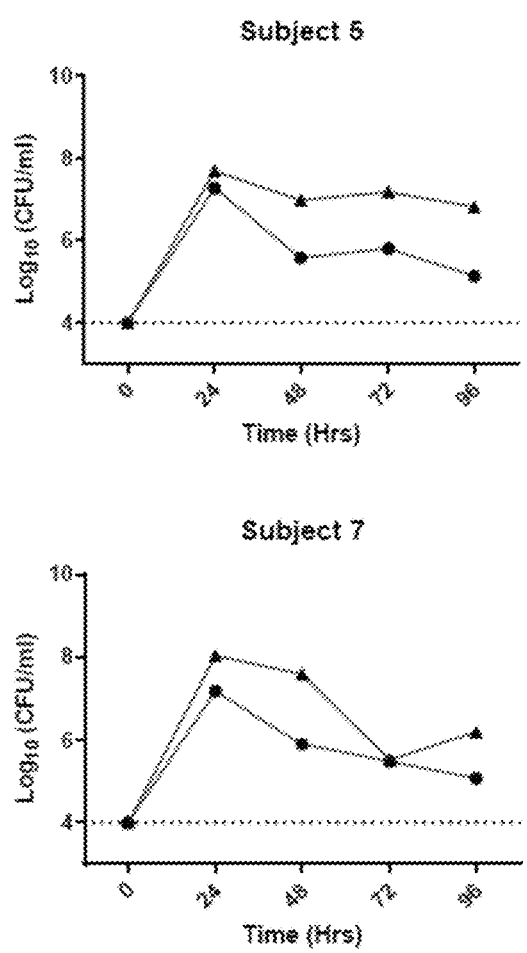
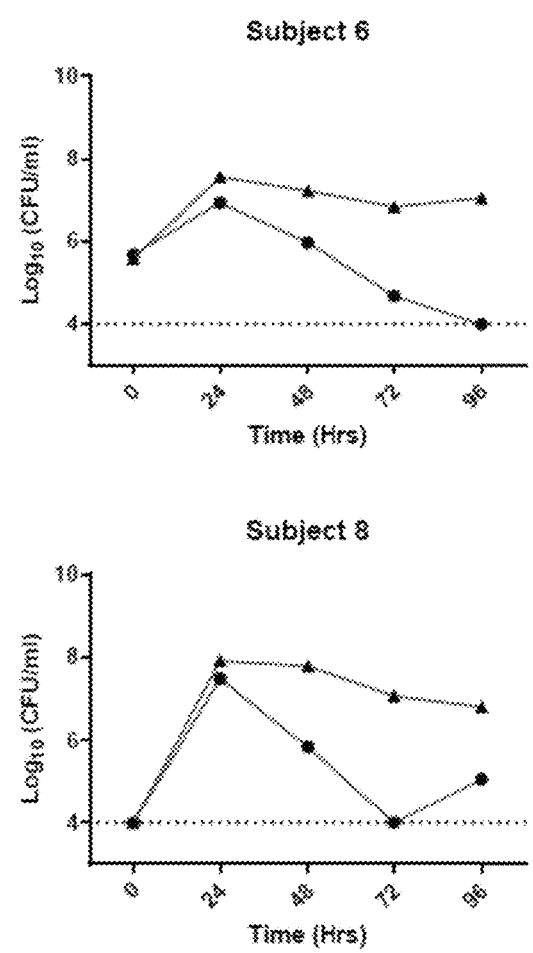

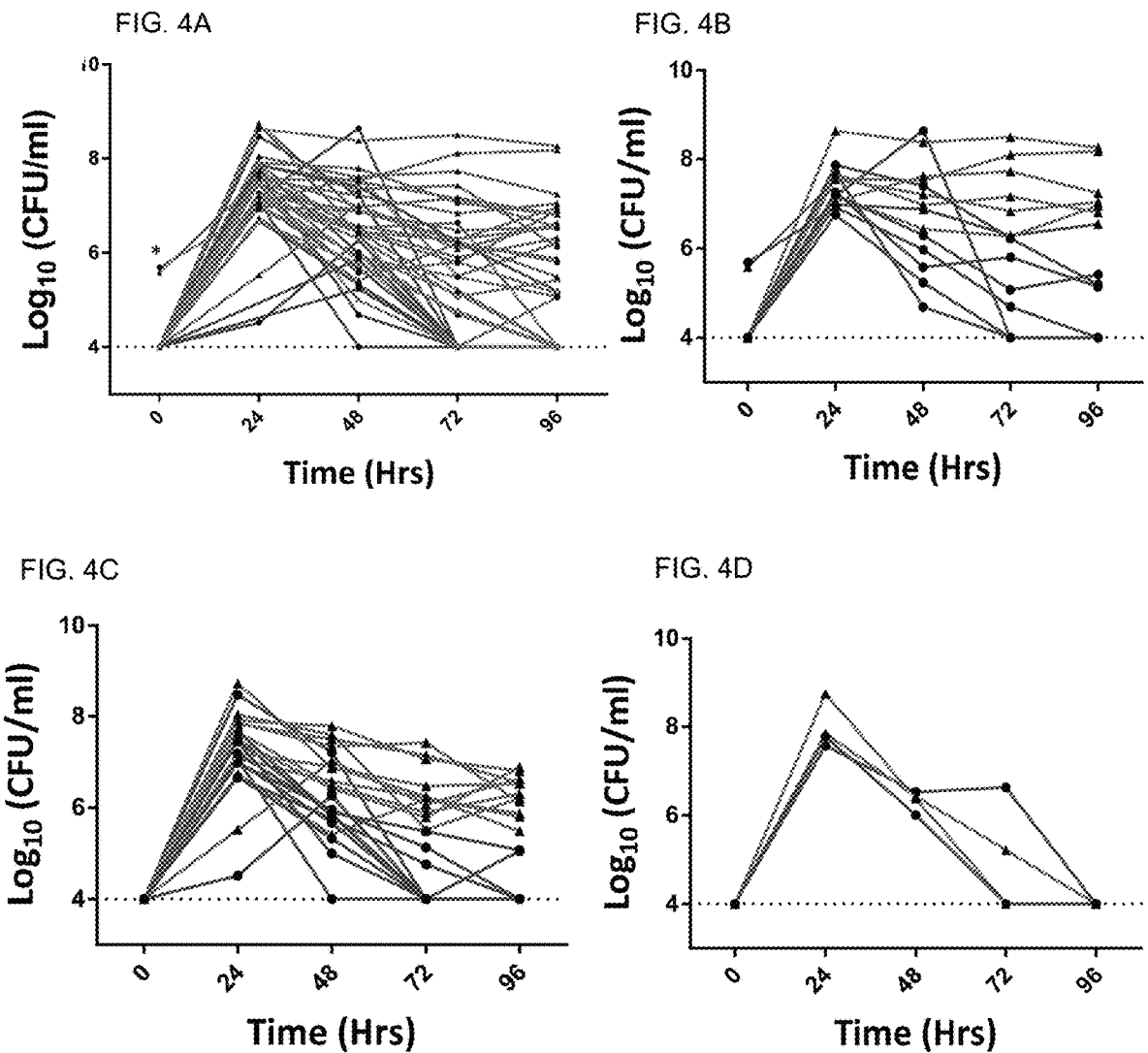

FIG. 7A
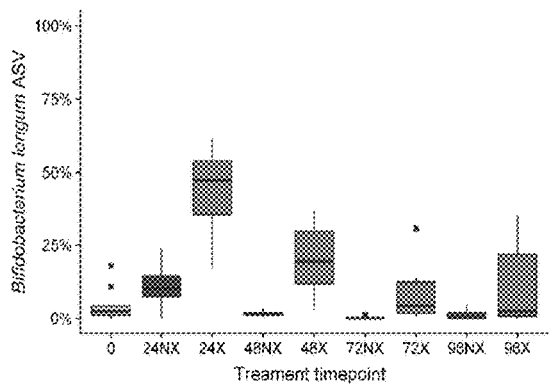
FIG. 7B
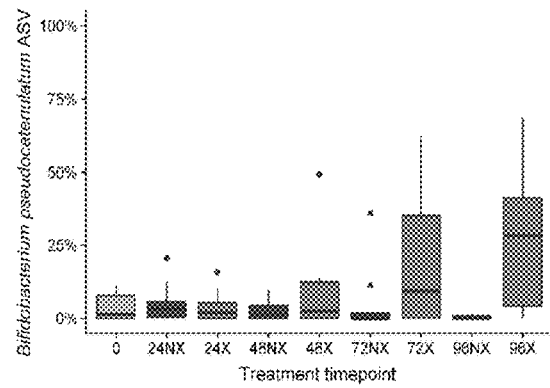
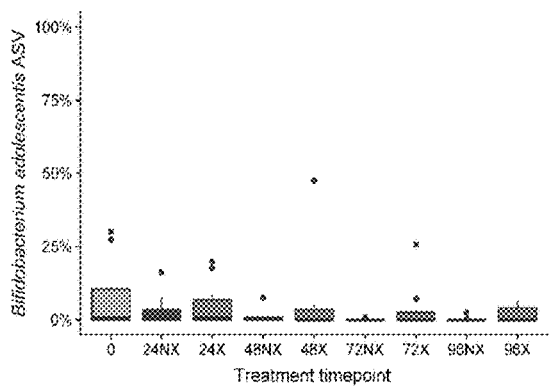
FIG. 7C
FIG. 8A
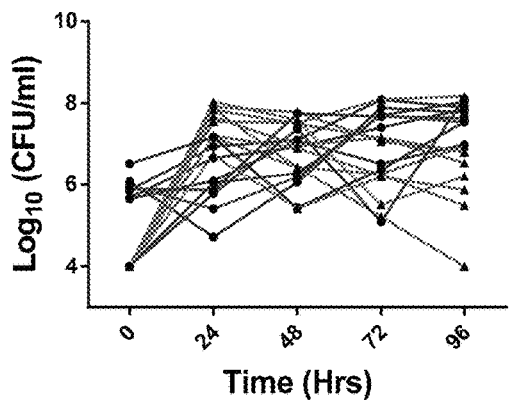
FIG. 8B
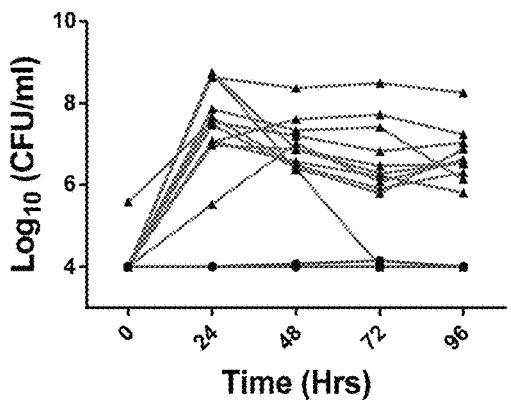

METHODS FOR THE ISOLATION OF MICROBES WITH ENHANCED PERSISTANCE AND COMPOSITIONS WITH SUCH MICROBES

SEQUENCE LISTING

This application contains a sequence listing in paper format and in computer readable format, the teachings and content of which are hereby incorporated by reference.

BACKGROUND OF THE DISCLOSURE

It is now well accepted that the composition and function of the gastrointestinal microbiome plays a major role in maintaining host health. How the human gut microbiome is affected by diet is one of the most important areas of research in the food, nutrition, and biomedical sciences. In particular, a disrupted or dysbiotic microbiota has been suggested to contribute to a wide range of gastrointestinal and systemic diseases. Researchers are now especially interested in developing therapeutic or dietary approaches to correct or redress these imbalances.

A frequent outcome of many biomedical reports and clinical trials is the observation that a particular treatment may be effective in some individuals, but not in others. This responder/non-responder phenomenon is also common in trials using probiotics, prebiotics, and other gut health interventions. For example, while prebiotic supplementations have been shown in numerous clinical studies to induce a bifidogenic response, there are often study participants for whom this expected response does not occur. Identifying or predicting responders and non-responders based on their resident microbiota remains a significant challenge.

Several explanations may account for the non-responder phenotype. For prebiotics, non-responders may lack the relevant strains that are physiologically or biochemically equipped to utilize that particular substrate. Alternatively, even if such strains were present, other members of the microbiota may simply out-compete those strains for the substrate. Similarly, probiotics are also subject to host-specific effects. To reach the colon, it is possible that ingested strains may not survive digestion through the stomach and small intestine. In the colon, they may be inhibited or outcompeted by other gut commensals.

One approach to enrich for beneficial microbes in the gut is to introduce specific strains in the form of synbiotics. Ideally, these synbiotics would be comprised of prebiotic-probiotic combinations, such that the prebiotic is specifically and preferentially fermented by the probiotic. The rational for this approach is based on classic ecological theory. Specifically, Tilman's resource ratio competition model states that the dominance of certain taxa is dependent upon the availability and demand for particular resources along with the rate of nutrient consumption. Thus, if the synbiotic was formulated such that the prebiotic specifically stimulated the growth of the companion probiotic, the latter would have a greater opportunity to become established in the gut. Indeed, previous studies described the possible persistence of probiotics when administered as a synbiotic.

Synbiotics that are appropriately designed also have the potential to increase the responder rate, by converting non-responders into responders. These so-called synergistic synbiotics were envisioned more than a decade ago, but few successful formulations of synergistic synbiotics have been reported. This is most likely due to the lack of strategic methods for pairing prebiotics and probiotics that can demonstrate synergism.

Recently, we described one such approach called in vivo selection or IVS. Briefly, an autochthonous strain (i.e., a normal resident of the gastrointestinal tract) of *Bifidobacterium adolescentis* was enriched in vivo by the prebiotic, galactooligosaccharide (GOS), and then recovered by cultural methods. When the enriched strain (*B. adolescentis* IVS-1) was recombined with GOS as a synbiotic and introduced to rodents, abundance of IVS-1 increased to 37%. The enhanced abundance of the IVS-1 strain was considered to be due to the ability of this strain to consume GOS more rapidly than its competitors, including other resident bifidobacteria. Although abundance of IVS-1 was not increased when combined with the prebiotic in humans subjects, the strain still reached higher levels of abundance compared to an allochthonous strain (i.e., a non-resident of the gastrointestinal tract) of *Bifidobacterium* (Krumbeck et al., 2018).

Despite the potential of the IVS approach for isolating autochthonous synergistic strains with putative beneficial properties, this method requires, at minimum, that a human subject study be conducted. In contrast, if a reproducible in vitro strategy could be devised to mimic the IVS method, it would be possible to obtain similar strains in a faster and more cost-effective manner.

This disclosure proposes the concept of in vitro enrichment (IVE) as an alternative strategy to select for potentially synergistic putative probiotic strains. Autochthonous strains of *Bifidobacterium* were enriched through a step-wise batch fecal fermentation model using a targeted approach. Such strains obtained by IVE would be expected to be competitive in the gut environment when combined with the cognate prebiotic. In this study we used the prebiotic xylooligosaccharide (XOS) and successfully obtained a *Bifidobacterium* strain that demonstrated synergism when reintroduced with XOS into in vitro fecal environments from multiple donors.

BRIEF DESCRIPTION OF THE DISCLOSURE

In one aspect of the disclosure, a synergistic combination of a probiotic species and a prebiotic (a "complementary synbiotic" or "synbiotic") is provided. In some forms, the probiotic species is selected from the group consisting of *B. pseudocatenulatum, B. longum*, and any combination or extract thereof. In some forms, the prebiotic is xylooligosaccharide (XOS). In some forms, the prebiotic is *B. longum* subsp *longum* CR15 or *B. pseudocatenulatum* CR16, preferably *B. longum* subsp *longum* CR15. In some forms, the prebiotic includes enzymes that assist with prebiotic utilization. In some forms, the enzymes include at least one member of the glycosyl hydrolase family. In some forms, the enzymes preferentially utilize XOS. In some forms, the enzymes include at least two different glycosyl hydrolase family members. In some forms, the *B. longum* subsp *longum* CR15 or *B. pseudocatenulatum* CR16 has a nucleotide sequence having at least 80%, 85, 90, 91, 92, 93, 94, 95, 96, 97, 98, 99, or 100% sequence identity to SEQ ID NO. 5 or SEQ ID NO. 6, respectively. CR15 can also be referred to as NCBI submission #PRJNA540282. In some forms, the *B. longum* or *B. pseudocatenulatum* have a contiguous nucleotide sequence that includes at least 1000, 950, 900, 850, 800, 750, 700, 650, 600, 550, 500, 450, 400, 350, 300, 250, 225, 200, 175, 150, 140, 130, 120, 110, 105, 100, 95, 90, 85, 80, 75, 70, 65, 60, 55, 50, 45, 40, 35, 30, 25, 24, 23, 22, 21, 20, 19, or 18 contiguous nucleotides having at least 90, 91, 92, 93, 94, 95, 96, 97, 98, 99, 99.1, 99.2, 99.3, 99.4, 99.5, 99.6, 99.7, 99.8, 99.9, or 100% sequence identity with a contiguous nucleotide sequence from SEQ ID NOs 5 or 6. Preferably, the contiguous nucleotide sequence from SEQ ID NO. 5 or 6 and the contiguous nucleotide sequence from *B. longum* or *B. pseudocatenulatum* are from the same genomic region. In some forms, the contiguous nucleotide sequence is selected from the group consisting of SEQ ID. NOs. 15-99 and any combination thereof. In some forms, the classification of a bacterial species as being *B. longum* or *B. pseudocatenulatum* is done by 16S sequencing. In some forms, the 16S sequencing will have at least 95, 96, 97, 98, 98.1, 98.2, 98.3, 98.4, 98.5, 98.6, 98.7, 98.8, 98.9, 99, 99.1, 99.2, 99.3, 99.4, 99.5, 99.6, 99.7, 99.8, 99.9, or 100% sequence homology with the 16S sequence of *B. longum* subsp. *longum* or the 16S sequence of *B. pseudocatenulatum*. In some forms, the 16S sequence of *B. longum* subsp *longum* can be or corresponds to the sequence generated by the primer pair of SEQ ID NO. 3 and 4. In some forms, the 16S sequence of *B. pseudocatenulatum* can be or corresponds to the sequence generated by the primer pair of SEQ ID NO. 9 and 10. In some forms, the 16S sequence of *B. longum* subsp. *longum* will have at least 95, 96, 97, 98, 98.1, 98.2, 98.3, 98.4, 98.5, 98.6, 98.7, 98.8, 98.9, 99, 99.1, 99.2, 99.3, 99.4, 99.5, 99.6, 99.7, 99.8, 99.9, or 100% sequence homology with SEQ ID NO. 13. In some forms, the 16S sequence of *B. pseudocatenulatum* will have at least 95, 96, 97, 98, 98.1, 98.2, 98.3, 98.4, 98.5, 98.6, 98.7, 98.8, 98.9, 99, 99.1, 99.2, 99.3, 99.4, 99.5, 99.6, 99.7, 99.8, 99.9, or 100% sequence homology with SEQ ID NO. 14. In some forms, the prebiotic and probiotic are administered within 6 hours, more preferably 5 hours, still more preferably 4 hours, even more preferably 3 hours, still more preferably 2 hours, even more preferably 1 hour, still more preferably 45 minutes, even more preferably 30 minutes, still more preferably 15 minutes, even more preferably 5, 4, 3, 2, 1 minutes, and most preferably at the same time, of one another. In some forms, the probiotic and prebiotic are administered in a weight ratio range between about 100:1 to 1:100. In some forms, the probiotic and prebiotic are combined in a composition. In some forms, the composition is in a form selected from the group consisting of a liquid, gelatin, capsule, sachet, straws, tablet, powder, or combined with or introduced into a food product, or kit comprising both an amount of probiotic and an amount of prebiotic, together with instructions on administration or consumption. In some forms, the probiotic and prebiotic are in different forms, together with instructions for administration or consumption. In some forms, the probiotic and prebiotic are each administered 1, 2, 3, 4, 5, 6, 7, 8, 9, 10, or more times. In some forms, the prebiotic is administered 1, 2, 3, 4, 5, 6, 7, 8, 9, 10, or more times after the initial administration of the probiotic. In some forms, the probiotic is administered 1, 2, 3, 4, 5, 6, 7, 8, 9, 10, or more times after the initial administration of the prebiotic. In some forms, the probiotic and/or the prebiotic are administered orally, via a suppository, or via a microbiome transplant. In some forms, the amount of probiotic comprises between about $10^6$ to about $10^{12}$ CFU, more preferably $10^8$ to $10^{11}$ CFU, and most preferably about $10^9$-$10^{10}$ CFU per administration. In some forms, the probiotic and prebiotic are administered to an animal, preferably a mammal or poultry, and especially including humans, pigs, cows, dogs, cats, goats, sheep, turkeys, and chicken.

In another aspect of the disclosure, a method of determining a synergistic combination of probiotic and prebiotic is provided. In some forms, the method includes the steps of fermenting fecal matter, preferably in a slurry, with a prebiotic; transferring the fermenting fecal matter-prebiotic mixture into fresh medium at least once, and determining which probiotic strains were established and/or maintained. In preferred forms, there are a plurality of different fecal matter-prebiotic mixtures, each of which has a different prebiotic so that a comparison can be made as to which probiotics worked best or were the most successful at becoming established or maintained. In some forms, the fecal matter-prebiotic mixture is transferred to fresh medium at least 5, 10, 15, 16, 17, 18, 19, 20, 21, 22, 23, 24, 25, 26, 27, 28, 29, 30 times or more. In some forms, the determination of which probiotic strains were established and/or maintained includes the steps of plating samples of the fecal matter-prebiotic mixture onto a growth medium such as agar, more preferably an agar designed for growth of probiotics, and then identifying the probiotic strains through sequencing, such as 16S rRNA sequencing. In some forms, the fecal matter is supplemented with particular probiotic strains in order to compare the growth rates of the supplemented probiotic with the naturally occurring bacterial flora in the fecal matter. In some forms, the fecal matter is supplemented with 1, 2, 3, 4, 5, 6, 7, 8, 9, 10, or more probiotic strains. In some forms, the probiotic strains include *B. pseudocatenulatum*, *B. longum*, and any extract or combination thereof and in any form described above. In some forms, the prebiotic is XOS.

In another aspect of the disclosure, a method of modulating gastrointestinal microbiota of a subject is provided. Generally, the method comprises the step of administering a synergistic combination of at least one probiotic species and at least one prebiotic. In some forms, the probiotic species is selected from the group consisting of *B. pseudocatenulatum*, and *B. longum* and any combination or extract thereof, or in any form described above. In some forms, the prebiotic is xylooligosaccharide (XOS). In some forms, the prebiotic is *B. longum* subsp *longum* CR15 or *B. pseudocatenulatum* CR16, preferably *B. longum* subsp *longum* CR15. In some forms, the prebiotic and probiotic are administered within 6 hours, more preferably 5 hours, still more preferably 4 hours, even more preferably 3 hours, still more preferably 2 hours, even more preferably 1 hour, still more preferably 45 minutes, even more preferably 30 minutes, still more preferably 15 minutes, even more preferably 5, 4, 3, 2, 1 minutes, and most preferably at the same time, of one another. In some forms, the probiotic and prebiotic are administered in a weight ratio range between about 100:1 to 1:100. In some forms, the probiotic and prebiotic are combined in a composition. In some forms, the composition is in a form selected from the group consisting of a liquid, gelatin, capsule, tablet, powder, or kit comprising both an amount of probiotic and an amount of prebiotic, together with instructions on administration or consumption. In some forms, the probiotic and prebiotic are in different forms, together with instructions for administration or consumption. In some forms, the probiotic and prebiotic are each administered 1, 2, 3, 4, 5, 6, 7, 8, 9, 10, or more times. In some forms, the prebiotic is administered 1, 2, 3, 4, 5, 6, 7, 8, 9, 10, or more times after the initial administration of the probiotic and/or prebiotic. In some forms, the probiotic is administered 1, 2, 3, 4, 5, 6, 7, 8, 9, 10, or more times after the initial administration of the prebiotic and/or probiotic. In some forms, the probiotic and/or the prebiotic are administered orally, via a suppository, or via a microbiome transplant. In some forms, the amount of probiotic comprises between about $10^6$ to about $10^{12}$ CFU, more preferably $10^8$ to $10^{11}$ CFU, and most preferably about $10^9$-$10^{10}$ CFU per administration. In some forms, the probiotic and prebiotic are administered to an animal, preferably a mammal or poultry, and especially including humans, pigs, cows, dogs, cats, goats, turkeys, chickens, and sheep.

In another aspect of the disclosure, a method of improving gut and/or systemic health is provided. In some forms, the improved gut and/or systemic health can be determined by assessing a gastrointestinal characteristic or parameter. In some forms, the improved gut and/or systemic health is determined through at least one of improved laxation and regularity, improved satiety, improved gut barrier function, less bloating and gas, reduced risk of gastrointestinal infections, reduced duration of colic symptoms, and/or reduced risk of atopic dermatitis. In some forms, the improvement is in comparison to a subject or group of subjects that has not had an administration of a probiotic and/or prebiotic, as described above. In some forms, the improvement is in comparison to the same subject before and after administration of a composition in accordance with the present disclosure. In some forms, the improvement is at least 10, 20, 30, 40, 50, 60, 70, 80, 90%, or more. Generally, the method comprises the step of administering a synergistic combination of at least one probiotic species and at least one prebiotic. In some forms, the probiotic species is selected from the group consisting of *B. pseudocatenulatum*, and *B. longum* and any combination or extract thereof. In some forms, the prebiotic is xylooligosaccharide (XOS). In some forms, the prebiotic is *B. longum* subsp *longum* CR15 or *B. pseudocatenulatum* CR16, preferably *B. longum* subsp *longum* CR15, or in any form described above. In some forms, the prebiotic and probiotic are administered within 6 hours, more preferably 5 hours, still more preferably 4 hours, even more preferably 3 hours, still more preferably 2 hours, even more preferably 1 hour, still more preferably 45 minutes, even more preferably 30 minutes, still more preferably 15 minutes, even more preferably 5, 4, 3, 2, 1 minutes, and most preferably at the same time, of one another. In some forms, the probiotic and prebiotic are administered in a weight ratio range between about 100:1 to 1:100. In some forms, the probiotic and prebiotic are combined in a composition. In some forms, the composition is in a form selected from the group consisting of a liquid, gelatin, capsule, tablet, powder, or kit comprising both an amount of probiotic and an amount of prebiotic, together with instructions on administration or consumption. In some forms, the probiotic and prebiotic are in different forms, together with instructions for administration or consumption. In some forms, the probiotic and prebiotic are each administered 1, 2, 3, 4, 5, 6, 7, 8, 9, 10, or more times. In some forms, the prebiotic is administered 1, 2, 3, 4, 5, 6, 7, 8, 9, 10, or more times after the initial administration of the probiotic and/or prebiotic. In some forms, the probiotic is administered 1, 2, 3, 4, 5, 6, 7, 8, 9, 10, or more times after the initial administration of the prebiotic and/or probiotic. In some forms, the probiotic and/or the prebiotic are administered orally or via a microbiome transplant. In some forms, the amount of probiotic comprises between about $10^6$ to about $10^{12}$ CFU, more preferably $10^8$ to $10^{11}$ CFU, and most preferably about $10^9$-$10^{10}$ CFU per administration. In some forms, the probiotic and prebiotic are administered to an animal, preferably a mammal or poultry, and especially including humans, pigs, cows, dogs, cats, goats, turkeys, chickens, and sheep.

BRIEF DESCRIPTION OF THE DRAWINGS

The disclosure will be better understood, and features, aspects and advantages other than those set forth above will become apparent when consideration is given to the following detailed description thereof. Such detailed description makes reference to the following drawings, wherein:

FIG. 4A is a graph illustrating a summary of the establishment trends of *B. longum* subsp. *longum* CR15 in all 20 samples in the presence (▲) or absence (•) of XOS and showing that *B. longum* subsp. *longum* CR15 was clearly established in 7 samples. Time 0 samples were taken prior to inoculation of $10^7$ CFU/mL of the test strains. Horizontal dashed lines indicate the limits of detection ($10^4$ CFU/mL);

FIG. 4B is a graph illustrating that *B. longum* subsp. *longum* CR15 was potentially established in 11 samples. Time 0 samples were taken prior to inoculation of $10^7$ CFU/mL of the test strains. Horizontal dashed lines indicate the limits of detection ($10^4$ CFU/mL);

FIG. 4C is a graph illustrating that *B. longum* subsp. *longum* CR15 was displaced or washed out in 2 samples. Time 0 samples were taken prior to inoculation of $10^7$ CFU/mL of the test strains. Horizontal dashed lines indicate the limits of detection ($10^4$ CFU/mL);

FIG. 4D is a graph illustrating that in the absence of XOS, the *B. longum* subsp. *longum* CR15 strain could not be established in any of the samples. Varying trends of establishment of *B. longum* subsp. *longum* CR15 were observed across fecal samples. Time 0 samples were taken prior to inoculation of $10^7$ CFU/mL of the test strains. Horizontal dashed lines indicate the limits of detection ($10^4$ CFU/mL);

FIG. 7A is a graph illustrating an abundance of ASVs corresponding to *B. longum* in the presence of XOS displayed as relative abundance at each time point. 0; baseline of samples at the start of fermentation; NX, fermentation without XOS; X, fermentations with XOS;

FIG. 7B is a graph illustrating an abundance of ASV's corresponding to *B. pseudocatenulatum* in the presence of XOS displayed as relative abundance at each time point. 0; baseline of samples at the start of fermentation; NX, fermentation without XOS; X, fermentations with XOS:

FIG. 7C is a graph illustrating an abundance of *B. adolescentis* in the presence of XOS displayed as relative abundance at each time point. 0; baseline of samples at the start of fermentation; NX, fermentation without XOS; X, fermentations with XOS;

FIG. 8A is a graph illustrating the enrichment of *B. longum* subsp. *longum* CR15 (▲) in the presence of XOS;

FIG. 8B is a graph illustrating the enrichment of *B. pseudocatenulatum* (•) in the presence of IOS. When present at baseline (9 samples), *B. pseudocatenulatum* reached high cell numbers at the end of fermentation (A). When *B. pseudocatenulatum* was below detection at baseline (11 samples), the species remained undetected after 96 hours;

DETAILED DESCRIPTION

Figure 1A:
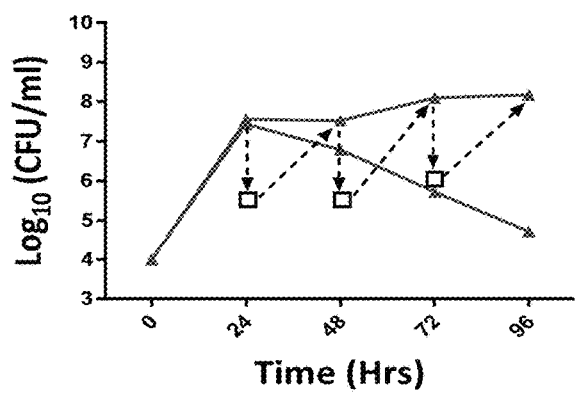
FIG. 1A is a graph illustrating hypothetical trends of successful (green) and unsuccessful enrichments (red) in fermentation experiments of bifidobacteria enriched by XOS in fecal environments whereas strain establishment was dependent on the strain and the host.

Unless defined otherwise, all technical and scientific terms used herein have the same meaning as commonly understood by one of ordinary skill in the art to which the disclosure belongs. Although any methods and materials similar to or equivalent to those described herein can be used in the practice or testing of the present disclosure, the preferred methods and materials are described below.

In some forms, the methods of the present disclosure are directed to administering at least one probiotic, preferably selected from the group consisting of *B. pseudocatenulatum*, *B. longum*, and any extract or combination, to a subject, and preferably to a subject in need thereof. As used herein, "subject in need thereof" refers to a subset of subjects in need of improving their gastrointestinal microbiota and/or their gut health and/or their systemic health. In one embodiment, subjects that are in need thereof may include animals, mammals, poultry, and more preferably humans, pigs, cows, dogs, cats, goats, turkey, chicken, and sheep. Additionally, the methods include administering a prebiotic, preferably a prebiotic that works synergistically with the administered probiotic, or the bacterial strain or strains that are in need of establishment and proliferation within the gut microbiota. In some preferred forms, the probiotic is *B. longum* subsp *longum*.

The term "administering" as used herein includes all means of introducing the bacterial strains and/or their extracts as well as the prebiotics described herein to the subject, including, but not limited to, oral (po), inhalation, buccal, sublingual, via suppository, microbiome transplantation, and the like. The strains and/or extracts as well as the prebiotics described herein may be administered in unit dosage forms and/or formulations containing conventional nontoxic pharmaceutically-acceptable carriers, adjuvants, and vehicles. The probiotic and/or extract thereof and the prebiotic do not need to be administered in the same way or in the same form.

Illustrative formats for oral administration include liquids, solids, tablets, pills, capsules, solids in a liquid medium, powders, lozenges, straws, sachets, cachets, solutions, elixirs, suspensions, emulsions, solutions, syrups, aerosols, soft and hard gelatin capsules, sterile packaged powders, or combined with or introduced into a food product.

In particularly suitable embodiments, the methods of the present disclosure include incorporating the probiotic(s) or extracts thereof and prebiotic(s) into the diet of the subject. In some forms, the probiotics can include live cultures or lyophilized preparations.

In some embodiments, a therapeutically effective amount of the probiotic(s) or extracts thereof in any of the various forms described herein may be mixed with one or more excipients, diluted by one or more excipients, or enclosed within such a carrier which can be in the form of a capsule, sachet, paper, or other container. Excipients may serve as a diluent, and can be solid, semi-solid, or liquid materials, which act as a vehicle, carrier or medium for the active ingredient. Thus, for example, *B. pseudocatenulatum, B. longum*, and any extract or combination thereof can be administered in the form of liquids, solids, tablets, pills, capsules, solids in a liquid medium, powders, lozenges, straws, sachets, cachets, solutions, elixirs, suspensions, emulsions, solutions, syrups, aerosols (as a solid or in a liquid medium), soft and hard gelatin capsules, sterile packaged powders, or combined with or introduced into a food product.

The term "therapeutically effective amount" as used herein, refers to that amount of active compound or agent that elicits the biological or medicinal response in a tissue system, animal or human that is being sought by a researcher, veterinarian, medical doctor or other clinician, which includes alleviation of the symptoms of the disease, condition or ailment being treated. In one aspect, the therapeutically effective amount is that which may treat or alleviate the condition, disease or symptoms of the disease at a reasonable benefit/risk ratio applicable to any medical treatment. The specific therapeutically-effective dose level for any particular patient will depend upon a variety of factors, including the severity of the condition being treated; the specific composition employed; the age, body weight, general health, gender and diet of the patient: the time of administration, route of administration, and the duration of the treatment; drugs used in combination or coincidentally with the probiotic(s) or extracts thereof and prebiotic(s); and like factors well known to the medical doctor, researcher, veterinarian, or other clinician of ordinary skill.

It is also appreciated that the therapeutically effective amount is advantageously selected with reference to any toxicity, or other undesirable side effect, that might occur during administration of the probiotic(s) such as *B. pseudocatenulatum, B. longum*, and any extract or combination thereof.

"Prebiotic" as used herein, refers to a substrate that exerts health benefits, which may include, but are not limited to, selective stimulation of the growth and/or activity of one or a limited number of beneficial gut bacteria, stimulation of the growth and/or activity of ingested probiotic microorganisms, selective reduction in gut pathogens, and favorable influence on gut short chain fatty acid profile. Some combinations of probiotic(s) such as *B. pseudocatenulatum, B. longum*, and any extract or combination thereof and/or at least one prebiotic, such as XOS, will act synergistically with one another. Such prebiotics may be naturally-occurring, synthetic, or developed through the genetic manipulation of organisms and/or plants, whether such new source is now known or developed later. Prebiotics useful in the present disclosure may include soluble starch, yeast extract, oligosaccharides, polysaccharides, and other prebiotics that contain fructose, xylose, soya, galactose, glucose and mannose. XOS is particularly preferred for some forms.

More specifically, prebiotics useful in the present disclosure may include soluble starch, yeast extract, polydextrose, polydextrose powder, lactulose, lactosucrose, raffinose, gluco-oligosaccharide, inulin, fructo-oligosaccharide, iso-malto-oligosaccharide, soybean oligosaccharides, lactosucrose, xylo-oligosaccharide, chito-oligosaccharide, manno-oligosaccharide, aribino-oligosaccharide, siallyl-oligosaccharide, fuco-oligosaccharide, galacto-oligosaccharide, and gentio-oligosaccharides.

In an embodiment, the total amount of prebiotics present in the composition may be from about 1.0 g/L to about 30.0 g/L including 1, 2, 3, 4, 5, 6, 7, 8, 9, 10, 11, 12, 13, 14, 15, 16, 17, 18, 19, 20, 21, 22, 23, 24, 25, 26, 27, 28, 29, and 30 g/L of the composition. More preferably, the total amount of prebiotics present in the nutritional composition may be from about 2.0 g/L and about 8.0 g/L of the composition. In some embodiments, the total amount of prebiotics present in the nutritional composition may be from about 0.1 g/100 kcal to about 1 g/100 kcal. In certain embodiments, the total amount of prebiotics present in the nutritional composition may be from about 0.3 g/100 kcal to about 0.7 g/100 kcal.

The prebiotics of this disclosure can be in the same capsule or formulation as the probiotics, or in a separate dosage form. In some forms, the prebiotic and probiotic are in contact with one another in the composition. The prebiotics and compositions of this disclosure may also be taken with carbohydrate or fiber to increase their effectiveness.

The compositions of the present disclosure can also include one or more additional active ingredients, excipients, dissolution agents, surfactants, antioxidants, antiseptics, preservatives, penetrants, osmoprotectants, cryoprotectants, and combinations thereof.

Various excipients can be mixed with the compositions as would be known to those skilled in the art. Suitable excipients include, for example, microcrystalline cellulose, maltodextrin, colloidal silicon dioxide, lactose, starch, sorbitol, cyclodextrin and combinations thereof.

Suitable dissolution agents include, for example, organic acids such as citric acid, fumaric acid, lactic acid, tartaric acid, succinic acid, ascorbic acid, acetic acid, malic acid, glutaric acid and adipic acid, and can be used alone or in combination. These agents can also be combined with salts of the acids, e.g. sodium citrate with citric acid, to produce a buffer system.

Suitable surfactants include, for example, sodium lauryl sulphate, polyethylene separates, polyethylene sorbitan fatty acid esters, polyoxyethylene castor oil derivatives, polyoxyethylene alkyl ethers, benzyl benzoate, cetrimide, cetyl alcohol, docusate sodium, glyceryl monooleate, glyceryl monostearate, glyceryl palmitostearate, lecithin, medium chain triglycerides, monoethanolamine, oleic acid, poloxamers, polyvinyl alcohol and sorbitan fatty acid esters.

Suitable antioxidants include, for example, sodium metabisulfite, tocopherols such as α, β, δ-tocopherol esters and α-tocopherol acetate, ascorbic acid and pharmaceutically acceptable salts thereof, ascorbyl palmitate, alkyl gallates (e.g., propyl gallate, TENOX® PG, TENOX® S-1), sulfites and pharmaceutically acceptable salts thereof, butylated hydroxyanisole, butylated hydroxytoluene, and monothioglycerol.

Suitable antiseptics include, for example, chlorhexidine gluconate, glucono delta-lactone, methylparaben, sodium hydroxide, and combinations thereof.

Suitable preservatives include parabens. Suitable parabens include, for example, methylparaben (E number E218), ethylparaben (E214), propylparaben (E216), butylparaben and heptylparaben (E209). Less common, but still suitable parabens include isobutylparaben, isopropylparaben, benzylparaben and their sodium salts.

Suitable penetrants include, for example, sulphoxides (e.g., dimethyl sulphoxide, dimethylacetamide, dimethylformamide), azone (1-dodecylazacycloheptan-2-one or laurocapran), pyrrolidones (e.g., N-methyl pyrolidone), fatty acids (e.g., oleic acid, lauric acid, myristic acid, capric acid), essential oils (e.g., *eucalyptus, chenopodium*, ylang-ylang, L-menthol), terpenes (e.g., sesquiterpene), terpenoids, oxazolidinones (e.g., 4-decyloxazolidin-2-one), and urea.

When producing a lyophilized form of a probiotic for use with the present disclosure, the probiotic strains are centrifuged at 3000×g for 15 minutes at room temperature and the resulting cell pellet is suspended in 10 ml of 20% glycerol in spent media resuspension solution (the media collected after centrifugation is mixed with 50% sterile glycerol to generate a 20% resuspension solution). The resulting cell suspension is snap frozen in liquid nitrogen and is then freeze dried to obtain a freeze dried viable cell product. 10 milligrams of the freeze dried cells is suspended in peptone water and is spread on brain heart infusion agar plates to determine viable colony forming units (CFUs) per milligram of freeze dried product. Alternatively, lyophilization can be scaled up in an appropriate industrial or commercial manufacturing processes wherein cells are harvested from high-cell density fermentors by continuous centrifugation and the slurries are frozen and lyophilized.

The following examples further illustrate specific embodiments of the present disclosure; however, the following illustrative examples should not be interpreted in any way to limit the disclosure.

EXAMPLES

Example 1

In this Example, stepwise in vitro fermentations to enrich for strains able to use XOS were performed and the most successful strains were identified and characterized.

Methods

Sample Collection

A total of 20 fecal samples were collected from volunteers throughout the duration of the study. Each participant was asked to sign a consent form indicating no known gastrointestinal disease, was 19 years of age or older, had not consumed antibiotics or probiotic supplements in the last 6 months, was not a regular consumer of yogurt, and was willing to provide 1 to 3 stool samples over three months. Participants were given a commode specimen collection kit (Fisher Scientific, New Hampshire, USA) and detailed instructions for collection and preservation. The study was approved by the UNL Institutional Review Board (IRB 20160616139).

Samples were collected and processed in an anaerobic chamber (Bactron IV Anaerobic Chamber, Sheldon Manufacturing, Cornelius, OR USA, 5% $H_2$, 5% $CO_2$, 90% $N_2$). Samples were diluted (1:10) in phosphate-buffered saline (PBS) at pH 7, homogenized, and stored in 2 ml aliquots at −80° C.

Step-Wise Fecal Fermentations

For all enrichment and establishment experiments XOS95™, a 95% pure prebiotic substrate with a degree of polymerization ranging from DP 2 to DP 20 was used (Prenexus Health, Arizona, US). For all fermentations, each fecal sample was treated as an individual experimental unit. In enrichment experiments, step-wise in vitro batch fermentations were performed. Diluted fecal slurries were homogenized, filtered and mixed with fermentation broth in a 6:3 ratio (v/v) in a total volume of 9.0 ml. When added, XOS was present at a concentration of 1%. All fermentations were incubated anaerobically at 37° C. After 24 hours, 100-fold dilutions were performed by transferring 100 ul of sample into 9.9 ml of fermentation broth containing XOS. Three subsequent transfers were performed every 24 hours, for a total of 96 hours. Samples at 0, 24, 48, 72, and 96 hours were collected and stored at −20° C. for DNA extraction and SCFA analysis. At the end of the four fermentation cycles (96 hours), samples were plated onto *Bifidobacterium* Selective Iodoacetate Mupirocin (BSIM) and colonies were picked. Each colony isolated was grown in modified de Man, Rogosa and Sharpe (mMRS) to which glucose was omitted, but supplemented with 1% XOS (mMRS-XOS) The isolates were stored at −20° C. for subsequent DNA extraction and 16S Sanger sequencing and identification.

For the establishment experiments, similar batch-wise fermentations were conducted, except that the XOS-enriched strains obtained from above were inoculated at the beginning of the fermentation cycle. Test strains were first incubated in MRS broth for 24 hours and used to inoculate (1%) fresh fecal fermentation media, with or without 1% XOS. Subsequent transfers were carried out as before. Samples were collected every 24 hours for up to 7 days, and isolates were picked from BISM plates, grown in mMRS-XOS and stored. Initial enrichment experiments were performed with 3 fecal samples, and 20 samples were used for subsequent establishment experiments with *B. longum* subsp. *longum* CR15.

DNA Extraction and 16S Sanger Sequencing and Analysis

DNA from the samples collected (fermentation media and isolates) were extracted using phenol-chloroform as described by Martinez et al. (2015), except that incubation times were for 30 minutes and DNA pellets were resuspended in 100 µl of DNase-free water. For the isolates, PCR was performed using 16S primers; 8F (5'-AGAGTTTGATCCTGGCTCAG-3') (SEQ ID NO. 1) and 1391R (5'-GACGGGCGGTGTGTRCA-3') (SEE ID NO 2) and PCR products were purified using QIAquick PCR Purification Kit (Qiagen, Hilden, Germany) and quantified with a NanoDrop ND-1000 Spectrophotometer (Thermo Fisher, Massachusetts, USA). The purified PCR products were sequenced by the Genomics Core Facility at Michigan State University.

Preliminary identification of potential IVE probiotic isolates was done using NCBI BLASTn. Isolates were assigned genus and species based on this blast search and were considered unique strains if isolated from different individuals.

Quantification of Bifidobacteria Using qRT-PCR

For all in vitro fermentation experiments, quantification of bacterial groups in the fermentation samples was performed by quantitative PCR (qPCR) using a Mastercycler Realplex2 (Eppendorf AG, Hamburg, Germany). Each reaction mixture contained 12.5 µl of qPCR Master Mix (2× Maxima SYBR green; Thermo Fisher Scientific, Massachusetts, USA), 0.4 µM of specific primers for each target organism, 8.5 µl of water, and 3 µl of template DNA for a final volume of 25 µl. Duplicate wells were used for each sample. Samples that had a standard deviation greater than 0.5 were re-analysed. For each assay, standard curves were made using DNA isolated from pure cultures from which counts were determined through plate counting. A 10-fold serial dilution of the DNA standards were made and the cycle threshold (ct) values of the standards were plotted against $log_{10}$ CFU/ml values. The *Bifidobacterium* genomes used for *B. longum* CR15 primer design are provided below. Whole genome sequences from closely related strains were used to identify unique target sequences in *B. longum* subsp *longum* CR15. The adenine-specific methyltransferase PaeR71 gene was selected as the target amplicon for *B. longum* subsp *longum* CR15.

TABLE 1

| | |
|---|---|
| Bifidobacterium longum subsp longum KACC 91563, complete genome | CP002794.1 |
| Bifidobacterium longum subsp longum strain AH1206, complete genome | CP016019.1 |
| Bifidobacterium longum subsp longum JCM 1217 DNA, complete genome | AP010888.1 |
| Bifidobacterium longum subsp longum NCIMB809, complete genome | CP011964.1 |
| Bifidobacterium longum subsp longum GT15, complete genome | CP006741.1 |
| Bifidobacterium longum subsp longum BBMN68, complete genome | CP002286.1 |
| Bifidobacterium longum subsp longum CCUG30698, complete genome | CP011965.1 |
| Bifidobacterium longum subsp longum JDM301, complete genome | CP002010.1 |

Genome Sequencing and Assembly of *B. longum* Subsp. *Longum* CR15

For whole genome sequencing, DNA extraction was performed using QIAamp DNA mini kit (Qiagen, Hilden, Germany), and a genomic library was prepared using the Nextera XT DNA Library Prep Kit. The genome of *B. longum* subsp. *longum* CR15 was sequenced on an Illumina MiSeq, resulting in 603,691 paired reads that were assembled de-novo using the SPAdes Genome Assembler (ver 3.11) and aligned against a reference genome using Mauve. A draft genome consisting of 63 contigs with 123-fold coverage was obtained post-assembly.

Gene annotation was performed using PROKKA. Additionally, the draft genome was annotated against the CAZy database using dbCAN and the transportDB 2.0 database through TransAAP to identify carbohydrate active enzyme clusters and sugar transporters, respectively.

Strain-Specific Primer Design and Validation

RUCS (rapid identification of PCR primers for unique core sequences) was used to identify unique targets in the draft genome of *B. longum* subsp. *longum* CR15 and for in-silico PCR. The unique target sequence was identified through alignment with complete genomes of 8 closely related *B. longum* subsp. *longum* strains that were retrieved from the NCBI database.

TABLE 2

| Bifidobacterium strains for primer validation | % identity at 16S rRNA gene level |
|---|---|
| B. longum subsp. longum AH120 | 100% |
| B. longum subsp. longum (ATCC15707) | 99% |
| B. longum longum F8 | 100% |
| B. longum longum JDM301 | 99% |
| B. longum DJ010A | 100% |
| Bifidobacterium sp. 12_1_47BFAA | 100% |
| Bifidobacterium sp. 113 | 95% |
| Bifidobacterium sp. HMLN14 | 96% |

Primer specificity was confirmed by blasting against the NCBI RefSeq representative genome database for bacteria with NCBI Primer Blast. Only 1 hit for a strain of *Gelidibacter algens*, a non-resident of the human gut matched the primer pair. The adenine-specific methyltransferase PaeR71 gene was subsequently selected as the target amplicon with a length of 210 base pairs with the primer pair; forward (F) CCGCATCACAACTGCTATTGG (SEQ ID NO. 3) and reverse (R) CGAAAGCCCCAATTTGTTCGT (SEQ ID NO. 4) (Invitrogen, California, USA). A gradient PCR was used to determine the suitable annealing temperature of 58° C. Experimental primer validation with both PCR and qPCR was performed using 11 strains in our culture collection that had a 95-100% identity at the 16S rRNA level.

TABLE 3

Primer sequences and PCR programs used to target different groups of *Bifidobacterium*.

| Target organism | Primer Direction | Sequence | SEQ ID NO. | qPCR program |
|---|---|---|---|---|
| Bifidobacterium | Forward | TCGCGTCYGGTGTG AAAG | 7 | Initial denaturation at 95° C. for 5 min, 35 cycles at 95° C. for 15 sec, 58° C. for 20 sec, and 68° C. for 30 sec |
| | Reverse | CCACATCCAGCRTC CAC | 8 | |
| B. pseudocatenulatum | Forward | AGCCATCGTCAAGG AGCTTATCGCAG | 9 | Initial denaturation at 95° C. for 5 min, 40 cycles at 94° C. for 15 sec, 68° C. for 15 sec, and 72° C. for 15 sec |
| | Reverse | CACGACGTCCTGCT GAGAGCTCAC | 10 | |
| B. longum | Forward | TTCCAGTTGATCGC ATGGTCTTCT | 11 | Initial denaturation at 95° C. for 10 min, 30 cycles at 95° C. for 15 sec, 65° C. for 1 min, and 72° C. for 45 sec |
| | Reverse | GGCTACCCGTCGAA GCCACG | 12 | |
| B. longum subsp. longum | Forward | CCGCATCACAACTG CTATTGG | 3 | Initial denaturation at 95° C. for 5 min, 30 cycles at 95° C. for 15 sec, 58° C. for 15 sec, and 72° C. for 20 sec |
| | Reverse | CGAAAGCCCCAATT TGTTCGT | 4 | |

Growth Measurement

The ability of selected strains to grow on XOS was performed in mMRS containing 1% XOS. Controls were prepared in mMRS either with 1% glucose (mMRS-glucose) or the equivalent amount of residual carbohydrates present in the 95% pure XOS (about 0.035%, final concentration; mMRS-res). The residual sugars were predicted to be equal proportions of glucose, fructose and sucrose based on the manufacturer's specification sheet. Furthermore, the mMRS media was prepared at half strength (i.e., using only half the amount of ingredients present in standard MRS) in order to minimize growth on background carbohydrates.

Test strains were first streaked onto BSIM plates from frozen stock cultures and incubated for 48 hours anaerobically at 37° C. Single colonies were isolated and inoculated into MRS broth for 24 hours at 37° C. Then, 1% (v/v) of the cultures were transferred into fresh MRS. These subcultures were incubated for 12 hours overnight before they were inoculated at 1% (v/v) into pre-warmed, pre-reduced mMRS, mMRS-XOS, mMRS-glucose, or mMRS-res. Cultures were then incubated anaerobically at 37° C., and growth was determined by measuring the optical density at 600 nm every 4 hours for the first 12 hours and again at 24 hours using a plate reader (Synergy HTX Plate Reader, BioTek, Vermont, USA). All experiments were performed in triplicate.

16S rRNA Amplicon Sequencing and Analysis 16S rRNA amplicon sequencing was performed on DNA extracted from fecal fermentations. Samples were sequenced on a 2×250 bp MiSeq sequencer, using primers for the V4 region of the 16S sequence. A total of 4,397,582 sequences were obtained with a mean of 36,954 sequences per sample.

Sequences were analyzed using QIIME2. Paired-end sequences were de-multiplexed prior to importing into QIIME. FastQC was used to check per sample sequence quality. Using the DADA2 workflow (found on the web at benjjneb.github.io/dada2/), chimeric sequences were removed and forward and reverse reads were truncated to 240 bp and 200 bp, respectively. Sequences were de-replicated into unique amplicon sequence variants (ASV) with DADA2, and a list of exact representative sequences were created. ASV refers to the exact sequences that are resolved through the DADA2 pipeline, as described previously. The resulting product is an ASV table recording the number of times by which an ASV was observed in each sample. A total of 974 features were identified. Taxonomy was assigned using the Greengenes database with the pre-trained classifier based on 99% sequence identity. Alpha diversity measures were calculated using a sample depth of 5171 sequences.

Statistical analysis for community sequencing data was done in QIIME and RStudio (ver 3.4.3). Two different alpha diversity measurements; Shannon index and Observed ASVs were computed. Pairwise comparisons between each treatment and time-point were made using Kruskal-Wallis test. FDR correction was incorporated for all statistical tests, and significance was determined using significance cutoff at 0.05. For beta diversity, Principal Coordinates Analysis (PCoA) and Principal Component Analysis (PCA) plots were prepared to compare community composition. The vegan (found on the web at github.com/vegandevs/vegan) package was used to compute Bray Curtis distance and conduct PERMANOVA analysis. Comparisons of the relative abundances of specific ASVs between XOS treatments at 96 hours were conducted using Wilcoxon rank sum test and visualized using Metacoder. Only taxa that had a relative abundance of greater than 0.1% were included in the analysis.

Short/Branched Chain Fatty Acids (S/BCFA) Analysis

S/BCFA concentrations were determined for all 20 fecal samples at all sample times using gas chromatography, similar to Yang and Rose. Briefly, 0.4 ml of fermentation supernatant was vortexed with approximately 0.16 g of NaCl and 0.2 ml of 9M sulfuric acid. Subsequently, 0.5 ml of diethyl ether was added, and tubes were shaken and briefly centrifuged. Then, 1 μl of the extract was injected into a gas chromatograph (Clarus 580; PerkinElmer, Waltham, Mass., USA) with a fused silica capillary column (Nukol 30 m×0.25 mm inner diameter×0.25 μm film thickness; Sigma-Aldrich, St. Louis, Mo., USA). Quantification of S/BCFA was carried out as described previously. Six samples could not be quantified due to insufficient amount of analyte. Subjects that comprised of any of these samples were removed and S/BCFA concentrations for 14 out of 20 subjects were used for the final statistical analysis. For comparison between treatments at every time point, a Kruskal Wallis test was conducted along with Wilcoxon rank sum test with FDR adjustment.

PICRUSt was used to relate taxonomic abundances from 16S data to functional S/BCFA metabolic genes, based on the Kyoto Encyclopedia of Genes and Genomes (KEGG) Ontology database. Correlation analysis between taxa and S/BCFA was also performed using the 16S sequencing data and all available S/BCFA concentrations. In addition, mean relative abundances of taxa and S/BCFA predicted metabolic genes were visualized for each treatment.

Results

Enrichment of XOS-Utilizing *Bifidobacterium* Strains

Figure 1B:
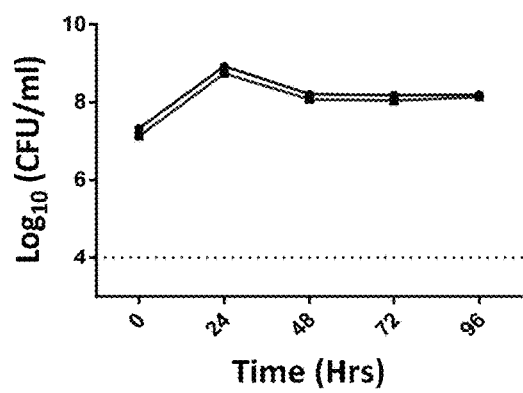
FIG. 1B is a graph illustrating enrichment of total *Bifidobacterium* (●) and *B. adolescentis* (■) in a sample from which *B. adolescentis* CR11 was isolated, wherein the Bifidobacteria was enriched by XOS in fecal environments whereas strain establishment was dependent on the strain and the host.

A total of 60 bifidobacteria isolates were initially obtained from enrichment experiments using 3 different fecal donor samples. A successful enrichment would be predicted by an increase or recovery of specific species of bacteria after every step-wise 100-fold dilution (FIG. 1A). Strains that were not enriched would be expected to be present at low abundance or entirely washed out (below detection levels) at the end of the four fermentation cycles (about 25 generations). From the 60 isolates obtained, identification through BLASTn of the 16S rRNA Sanger-based sequences resulted in 7 unique bifidobacteria strains. These included five strains of *B. adolescentis* and one each of *B. pseudocatenulatum* and *B. longum*. Quantification at the genus level using qPCR revealed enrichment of total *Bifidobacterium* in all 3 samples. Specifically, one *B. adolescentis* isolate was obtained from a sample displaying enrichment in species of *B. adolescentis* (FIG. 1B), and this isolate, *B. adolescentis* CR11 was chosen for subsequent establishment experiments.

Establishment of *B. adolescentis* CR11 and Surprising Discovery of *B. longum* Subsp. *Longum* CR15

Figure 1C:
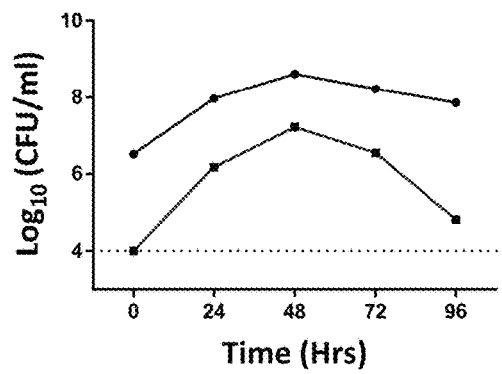
FIG. 1C is a graph illustrating the unsuccessful establishment of *B. adolescentis* CR11 (■) with commensurate enrichment of total *Bifidobacterium* (●) enriched by XOS in fecal environments whereas strain establishment was dependent on the strain and the host.

The ability of a strain to become established in an in vitro fecal environment was assessed in establishment experiments in a manner similar to that of the XOS enrichment, except that the test strain was included along with the prebiotic. A successful establishment was denoted by persistence of the test strain during the test period, whereas a failed establishment was indicated by a decrease in abundance or washout of the test strain over the test period. When *B. adolescentis* CR11 was reintroduced in a new fecal sample along with the prebiotic at the start of fermentation, quantification by genus-specific qPCR revealed that enrichment of *Bifidobacterium* was initially observed (FIG. 1C). Surprisingly, based on species-specific qPCR, it was evident that *B. adolescentis* had been displaced by other bifidobacteria. Indeed, all of the isolates (n=10) subsequently recovered by culturing were identified as *B. longum* by 16S Sanger sequencing.

Figure 1D:
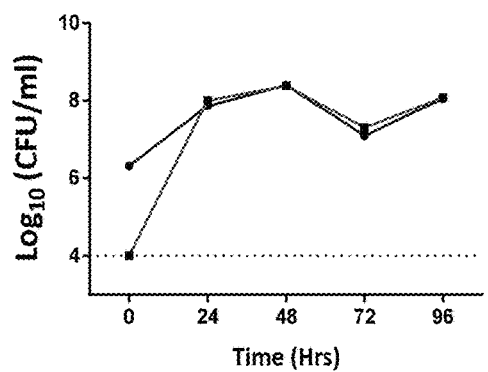
FIG. 1D is a graph illustrating the establishment of *B. longum* subsp. *longum* CR15 (■) and total *Bifidobacterium* (●). Horizontal dashed lines indicate limits of detection ($10^4$ CFU/mL) and the *Bifidobacterium* was enriched by XOS in fecal environments whereas strain establishment was dependent on the strain and the host.
Figure 2:
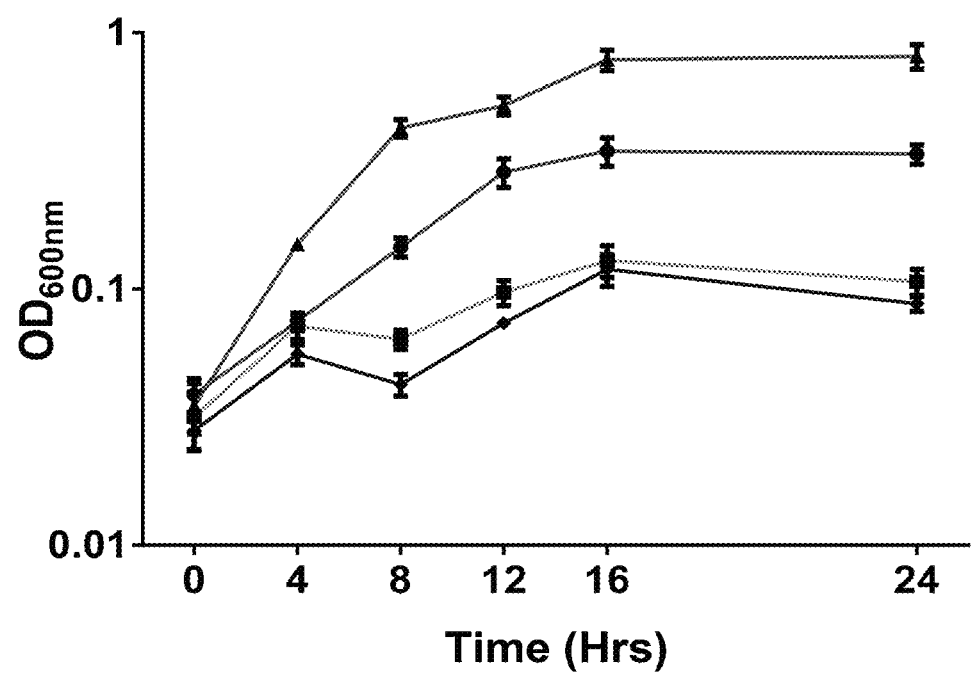
FIG. 2 is a graph illustrating the growth of *B. longum* subsp. *longum* CR15 in minimal media supplemented with sugars. Optical density measurements at a wavelength of 600 nm were taken at 4-hour periods within the first 16 hours and again at 24 hours in mMRS (♦) and in mMRS containing the equivalent amounts of residual sugars in the XOS (■), 1% glucose (▲), 1% XOS (•); 1% XOS DPs 2,3,4 ( ⬤ ) and 1% XOS DP≥4 (▼).

The *B. longum* strain (identified and named as *B. longum* subsp. *longum* CR15) was subsequently introduced into another fecal sample. Quantification revealed stable enrichment of *B. longum* species, with 100% of the isolates (n=10) identified as *B. longum* (FIG. 1D). Growth of *B. longum* subsp. *longum* CR15 in mMRS-XOS demonstrated that this strain was able to utilize XOS with a preference for polymers with a low degree of polymerization.

Genome Assembly and Annotation of *B. longum* Subsp. *Longum* CR15

Whole genome sequence data was generated (a total of 296 Mbp), and a draft genome of 2.4 Mbp was assembled with 96% coverage against a reference genome. Annotation against the CAZy database identified several proteins associated with XOS utilization, including the glycosyl hydrolases, GH43 and GH120 and carbohydrate binding molecules, CBM6 and CBM22. In addition, relevant sugar transport and utilization genes were annotated with Prokka and TransAAP as D-xylulose 5-phosphate (xfp), xylose isomerase (xylA), xylulokinase (xylB), (3-xylosidase (xynB), xylose import ATP-binding protein (xylG), xylose transport system permease protein (xylH) and ABC-type xylose transport system (xylF). Strain specific primers targeting the adenine-specific methyltransferase PaeR71 gene were subsequently designed from the genome.

Establishment of *B. longum* Subsp. *Longum* CR15 is Host-Dependent

Figure 3:
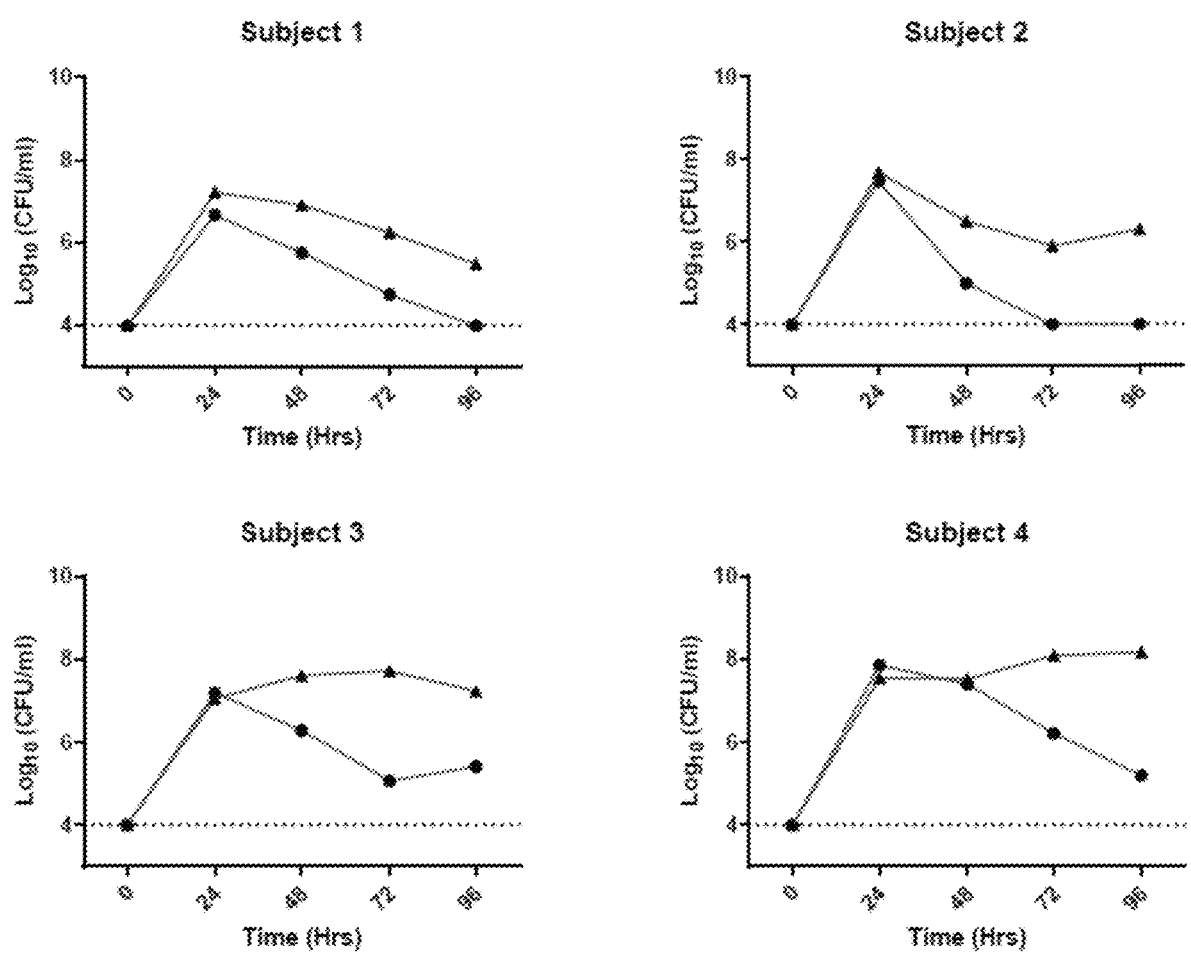
FIG. 3 is a series of graphs illustrating the establishment of *B. longum* subsp. *longum* CR15 after inoculation into 20 individual fecal samples in the presence (▲) or absence (•) of XOS. For each experiment, the strain was inoculated at $10^7$ CFU/mL and quantified by RT-qPCR using strain-specific primers. Horizontal dashed lines indicate the limit of detection ($10^4$ CFU/mL)
Figure 3:
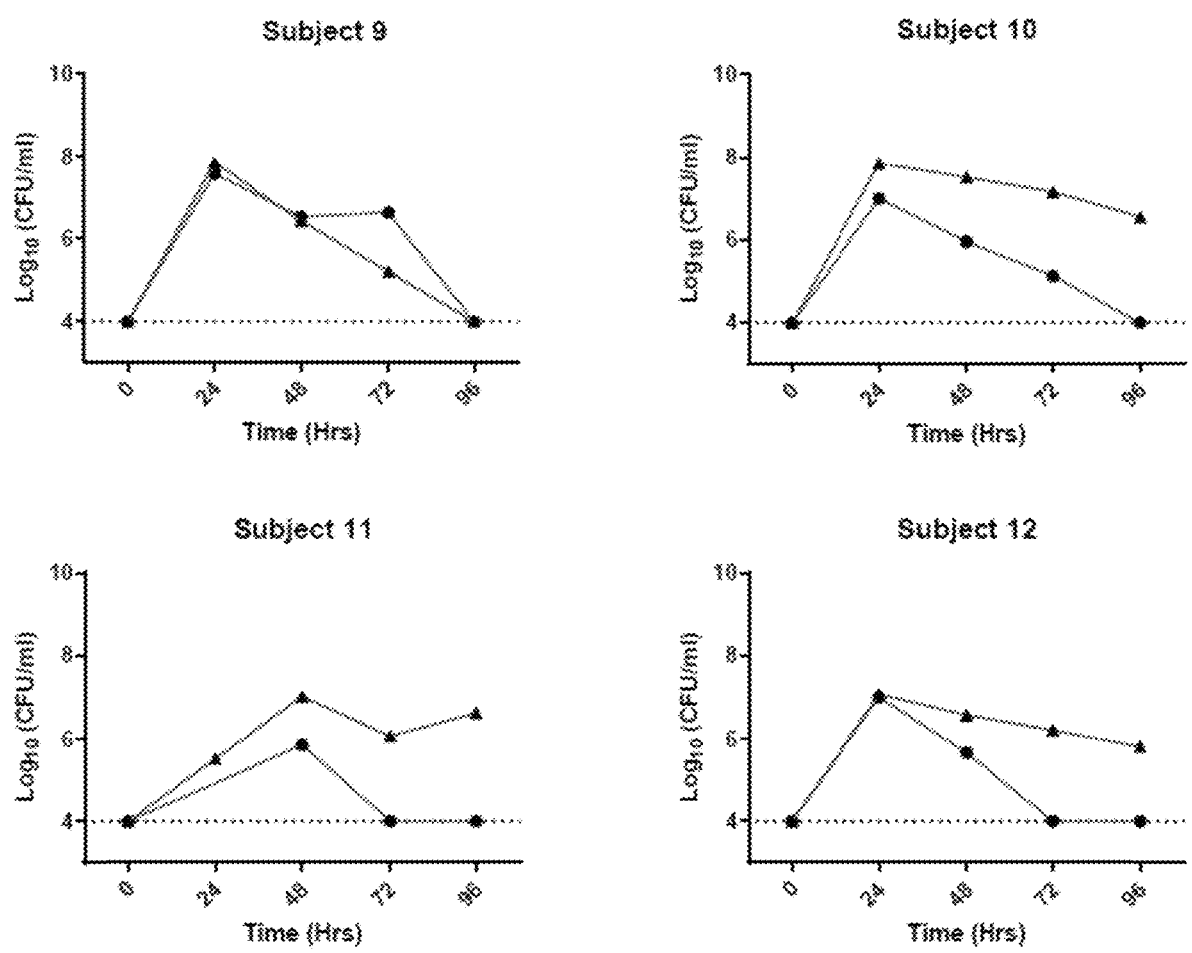
Figure 3:
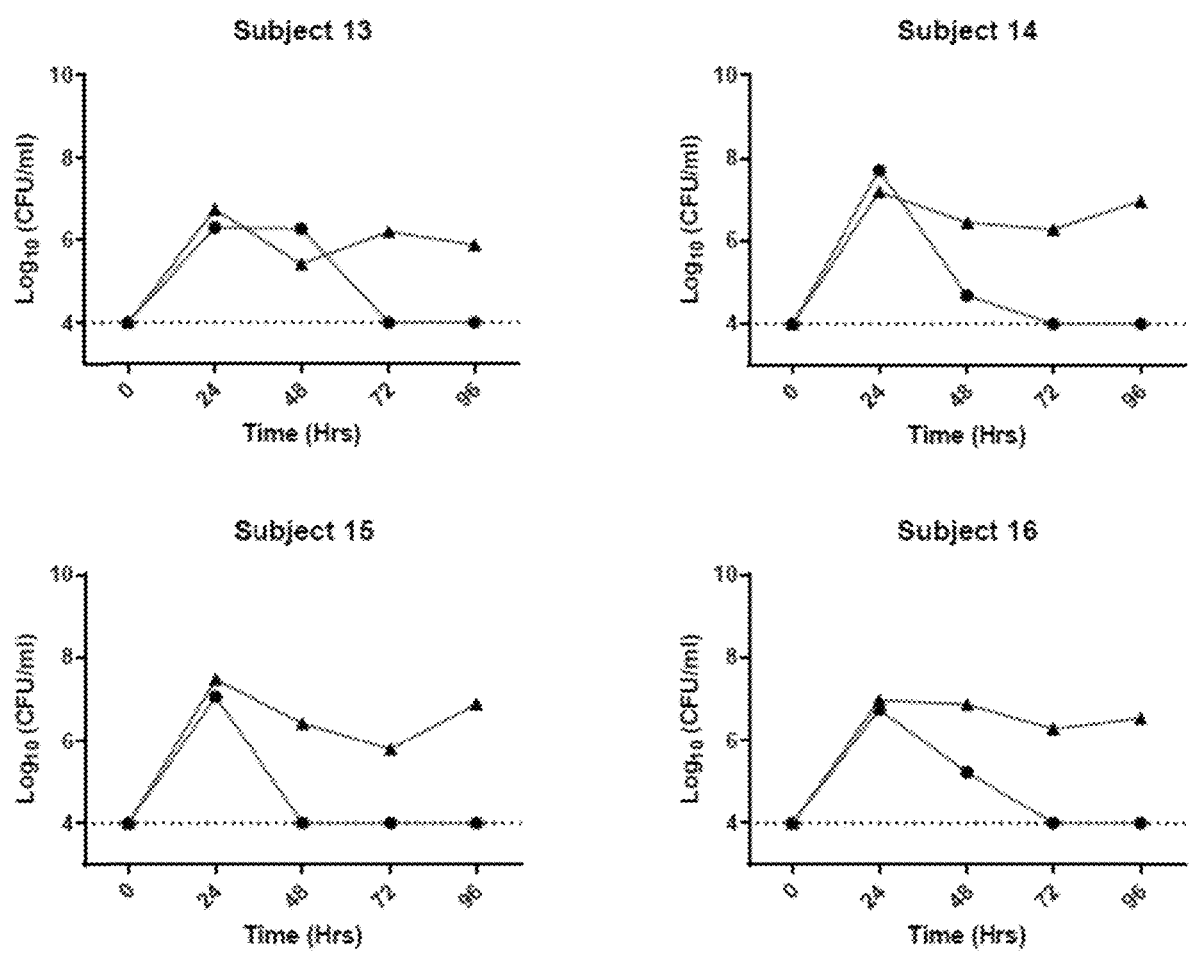
Figure 3:
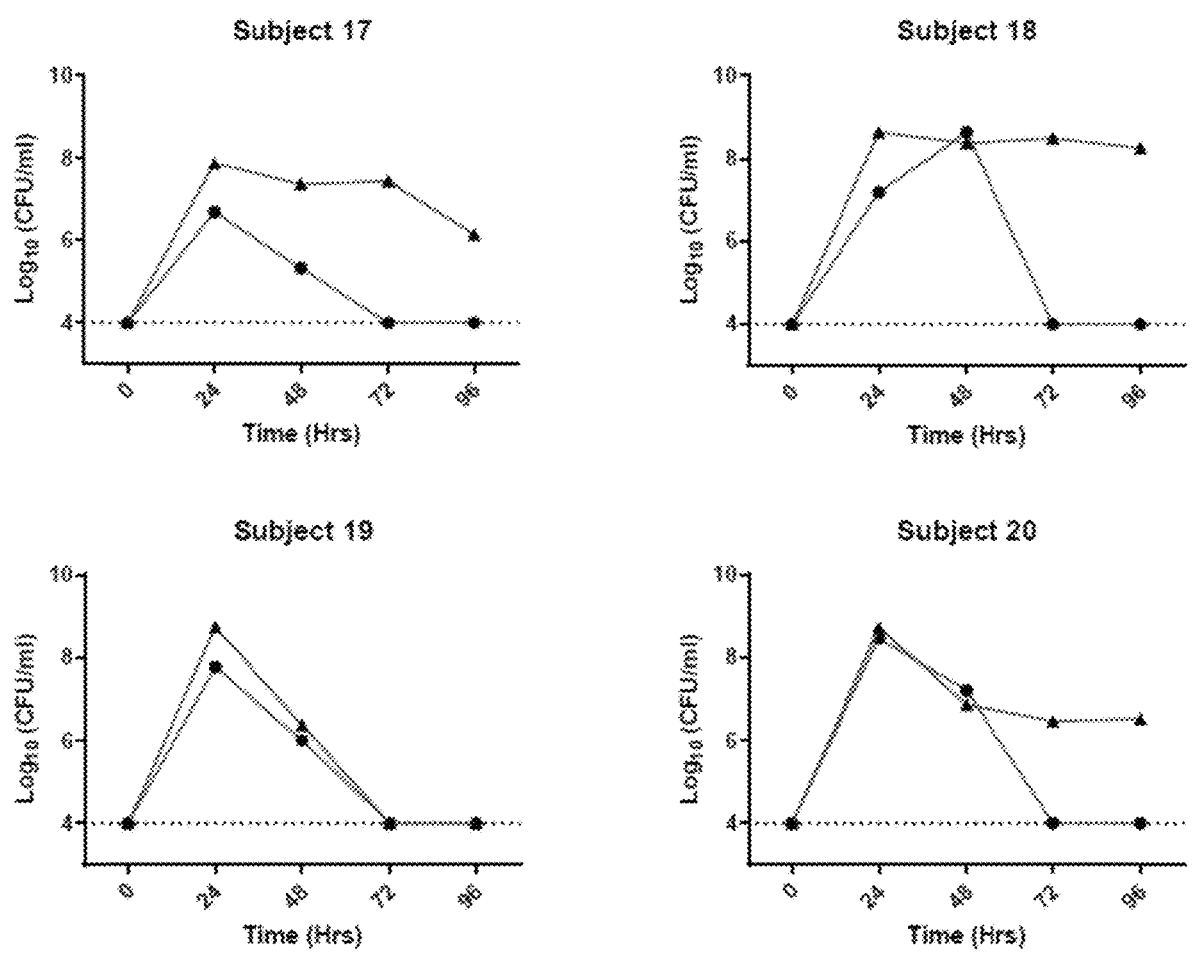

Additional establishment experiments with *B. longum* subsp. *longum* CR15 and XOS were performed using 20 individual donor samples. Experiments in the absence of XOS were conducted in parallel and served as controls. In the presence of XOS, strain-specific qPCR quantification revealed that the CR15 strain was clearly established in 7 samples; another 11 demonstrated intermediate establishment (FIG. 3, 4A-B). The latter included samples in which CR15 levels fluctuated between the start and end of fermentation or decreased by less than 2 logs (FIG. 4C). Only in two samples did the CR15 strain fail to become established (FIG. 4D). *B. longum* subsp. *longum* CR15 was either reduced or completely washed out in the no-prebiotic-containing controls.

XOS Treatment Differentially Shifts the Fecal Microbial Community

Figure 5A:
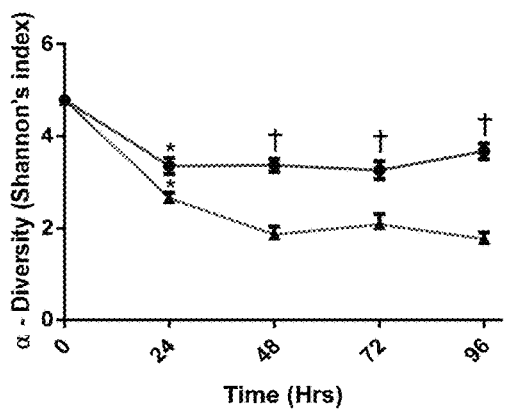
FIG. 5A is a graph illustrating an analysis of microbial community composition and diversity across treatments using the Shannon measure of α-diversity.
Figure 5B:
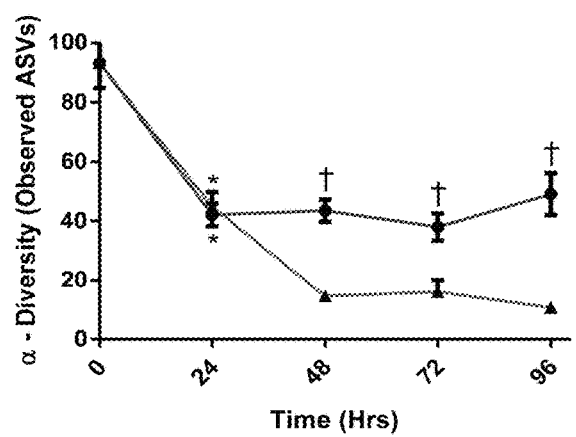
FIG. 5B is a graph illustrating an analysis of microbial community composition and diversity across treatments using the number of ASV's measure of α-diversity.
Figure 5C:
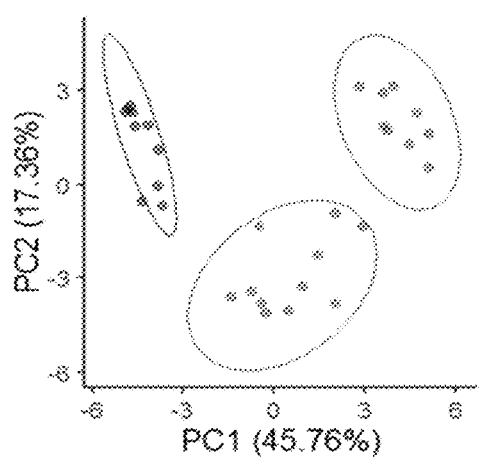
FIG. 5C is a graph illustrating Principal Coordinate Analysis (PCoA); and revealing distinct community profiles between groups at baseline (blue) and at the end of the fermentation period, with (green) or without (red) XOS (PERMANOVA, p=0.001). * indicates significant difference between 0 and 24 hours. † indicates significant differences between treatments at a particular timepoint.
Figure 5D:
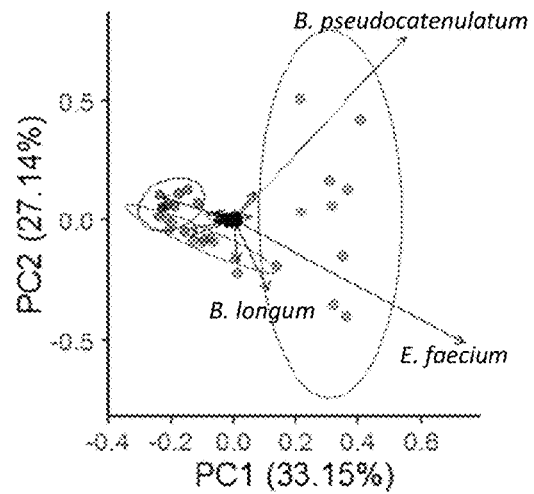
FIG. 5D is a graph illustrating Principal Component Analysis (PCA) and revealing distinct community profiles between groups at baseline (blue) and at the end of the fermentation period, with (green) or without (red) XOS (PERMANOVA, p=0.001). * indicates significant difference between 0 and 24 hours. † indicates significant differences between treatments at a particular timepoint.

Next, 16S amplicon sequencing was performed to investigate changes in community structure in a subset of 10 samples. To assess alpha diversity of the samples over time, Shannon's index and observed amplicon sequence variants (ASVs) were computed. There was an initial significant decrease in diversity (FDR<0.05) from 0 to 24 hours for both treatments (FIG. 5A-B). However, no further changes were observed after the first 24-hour time point. Throughout the fermentation period, the diversity of the XOS supplemented samples were significantly lower than the no-prebiotic controls (FDR<0.05). Beta diversity analysis of the samples at baseline and at the end of fermentation was visualized using Principal Coordinate Analysis (PCoA) based on Bray-Curtis distance. The samples at baseline clustered together while fermentation samples at 96 hours clearly clustered separately based on treatment (FIG. 5C). Principal Component Analysis (PCA) revealed that *B. longum*, *B. pseudocatenulatum* and *Enterococcus faecium* were drivers in the XOS group (FIG. 5D).

Figure 6A:
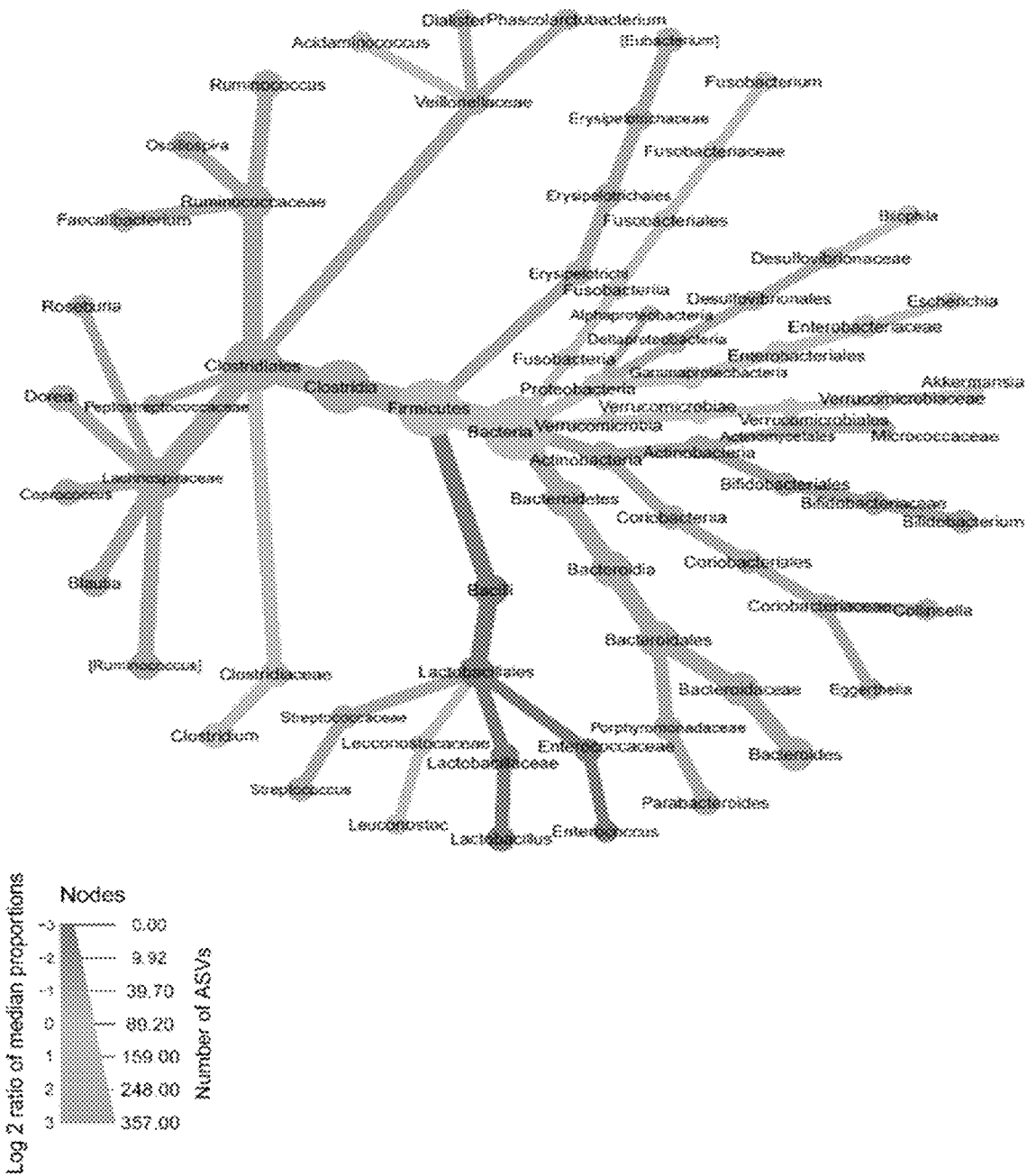
FIG. 6 illustrates significant changes in taxa driven by XOS in establishment experiments with *B. longum* subsp. *longum* CR15. Wilcoxon rank sum test with FDR adjustment was used to identify significantly different taxa (FDR<0.05) in the presence (A) and absence (B) of XOS. Nodes in orange indicate greater abundance at baseline compared to 96 hours whereas nodes in green and red indicate greater abundance at 96 hours compared to baseline.
Figure 6B:
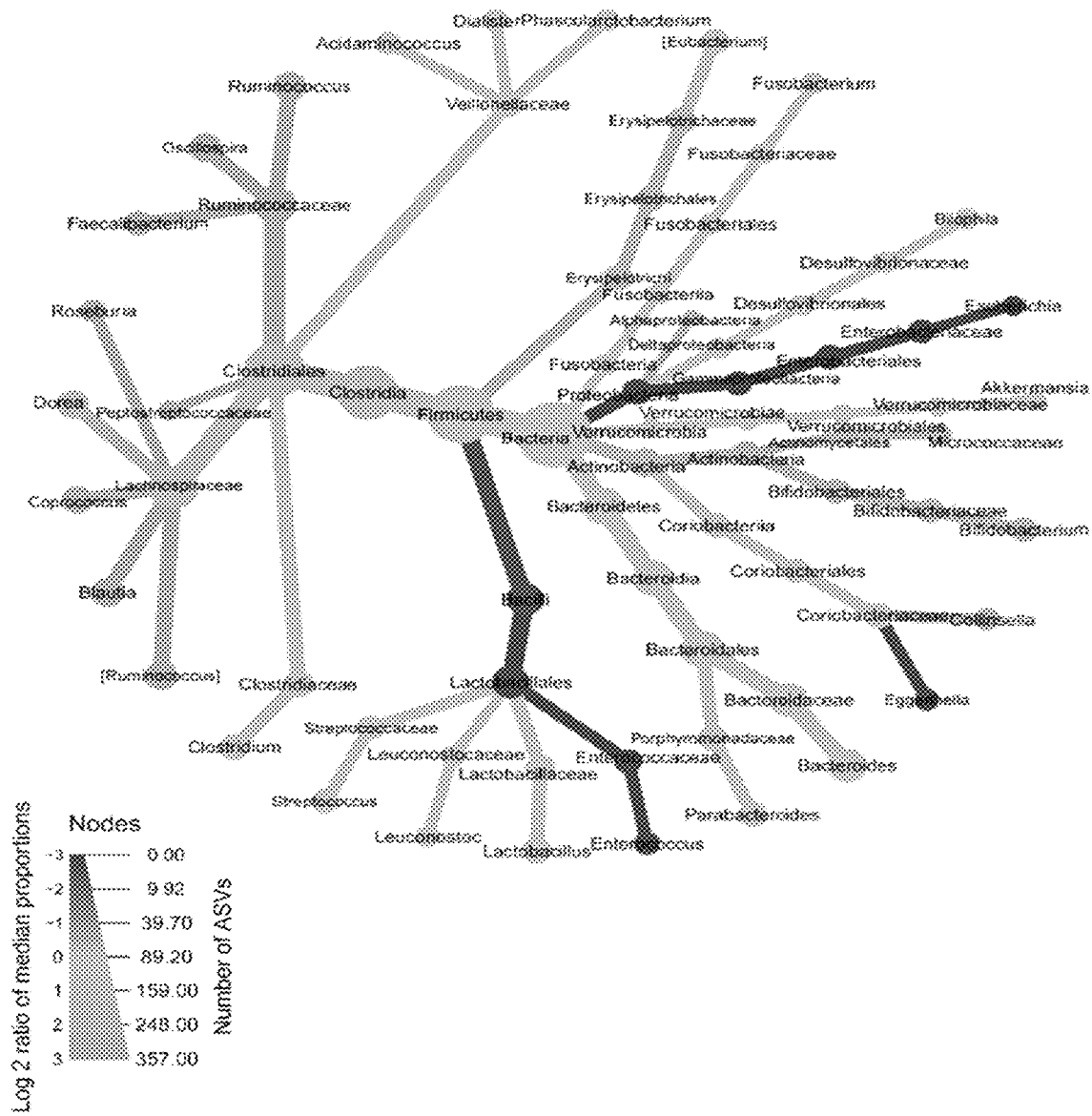

Taxonomic analysis of the 16S rRNA sequences revealed a highly bifidogenic response in the presence of XOS as well as significant enrichment of *Lactobacillus* that was not observed in the no-XOS controls (FIG. 6A). Enrichment of *Enterococcus* was also observed after 96 hours for both the XOS and no-XOS treatments (FIG. 6A-B). Three specific *Bifidobacterium* ASVs were investigated for their contribution towards the bifidogenic response throughout the fermentation duration (FIG. 7A-C). BLASTn of these specific sequence variants against the NCBI nr database revealed that they belonged to the species *B. longum*, *B. pseudocatenulatum* and *B. adolescentis*. These species were also previously observed from the 16S Sanger sequencing of isolates that were obtained post-fermentation.

Co-Enrichment of *B. longum* Subsp. *Longum* CR15 and *B. pseudocatenulatum*

Additional analyses revealed differences in the mean abundance of the *B. longum* and *B. pseudocatenulatum* ASVs between treatments. In the first 24 hours, the mean percentage relative abundance of the *B. longum* ASV increased from 4% to 43% in fermentations with XOS but only to 11% in the no-prebiotic controls (FIG. 7A). While a subsequent decrease in abundance of the *B. longum* ASV was observed in both treatments, only 1% remained at 96 hours in the controls compared to 10% in the XOS fermentations (FIG. 7A). In addition, there was an average increase from 4% to 29% in the *B. pseudocatenulatum* ASV in the XOS-supplemented fermentations after 96 hours (FIG. 7B). Low abundance of the *B. adolescentis* ASV was observed throughout the fermentation in both XOS and no-XOS treatments (FIG. 7C).

The effect of *B. pseudocatenulatum* on persistence of CR15 was determined by species-level qPCR. In most cases (n=11), when *B. pseudocatenulatum* was absent (i.e., below detection) in fecal samples at baseline, levels remained low throughout fermentation and successful establishment of *B. longum* subsp. *longum* CR15 was observed (FIG. 8B). In contrast, *B. pseudocatenulatum* was able to persist and co-occur with CR15 if detectable levels of this organism were present at baseline (n=9) (FIG. 8A).

Figure 10A:
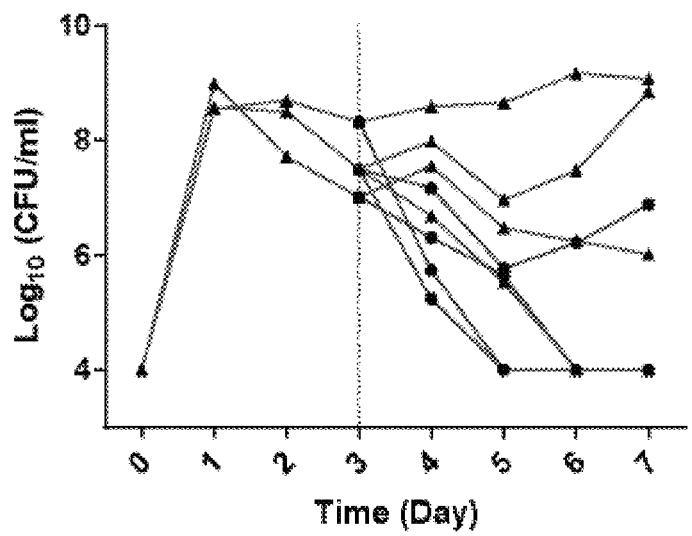
FIG. 10A is a graph illustrating qPCR quantification of *B. longum* subsp *longum* CR15 throughout fermentation with (▲) and without (•) XOS in the 4 samples tested.
Figure 10B:
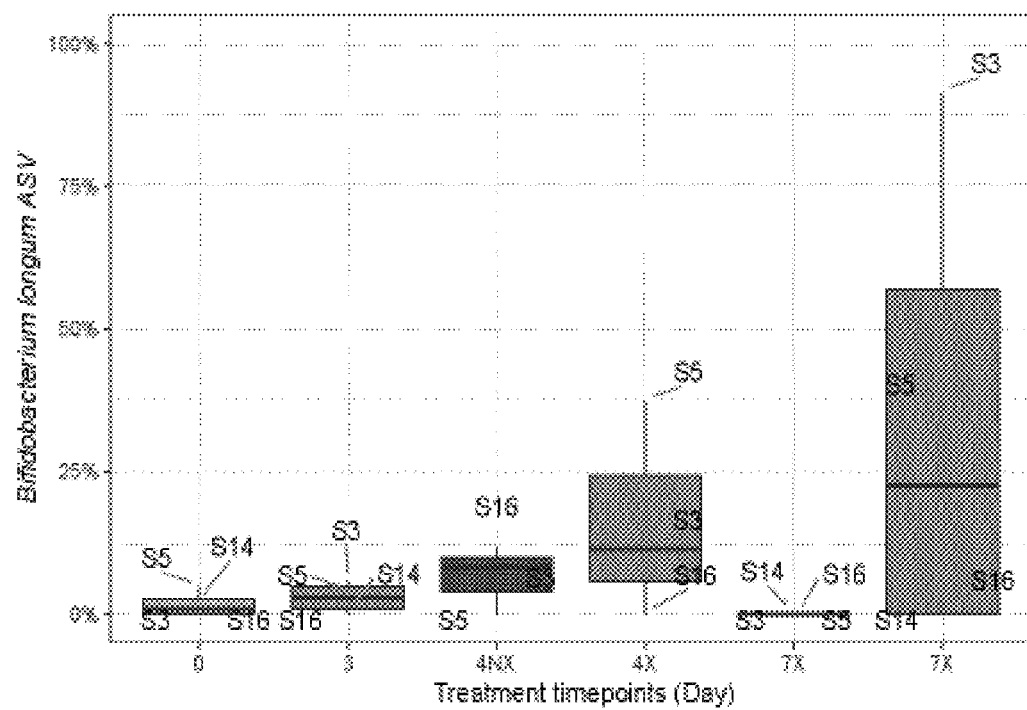
FIG. 10B is a graph illustrating the relative abundance of *B. longum* in the presence of XOS at each time point, wherein 0 is the baseline of samples at the start of fermentation, NX is fermentation without XOS, X is fermentation with XOS, and wherein day 4 samples for S14 were not sequenced and ▲; +XOS, •; −XOS.
Figure 10C:
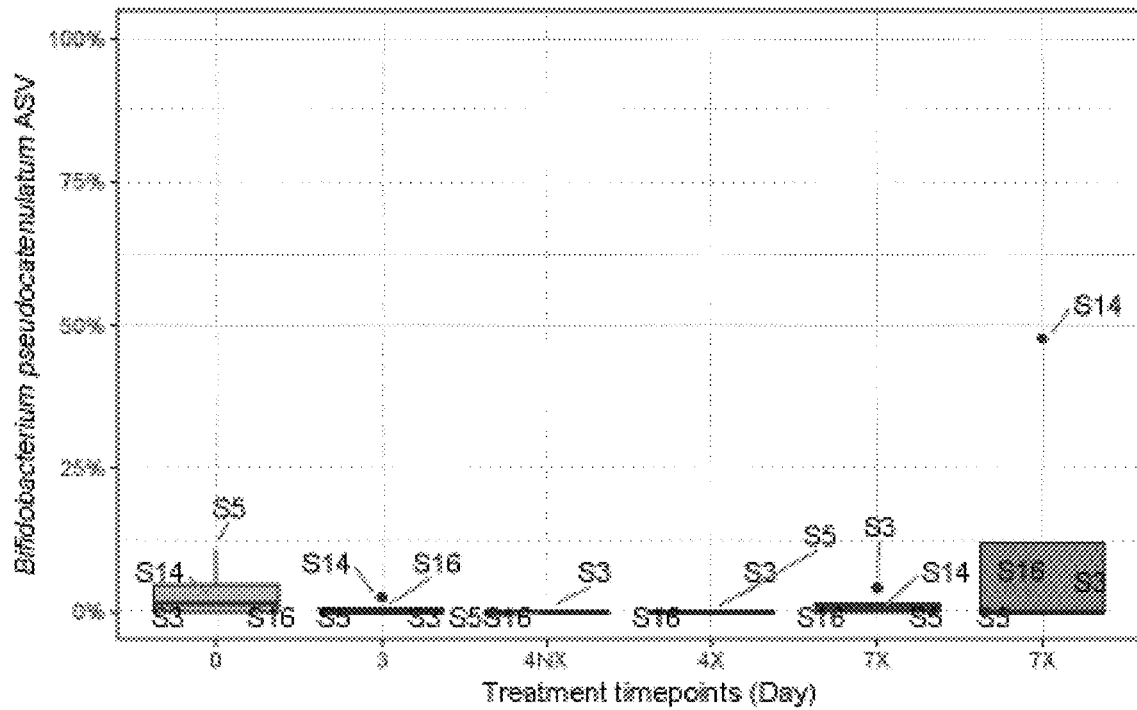
FIG. 10C is a graph illustrating the relative abundance of *B. pseudocatenulatum* in the presence of XOS at each time point, wherein 0 is the baseline of samples at the start of fermentation, NX is fermentation without XOS, X is fermentation with XOS, and wherein day 4 samples for S14 were not sequenced and ▲; +XOS, •; −XOS.
Figure 10D:
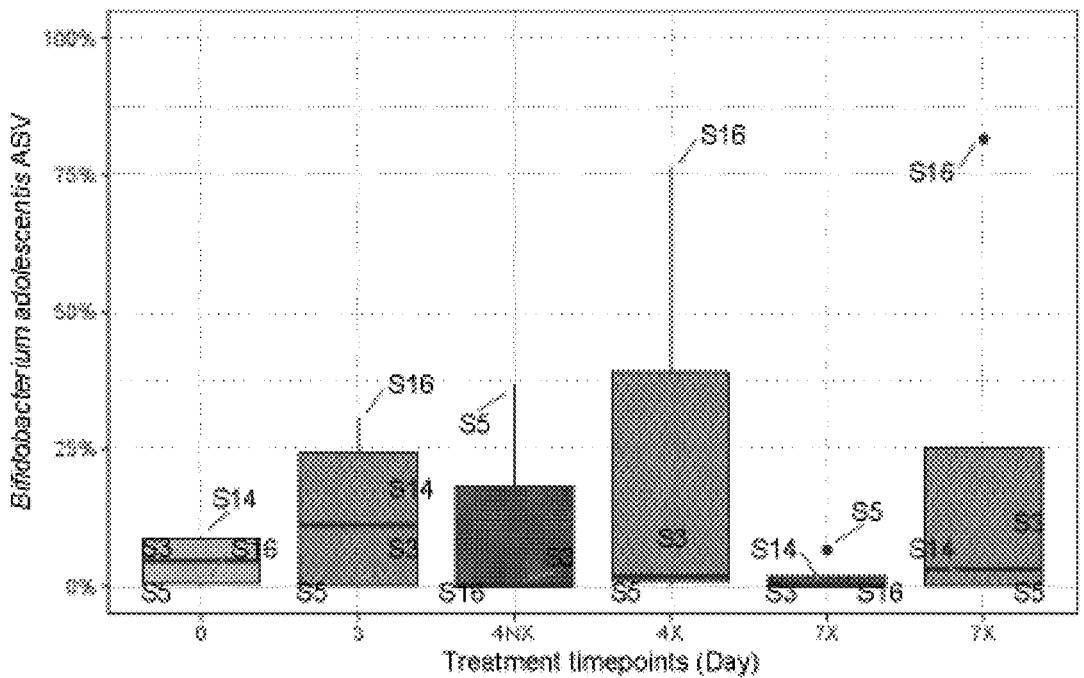
FIG. 10D is a graph illustrating the relative abundance of *B. adolescentis* in the presence of XOS at each time point, wherein 0 is the baseline of samples at the start of fermentation, NX is fermentation without XOS, X is fermentation with XOS, and wherein day 4 samples for S14 were not sequenced and ▲; +XOS, •; −XOS.

To further investigate the persistence potential of *B. longum* subsp. *longum* CR15, a 7-day washout experiment was performed using a subset of 4 of the 20 fecal samples. In 2 samples (Subjects 3 and 4), high numbers of *B. longum* subsp. *longum* CR15 were maintained through day 7. However, in the other 2 samples (Subjects 14 and 16), *B. longum* subsp. *longum* CR15 were decreased or washed out by day 7, even in the presence of XOS (FIG. 10A,B). Subsequent 16S amplicon sequencing of these day 7 samples revealed high abundance of two ASVs corresponding to *B. adolescentis* and *B. pseudocatenulatum* (FIG. 10 C,D). This 7 day fermentation experiment further demonstrates dependency of *B. longum* subsp. *longum* CR15 on XOS along with host-dependent response. Samples were first supplemented with XOS and stepwise transfers were carried out for the first 3 days. A split was done during day 3 with parallel transfers into XOS-containing fermenters and in fermenters without XOS. Subsequent step-wise transfers were conducted from day 4 to day 7 following the respective treatments at the split. 16S sequencing was carried out for samples for Days 0, 3, 4, and 7. The 16S RNA sequence for *B. longum* subsp. *longum* CR15 is SEQ ID NO. 13 and the 16S RNA sequence for *B. pseudocatelenatum* CR16 is SEQ ID NO. 14.

Acetate is Enriched in XOS-Supplemented Fermentations

Short and branched chain fatty acid (S/BCFA) profiles were obtained for all 20 *B. longum* subsp. *longum* CR15 establishment experiments in the presence and absence of XOS. At all time points, acetate levels were highest, followed by lower levels of propionate and butyrate (Table 4). At 24 hours, acetate and total SCFA levels were significantly higher in the prebiotic group, whereas by 48 hours, butyrate and propionate levels were significantly higher in the control group. By 96 hours, the BCFAs, isobutyrate and isovalerate, were significantly higher in the control group. After 24 hours, SCFA production remained generally stable for both treatments.

TABLE 4

Concentrations of S/BCFA from fermentation supernatants of establishment experiments with *B. longum* subsp. *longum* CR15.

| Microbial metabolite | 0 h | mean S/BCFA concentration (mM) ± SEM | | | | | | |
|---|---|---|---|---|---|---|---|---|
| | | 24 h | | 48 h | | 72 h | | 96 h | |
| | | Control | XOS | Control | XOS | Control | XOS | Control | XOS |
| Acetate | 8.72 ± 3.61 | 18.65 ± 2.35 | 34.94 ± 3.73†* | 11.65 ± 2.18 | 33.64 ± 3.69† | 8.94 ± 1.26 | 41.25 ± 5.03† | 11.59 ± 1.87 | 42.24 ± 2.85† |
| Butyrate | 0.05 ± 0.01 | 0.69 ± 0.21* | 0.53 ± 0.26 | 1.04 ± 0.21 | 0.48 ± 0.18† | 1.07 ± 0.23 | 0.43 ± 0.21 | 0.94 ± 0.19 | 0.35 ± 0.18† |
| Propionate | 0.09 ± 0.05 | 0.5 ± 0.33 | 0.39 ± 0.19 | 1.35 ± 0.22* | 0.06 ± 0.03† | 1.24 ± 0.23 | 0.04 ± 0.02† | 1.46 ± 0.20 | 0.05 ± 0.02† |
| Total SCFA | 8.87 ± 3.64 | 19.84 ± 2.60* | 35.85 ± 3.38†* | 14.04 ± 2.39 | 34.18 ± 3.67† | 11.25 ± 1.61 | 41.72 ± 5.04† | 13.99 ± 1.84 | 42.64 ± 2.85† |
| Isobutyrate | 0.01 ± 0.003 | 0.01 ± 0.004 | 0.02 ± 0.01 | 0.07 ± 0.04 | 0.01 ± 0.01 | 0.05 ± 0.02 | 0.003 ± 0.001 | 0.11 ± 0.05 | 0.01 ± 0.004† |
| Isovalerate | 0.02 ± 0.003 | 0.02 ± 0.01 | 0.17 ± 0.12 | 0.21 ± 0.09 | 0.18 ± 0.14 | 0.38 ± 0.18 | 0.29 ± 0.25† | 0.19 ± 0.06 | 0.04 ± 0.02† |
| Total BCFA | 0.02 ± 0.005 | 0.03 ± 0.01 | 0.18 ± 0.12 | 0.27 ± 0.11 | 0.19 ± 0.14 | 0.43 ± 0.19 | 0.3 ± 0.25† | 0.3 ± 0.11 | 0.05 ± 0.02† |

Figure 9:
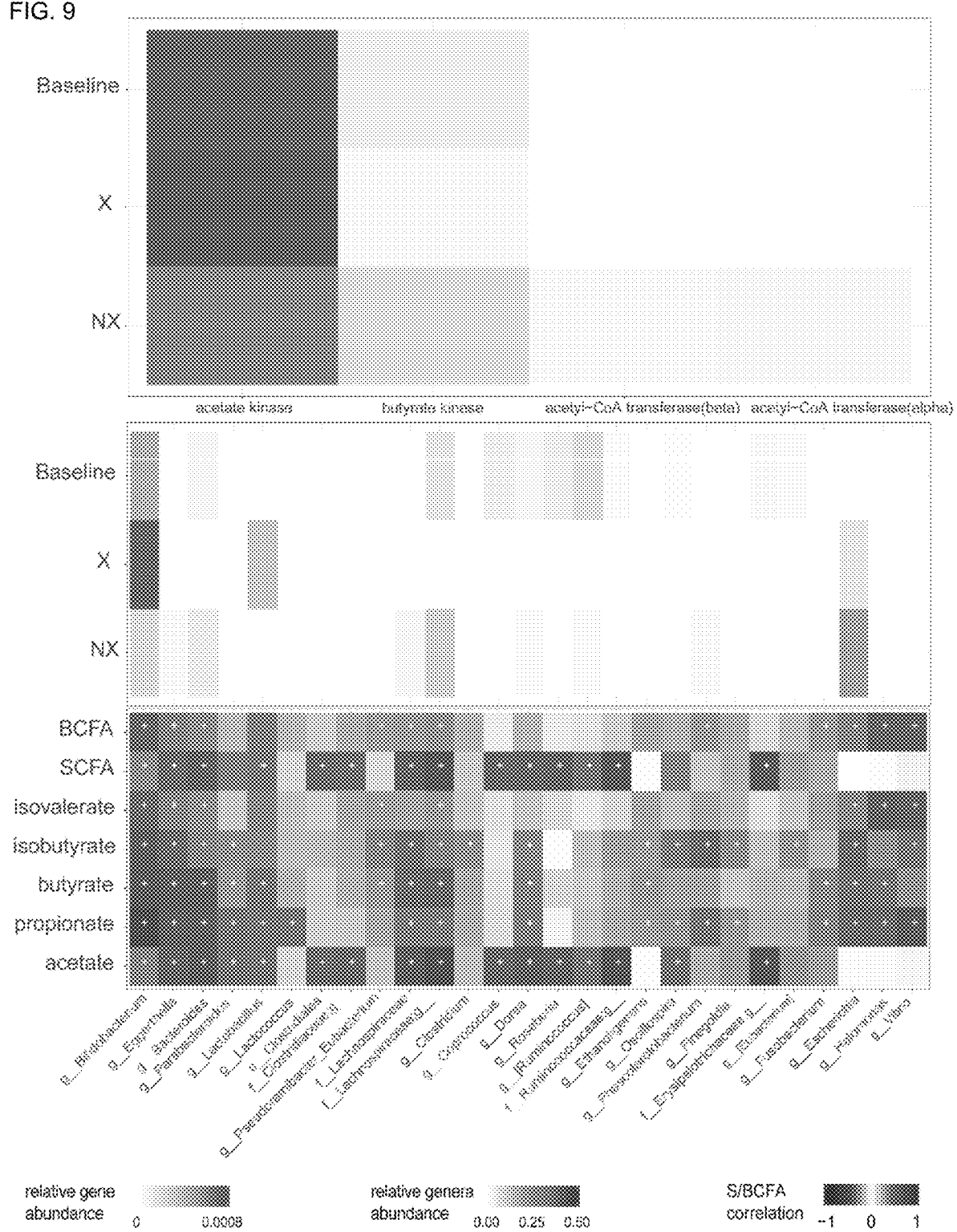
FIG. 9 is a set of graphs illustrating mean relative abundances for taxa and predicted S/BCFA genes and correlation of microbial fermentation metabolites with genera identified in the fermentation samples. Only genera that had at least one significant correlation with a metabolite were mapped. +significant correlation between genus abundance and concentration of metabolite (FDR<0.05). SCFA; short chain fatty acids, BCFA; branched chain fatty acids, X; XOS, NX; No XOS.

SEM; standard error of mean
*denotes significant difference than the previous timepoint
†denotes significant difference between XOS and control treatments within a timepoint.
SCFA; short chain fatty acids, BCFA; branched chain fatty acids PICRUSt was used to assess differences in the abundance of predicted metabolic genes involved in acetate and butyrate production between treatments. Specifically, butyrate kinase, acetate kinase and acetyl-CoA transferase genes were investigated. As expected, metagenome predictions indicated higher levels of acetate kinase genes in the XOS group. Likewise, higher levels of butyrate kinase and acetyl-CoA transferase genes in the control group were also predicted (FIG. 9). Further investigation of family-level taxonomic contributions towards those genes suggested that Prevotellaceae, Paraprevotellaceae, Bacteroidaceae and Rikenellaceae contributed towards butyrate kinase. A total of 11 and 46 taxa were identified to contribute towards acetyl-CoA transferase and acetate kinase, respectively. Among those, taxa that contributed towards acetate kinase were Bifidobacteriaceae and Lactobacillaceae while Enterobacteriaceae, Lachnospiraceae, Ruminococcaceae were identified as contributors of acetyl-CoA transferase. Correlation analysis between genera abundance and S/BCFA concentrations confirmed significant positive correlation between *Bifidobacterium* and *Lactobacillus* with acetate (FIG. 9). *Eggerthella, Bacteroides* and Lachnospiraceae were among several genera that were positively correlated with butyrate and propionate.

The whole genome sequence of *B. longum* subsp. *longum* CR15 (SEQ ID NO. 5) is uploaded in the NCBI database at PRJNA540282 and PRJNA540304, respectively and 16S rRNA sequencing of fermentation samples are uploaded in the NCBI database and can be found at PRJNA540282 and PRJNA540304, respectively.

Discussion

In this study, we developed an in vitro enrichment (IVE) platform for isolating prebiotic-enriched strains that could be combined with the cognate prebiotic to form synergistic synbiotics. Enrichment was performed using a bifidogenic and highly selective substrate, XOS. Overall, 15 unique *Bifidobacterium* isolates were obtained. All belonged to one of three species, *B. pseudocatenulatum, B. longum*, and any extract or combination thereof *B. pseudocatenulatum*, and *B. longum*, which are among the predominant resident *Bifidobacterium* species found in adults. Of these 3 species, *B. adolescentis* and *B. longum* have been well studied for their probiotic properties, as well as for their growth potential on XOS. In contrast, the probiotic potential of *B. pseudocatenulatum* has not been well explored. However, it is known to ferment dietary fibers, including XOS.

Compared to strain enrichment by prebiotics, strain establishment is a more complex and challenging process. Indeed, probiotic microbes rarely persist after the supplementation period has ended. This is due, in part, to the individuality and highly competitive nature of the gut microbiome, as well as the absence of open ecological niches. These factors likely contribute to the responder/non-responder phenomenon that is commonly observed in dietary intervention studies. Thus, the absence of an available ecological or functional niche could inhibit or prevent the establishment of a particular strain.

In contrast, provision of a prebiotic or other specialized nutrient, along with a suitable probiotic, could provide a new nutrient niche, enhance persistence, and reduce the frequency of non-responder phenotypes. In this in vitro study, combining the XOS-enriched *B. longum* subsp. *longum* CR15 strain with XOS promoted strain establishment in most of the 20 unique fecal samples, with steady-state populations maintained at about $10^7$ CFU/ml. Although variation in the persistence phenotype was observed, the CR15 strain was unable to persist in only two samples. XOS-dependent establishment was confirmed by the rapid washout of CR15 in fermentations in the absence of the prebiotic.

While qPCR was useful for measuring populations of specific genera, species, or strains, community sequencing provided an independent basis for assessing changes in microbial composition. Taxonomic results confirmed that enrichment of *B. longum* occurred as a result of XOS supplementation. This observation also suggested that a specific *B. longum* ASV that was present in high abundance was representative of the CR15 strain, although it may be comprised of other closely related *B. longum* strains that shared high 16S sequence similarity.

Interestingly, community analysis also revealed that the *B. longum* ASV/CR15 strain was not always the dominant *Bifidobacterium*. In some samples, *B. pseudocatenulatum* and *B. pseudocatenulatum*, as represented by two other unique ASVs, were prevalent during the fermentations, and their growth was clearly supported by the presence of XOS. In particular, *B. pseudocatenulatum* was present in high abundance across multiple samples. This was further confirmed by qPCR showing that levels of *B. pseudocatenulatum* remained high during the entire fermentation when present at baseline. Both methods suggested that *B. pseudocatenulatum* was also enriched by XOS. In some samples, an observed relative low abundance/absence of *B. longum* subsp. *longum* when *B. pseudocatenulatum* abundance was high suggested these two microbes were niche competitors.

The synbiotic treatment led to significantly lower alpha diversity measures, likely due to enrichment of bifidobacteria. This was further confirmed in the PCA plot where *Bifidobacterium* was a major driver differentiating the two treatments. Reduced diversity has been previously observed in in vitro studies of fiber fermentation.

When the step-wise fermentations were extended to seven days, CR15 again persisted in the presence of XOS for the first 4 days. However, beyond day 4, persistence was more variable. When CR15 was washed out, increased populations of *B. adolescentis* and *B. pseudocatenulatum* were observed.

SCFAs are beneficial by-products of gut metabolism that are associated with carbohydrate fermentation. Like other SCFAs, acetate serves as an energetic source for epithelial cells and comprises a high percentage of total SCFA produced in the gut. In the presence of XOS, the higher concentrations of acetate were likely due to fermentation by *Bifidobacterium* although it is possible that enriched lactobacilli (FIG. 6A) may have also produced acetate. However, the low butyrate levels were unexpected. This is because high abundance of bifidobacteria usually correlates with butyrate production via metabolic cross-feeding between acetate-producing bifidobacteria and acetate-consuming butyrate producers. In particular, Rivière et al. (2015) demonstrated both bifidogenic and butyrogenic effects of arabinoxylan oligossacharides (AXOS) in co-culture fermentations with strains of *B. longum* and *Eubacterium rectale*. Targeting of specific acetate and butyrate genes through gene prediction from 16S sequence data confirmed that acetate kinase was present at higher abundance in the in vitro system compared to butyrate kinase and acetyl-CoA transferase, and the same trend was observed in the XOS fermentations compared to the no-prebiotic controls. In addition, butyrate producers belonging to the Lachnospiraceae and Ruminococcaceae family, including Ruminococcus, *Coprococcus* and *Oscillospira*, were also present in higher abundance in the no-prebiotic controls. This suggests the possibility that butyrate producers may have been washed out during successive transfers. A similar finding was also observed in an in vitro fermentation model using infant stool samples. However, under in vivo conditions, the high acetate levels produced by CR15 would be expected to cross-feed butyrate producers, increase butyrate levels, and provide health benefits to the host.

In the latter study, supplementation of infant fecal fermentations with GOS exerted a bifidogenic effect with high concentrations of acetate, low concentrations of butyrate and low fecal pH. Interestingly, pH has previously been reported to influence bacteria communities and production of SCFA in vitro. This implies that improved buffering or pH control should be considered when designing batch in vitro models to study fecal communities and their metabolic byproducts.

Prebiotics are defined, in part, by virtue of their utilization by host microbes. Although functional demonstration of the specific mechanisms by which XOS transport and utilization occurs in bifidobacteria has not yet been established, two models have been proposed. In one model, extracellular xylolytic enzymes degrade XOS, and then xylose monomers are transported into the cell. Alternatively, XOS are transported via an ABC transport system, and intracellular XOS is hydrolyzed. The resulting xylose monomers are phosphorylated to form xylulose-5-P which then enters the *Bifidobacterium* shunt. Gene clusters encoding for putative glycosyl hydrolases have been identified, including GH8, GH43 and GH120. These clusters include genes encoding for non-reducing end β-xylosidase, reducing-end xylose-releasing exo-oligoxylanase and endo-1,4-β-xylanase, each having a preferred oligomer length. Based on the current genome annotations, the presence of GH43 and GH120 clusters and genes encoding for ABC-type permeases in *B. longum* subsp. *longum* CR15 suggest that the strain was capable of intracellular degradation of XOS.

Like other in vitro models, limitations exist with the IVE method. However, despite these limitations, the IVE model serves as a useful tool to identify potential synergistic pairs and then for testing those pairings across multiple samples. Such in vitro methodologies can accelerate the process of strain discovery and synbiotic pairing prior to in vivo trials to validate these formulations. Finally, more sophisticated and controlled in vitro models would provide a basis for greater throughput and increase the library of strains that can be collected in a short amount of time.

Other attempts to identify synbiotic combinations have generally relied on pairing previously isolated probiotic strains with one or more prebiotics. Indeed, these and many of the other synbiotic combinations described in the literature would be considered as complementary. While these approaches have the advantage of having characterized strains as the probiotic component, there is no a priori reason why the prebiotic would necessarily support growth of the probiotic in vivo. Accordingly, the enrichment method described in this study provides a basis for identifying putative probiotic strains that would be predicted to out-compete other resident microbes for the prebiotic. Provided these probiotic-prebiotic combinations result in a health benefit to the host, they would satisfy the definition of a synergistic synbiotic.

SEQUENCE LISTING (99 sequences)

SEQ ID NO: 1 - DNA, 20 bp, Artificial Sequence
  16S primer 8F
agagtttgatcctggctcag

SEQ ID NO: 2 - DNA, 17 bp, Artificial Sequence
  16S primer 1391R
gacgggcggtgtgtrca

SEQ ID NO: 3 - DNA, 21 bp, Artificial Sequence
  forward primer
ccgcatcacaactgctattgg

SEQ ID NO: 4 - DNA, 21 bp, Artificial Sequence
  reverse primer
cgaaagccccaatttgttcgt

SEQ ID NO: 5 - DNA, 2403135 bp, Bifidobacterium longum
aacccggaacgttaagccgggaaaccacatgggacacggccagccaccaagaccccgaaccgttccccggcttaacaacaaacccggcttaatcggagttaaaccgatgtcggtttaattccgaccgtggatgccactaccggtgggacgaatggatccgcatctacggggagcacaggctgacgcggtcgatgagcgcgaagggctgcagtccggacaacgcggccgccgaggggttcttcggcaggctcaagcaggagttcttccacaagcgaagcttccaaggtgtctcgatcgacgagttcatcacgttgttggacgagtacatggtctggtacagggacaagcgcatcaaactcgaatacgggatgagcatcatggacaaacgcatccagctcgggctcgtcgcctgaacgtgcgcgctatcgttgcgaacgaccattcagacaacgaagtccaacaaaacgtcaccgcccccgtctttattaaaagcttccataaagcctgacttggtgtctcattgggaacgtatcggtggacgacactgagaaactcagagggaataagactttcagtagaaaaaaagagggtaagcctatgtctttgtcaattctgtagaaggttgtcgtattggggtctcggtgaccgtcgtgggtgtgcttcgtcttgctggctgatccgatgcttttgtctgccgcttgagtttcatgcggcgaggacacggtctgcggacgtccccgctcctcccatatccggacaagcattacattctgttctccaaggaaggattcaccgacaacatgaaacgtctggccgaagaggacggtgccgtccgactcgtctcgttcgatgagatggcctgaagcctatgttcggtttaccgtaacccgaggagggtgttttccgcggggtgcccccctccttgtaggatatgggggtatggctgatgaagttttctctccgaagaacgttattgtgaccggtggctgtggttttatcggttcgaatttcgtgcattacgtgtatgaccatcatcctgatgtgcatgtgacggtcctggatgcgttgacgtatgcgggcaacctggagaacatcaggggcattcttggcgaccgcgtggagttcgtgcacggcaacatctgcgacgccgagctgctcgacaaaatcgtgccgggccatgacgcgatcgtgcactacgcggcggaatcccacaacgacaactcgatcgcgaatccggagccgtttttgaagacgaacgtggagggcacgttccgcttgttggaggcggcccgcaagtacgatgtgcgctaccatcacgtgagcactgacgaggtgtacggcgatctcgccctggacgatccggcgaagttcacggagcagaccccgtaccatccgtcgagcccgtacagttcgacgaaggcgagttcggacctgctggtgcgcgcctggcaccgtacgttcggggtgcgcgcgacgatctcgaactgctcgaacaactacggcccgtaccagcatgtggagaagttcatcccgcgtcagatcacgaacatcctggacggcatgcgtccgaagctgtacggcgatgggttgaacgtgcgtgactggattcatacggacgaccattcgacgggcgtgtgggcgatcctgacgaagggtcgtatcggcgagacgtatctgatcggcgcggacggcgagcggaacaacctgacggtgctgcgcgacatcctgaccgtgatgggcaagagcccggacgacttcgactgggtcaaggaccgtcccggccacgaccgccgttacgcgatcgactcgaccaggctgcgcaccgagctcggctggaagccggtgcacacggacttccagaagggcctggagcagaccatcaagtggtacacggacaaccgcgcctggtgggagcccgccaaggccgccaccgaagccaaatacaagcagcagggccagtgagcggaatatgaaaatggccacacctcgaaggtgtggcccctatagcactaagaaagatacacatatgaatttgaaaaagcaagcggacaatgccgtgatggcgagtcgttttcttgctgacgcgcggttccaagtgtatctcgattatgcaagacggcatgtggatacagtcgatcgggaacggctggtcgatctggcggtgaggctgtaccgctggaacgtggaggcatccgccatcacaatcggttatatcggctatatcgagatattcgtcagaaacgcaatcgatcaccggctttgcgaatgggtgtccgggcagcagataacgggcatcccggactggcttgaagccggcaaaagcgatccgatcgggaggatacgggctttgatcaacagccccgagcgcgactatatcgcggaggcccggaacacggcattgcgcaagcagcggcattggcgttccgaccagacgcatccaaggcacggggatgcgatcacccgcgacgacgtgttctcccaattgacattgggcacgtgggatggcatgttgtcccgttccggcaaggaccctgaactcgcccatgtcctcatgggcgcgttccccaacatcgcggatgcatgggcgtcggaactgcgtcgtatgccgaagggaaggcttcccggcaacgacggcgacccgtttgaggacaggctgcgcaaggaactggtggaccgcctcaaatcggttcgtaccatccgcaaccgtatcggtcatgatgagaaccttctgcgggtcgagttcgcgaaactgagatacgacatgttcttcatcctcgatgccttgggccccgaatgcccgaattgggctttccccgataaaggggaggccttgaaaacgcttaatcctgcacgctgcatagcaacgtggcaaaacgattctgaagatagaaagtagggaacgtatgtcgttcgaattcgagaaggacttgaaggtcgaggagacgaacatcccgggcctgttggtgttcgacctgccggtacatggtgacaatcgtggctggttcaaggagaactggcagcgtgcgaagatgaccgcgttgggcctgccggatttcggtccggtgcagaacaacatcagcttcaacgcgacgaagggcgtgacgcgcggcatccacgcggagccatgggacaagtacatcagcatcgcggccggtgagatcttcggcgcgtgggtggacctgcggccgggggagagcttcggccaggtgtacacgacccgcctggacccgtctcgcgcgatctatgtgccgcgtggcgtgggcaacagcttccaggcattggccgatggcaccgtgtacacgtatctggtgaacgcgcactggagtctggaacagaagaagacgtacacgttcgtcaacctcgccgacccggaactcgacatccactggcccatcccgctggaggaaagcgaacgctccgaggcggacctgcatcatccgatgctcaaggacgccaagccgatggagccgaagcgcacgctggtgacgggctgcaacggccagttgggccatgcgatccgcgcctacgcggaggcccatggccttgagggcttcgagtacacggacatcgacgagttcgacttctccgacccggccgcgtacgacaggtacgattggagcctgtacgggacgatcatcaacgcgggcgcctatacggccgtggataaggcggagaccgcggagggccgtccggtggcgtggaaggcgaacgcgcagggtccggccctgctcgcgagggtcgcgaaggaccatcacatcacgctggtgcatgtgagttccgactacgtgttcgacggcaccgcggacctgcattcggaggatgaggcgttcgcgccgttgggcgtgtacgggcagacgaaggcagcgggcgatatcgcggtggcgaacgccccggagcactacatcctgcgttccagctgggtgatcggtgagggccgcaacttcgtgaagacgatgatgatgctgtcggaccgtgtcgcgaacccggacgaccagctggagcaggtgacggtggtggacgaccagtacgggcgcctcacgttcacgaaggacatggccgaggcgatctttcacctgctggacagccatgccccgtacgggacctataacctgaccgggtccggtgcggtcaagtcgtgggcggagatcgcccgtgaggtgttcgatttgacgaacggtaacggcgacaaggtcaagcccatctcgacgtccgagtatttcgctaacgcgaccagcccggtcagcccgcgccccgtgcacagcgcgctcgacctggcgaagatcgaggcggccggatacacgcctgccgactgggaggaaaccctcaaagaatacgtcacccgcgaactcaacaagcggtgaaacaggaagtgaaggaaaacaccatgaagggcattatcttggctggtggttccggtacgcgtctgtatccgttgaccaccgtcacgtcgaagcagttgctgccggtgtatgacaagccgatgatctactatccgctcagcgtgctcatgcttgcgggcatccgtgacatcctgatcatctccacgccgaaggacctgccgaacttcgaaaagctcctcggcgacggttcgcattacggcgtgcatttttcctataaggtgcagcccagcccggatggtttggcgcaggcattcctcttgggagaggagttcatcgacggcgagccgtgcgcgctcgtgctgggcgacaacatcttctacggtaacggtctgggcgccacattgcgcaaggccgtcgctaaggccgaaggcggcgagggcgcaagtgtgttcggctactatgtcgacgatccggaacgctatggtgtggtcgagttcgacgagcataaaaaggccgtctccatcgaggagaagccgaaggagccgaagtcgcattacgcggtgacgggtctgtacttctatgacgagcgtgtggtcgagttcgccaagcgggtcaggccgtcggctcgtggcgaactggagatcacggacctgaacaagatgtatttggaggacggctccctgaacgtgcgaacgctgggtcgtggttacgcatggctggatacgggtaccatggattccctgtacgaggcgggcgagttcgtgcgcaccgtgcagcgcgcccagggcctgcccatcgccatcgtggaggaaatcgcctacgaaaatgggtggatttccaaggaggagctcctcgaatcggccgaacgttacggcaagagcccctacggcaagcatctcaaggatgtggccgaaggcaaagtcgtgattgttcctaacgactgatcgactcggacgaatgcggaaacgccatagtattttgagattaatgctgagtgcgatagcagattacgcatttgccgatgtatatgacaacattgttcatcaatagtaaaagggggctgctgcattgcagtatgcagcagcccattaccatgtttggtaggccccgaccatcgaggcctaccaaacatggtaatgggcggacggaaagttggacgttttggcgtccggattggagtccgcatgttttcgatggaggatcggcgcagggccgttgacctgtatttcacggagggcatgaccatcaggaaggtcgtcgccaagctcggctacccgtccgagggcgcgctggcgaaatgggttcgcgaggacccgcgctgcacggttcctttggccttccataagttctaggtaaaaatatacacttatatacacatatatacatgaatatgtgagttcaagcgaactgatgctacgccggttcgtccccgtccccatcaaacttgtgctcatcctcgtaggcaacgatgtccatatcgcctcgatggagtttcttgagtgtttcagccactcgcgcctgctcatcatcaacaacagggcgctcgccggctaggcatgtgagaccatcggacactgcggaaaacactgccgaacccgcccaacaaacattgaagcaatacattttttatttgcttcgttactgcgtattctgtacttcacatgtgcgaaacgttggaattccgccaaaattttatttgcctggtatttgcttgggtgggtcgcaaagcgcggttgcggcacgattcttagtggtggtgccttatggcgtcgggctttccttgcaaatcgaggtaaggaaactggcccttaacccggaatttgaaaaagtaaaaggtccctggctgttcaccagccagagacctttttggtaacaactgaggttgaggaaacctcggcagttgggtccaacggggcgaaagtctgtggcgccgccgagaagattgccccgaagctagcgcgacctttctgctacaacacagcataccagcatccatcgaaccttccccgtacactggacagaccaaaccaaggaactactagcgtggcaccttggcacggtgtcattgtgccagcaggcatagtgactggttacaactaaagaggaggttctcatggaaggcaacgaccatgacaaccgtccgagatctgaccgacaataccgggaaggcctgatgacgggcctgttgatcgctctggccaaccaagttggacagggatggtcgacggctatcatcatcgccacactggtactgcttggattaagtctcagacgaggccgctgacttgtcagcggaacagccggaatcttttacgggttccggcccctcgtcttcaatcagggcaccatttcaaggcagaagaatcaggcggcctttttgcggccgcggcgcttcatggtgccagcggtggcgttggccacgtcgaagatcacggtcttgctttcggggtaggcggtaccgttgacggactggtaggcgatttcgccttccggagcctcaggcagagtgaagtatgccttcactgcttcaatgagcgtggcttccttgacgcttaccgaagcagcctgcttgccttcgggcttgctgaacttaatggcgttgtcggccttggcggtggtcggggttacggcgatctgcttggtcttgtcgttaatcagcaccttgacgtacgccgggaatccgagcacttcagcggtggctttgttgaaacgaatggcggaatcggtgacggtcagaacggtcttgcccaccggcttgaccagctgaacctcttcgaatccctgaagcaatgaagccataattgctctccttattgcattggtcacgtgttttttatttacgtcactaattgtaaccagctaatttcgcattatacaaatcatatgcatgcatgattgcataattgaagaacatttgacctacgtattgcgctcctcgaatagcactgatttaaccaataccaagaaaagcggaaacaagaacccgcaatatcagccgtattgaatatagcaatatgcaatttcaacatcgcaataactgacggcctttttgcttgctctattcgccgatatcgcattcaggccacagcgccgagcataatatcgacgccgtgcttgatttccgcatacacgcgttcaaacacctcgcgtgattgacgatgagggtcttcggtttcgagtgccgtaggcaaaaacggccgcagcataggtacgcaatccatgatttcgatgagcctgtctgcggcggtatcgccggcaatcggaccctcggcatgcatatgtttgcaagcgttcacgaagtcattgaacagaaatactttgcgaatagccagtggattctgttcaagcaaatcggaaatttgctcacgctcaaaacacagaatcaggtcggcttgccggctgatatcggtggtgagaggggtggaagaatgggaattcgcgtcaatgccgtcgttcttcagcaaatcgataaccatcggatcagcgggatgcgggggatagtgcagagtacccgcgctgcgcacggtgatattgccgctctgcaagccaattcctcggtcggcaagcttggctcgggtgtagtattcggccatcacggaacggcattgattgccggtgcatacatacatgatttgcataacaacgtcccttctcaagtgttgtgagcattccctcatatattccagtgagcattcctcgcgaatatgcgtgcgttatgtaccgtagcaataacatgaaaaaaccgggaatcatcgactcccggttcagtggtattcgcgaactatgcttcagcgtctactgtttattatgtcagtcacgtcagcgacgagtggtgttcttgcggacggcgaacagggcgatgcccgcggcggcaagcagcacaacggccacaccgtacggtgcgatggccgcaccggtgttggcggtggtagcagtcgtggtaccggactggtcaccggttccggttgccggaacctgaatggtggcggtcttggtaccggatacagcgccaacagccttgaccgcgatggtcttgccagcctggctggccttgaacgtgtacagcaaagtcaaggaaccatctgccttggcagtgaacgtcttggatacttcagcgatctgctggacgtcggcgacgatggcatcatcgtagtacacggtgacggattcgttcggctggaatgtgcctgcagggaacgtcacggtagcggtggtgccgctgtaagtaaccgttgcaccgtaatcatcagccatagcggtattcgttgcaaaaccaaagcccagaactgcggcgataacggccagcacggccataatcttcttcttcataacttcgaacctccacaatagaaccggttactatcaatagaaaatcggtcttttttcaattacaccccccaaccatacacccccttttgtcggtatataaggggtaattatgttaacgggtaagggggtgtgacaacgtggtcacaccatgtgacaacgttcgaacatactgtcgccgcattaccgttgcagcggggtctcctgacattctgaaaacgttgctattccaacgattttgctgactggcgatacgtgcatggcaaacaacagggaaattttttctgcgacacgccgacgggctactcggattctgatttgtactcgtcgtcaaaactgaacaggtcctctacggtggtgccgaacacccgcgccaaatccatggccagacgcaatgatggacagtattgcccctgttccagccttcctatggtctcacgtcgcacgttgaccagatcggcgaggtcggattgcttcataccgcgttggagtcggtgaagtttcaggctagtcttcatcgtcgccctcggtgccggcatcgtgttccagccatagatatcgaatatcggaaatggccagggcgcacatggccaatgcgggcaacagcattggcggaataatgtgaactatcgagcggtcaatcagattcagtgtggtgtagatgaaaccgacaattaccagaatgcccaccaaactgaccagcgcgaattgcatggccgcgctttgatgcatatcggaaagctcgtcgcgtcgcgggttctgccgtcggaatacagtcatgccccatacttcgccgccgatccacaacagcgccgcgatcgctgccacgattactccgagcaggttattgccaataagaaccatcagcatgcaggcaatggcacctatggattcaaggatggcacgaaagcaaatataccgattaaaggtcatggccgtctccgtgaattatgcgagcgatattgaattgcatacgcaattataaagttaggggggtaaccccttgtgtggtggttaggccaaccggcggaggctctttgcgtagaccgagaataatcgcaatcagtaattgttatgggcgatccagtagttgtacgctgcgacgatgccgccgtagcgctgctcgcagtagctgatgaaccacttgaactgggtcttgtagttggtctgccagtccgcgccgaaggaagccatcttgctaccggggtaggcctgacccaagccataagcaccagacgtggggttggtggcggtggggctccaaccggactcgtggttgatgatgtagttcgcagcggtgaagtccgcttcgctatacccgttgtccaacagatactgatgcgcccaggactgaacttctccagccggaacagtggtgccgagatcggccgacgatgatgacgacgtcgacggcgactcggtggaaccagtgcccaccaggatcaccttatccaccggggccttcttgacccatgaggcgaatacgttagaagagacgaccttgtcgccggctcgcttgaccagcgaggtggtctccataatgcccttttggccctcggtctcgaccttttcctgacccctgggcaggctgctggtctccttgcgcacttcattgaaggcgatctcggtatcgttggtctccacatcggcatccgcgcgattaatggtgaccacggtggcctcggtgaccttggatttcagcgagggagatacggcatcatccgggtcaagcgtgatatcacccgtctccagcacgtccttgacggtggtcatgttggctttttcgccaagtactacgcgcgaatcgccattaatcttcaccgtaacgaacgtggtgttcttgtcggcgctgttgattgcgccacgagtggcagaacgggatgcggccgaatcggtggcggagaacgaagtgatggtggaaatcggcttcacatcatcagcatggtagaaactgcgcgacaccaatcccgccgtgccgagcagacctgccgcggccaccacagccgcgatcttcatccactggcgcttgttcaacggtctgagcatacgggtcggcttggcatgtctcgtcattgcgctccttgatcggatttcacactgaccaccatgataggcggcgcagtggatgaaggaaaatcaggcttaggcctgctggtcggcaccggactgggcggccttggcggcggcgaggtcgagtgccttggtctgggcgatcagatcgtcgagatcggcggcctgcagcgcgccggcctgctggaagatgacctcgccctgcttggcgatcatcagcgtgggcaccgcctggatgccggcggcctgggccagatcctggttggcgtcgatatcaaccttgacgaatgcgatgttcgcgttctccggctcgttggaggccgcctcgaaaatcgggccgaacgcgcggcacgggccgcaccaggtggcccagaagtcaacgaacacgatttcgttgtcggtgatggtcttctcgaaatcggcggaggtgatggcggtggttgccatgatgttcccttcttctgtgttttccctggcatcgccgtacggccctcgtgcgtggccgccgggcgattgccttattcatgcaatacgtcttggcgcttggggccgtgcggttcgtggccgtcggctccctgctggctaccagcttcccagcaccacccaacatttgtgttgtattttccgccgccggccaaacgtttcccaagatttcgccgtaaggtgacgcgtggcgtgattttgcgcgcaataatgggatgcatgccagtcatgaatgatgaagtgcccgacgagggcgattatgatgccggccgtggccgcggcgaattcgacaacatcacgcccgaggacttcatccacggaggcggttccggtcacggcaacccgccgggctggctggggccgtccgacatcaaccgggcgcgccatcagatgcccatcgcgtatgtggagatcgtgcctgtgcgcaccgatgagatgggccgcatctcccaagtgggctcgctgctgcgcgtatccgaagacgggtcgatcgagcgtacgctgattaccggccgtgtgctgtaccacgagacgttgcgcgaggccatcgcccgcaatgtggccaaggacctgggcgatatcgccttgccgctgctgccgatcgggctccagccgttcaccgtggccgaattcttccccacgccgggactaagcgaatactacgatccgcgccagcacgccatcgcactgtgctacgtggtgcctatcgccggcgactgcaagccgcaggatgagacgctggatgtggaatgggtggatcccaagagcgacgtaatggacacgttcgtggcgcagatggtcaacggccatgggcgcatcgtgcgacaggcgttggcctgggccggaatctgacagttgttttgccttccgttggaggggatggcgcgtagcgacggagggcggtccgcgttgagaccgctcccagccgactgtgccgacagctccgccagtggggcgcgaatgtgaaggagtaattcatggcaatcgaattggccaatcatatctaccgcgacggcgaaggcgtgccggtggtgctgatgaacgcctacccggtggaccaccgcatgtgggacgtgtgcgcgaaggcgctcgccgacttcgccgacctgaacgacgtgccggacttcccgatctgggctccggacatggccggctccggcgcatccccggtgccgagcgacgccgattcgggcccccgcatggcgaacggcgcgtacagcgaggcgttggatcgcctggccggagcctacgtggacctgatcaaggccgccggctatgagcaggcgatttgggtcgggctgtcgatgggcggctacgtggcgatggacatccagcgcctgtaccccgaaacggtggccggactggccttgtgcgacacgatggccgcgtccgacggcgtgggcggagagaaccgactgaagatggcggacgccgccgaacagacgaactcggtcgaaccggtgatgcacttcgcgcagccggccgatggcgattccaccgtcaagaagactcctgaattcatcgcgaccatgaccggctggatcaacgaacagaacccggctggtctggcctggcgtcagcgcatgacctacggacgtcctgaactgggggcggtgccggaaacgatcagcgcaccgagcctggtggtatccggcgaactggacccctccagcaatccgagtgtgatgcggccgctcgccgaacgaatcaccggcgctgaattcatcgatattccggactgcggccatttcagtgccgtcgaacatccggataccgtggcgcgagcactgctctcgctcgtcaagcgcgtgcagagcgcgcagaagaacgcataggagacctcgatgaccgctgacattcatttctcgcctctggcactgacccatgcgctgccgttcctgccgctcgcacaaggcgacatcgactatcaggtggaccggcgaagcgaacccggcctgatcgacgagctgctggccgagccgaccaccaaagtcgtgcttacgcgcggcggacttgtcgccgtaccgcgcggccaaggcgagcttgtggactatgagaacgtgaaaatgcggctcgccacgttgccgggcgcctatgtgtccgccgaactggcacgctaccccgaagcggtcgccatgttccttggctcctatgtcggggcgcgcggcgaatccgtggtcgccgtggatatcacgcgcgtgccggaagccggcgttcccggtgttggcgggattgccggtgttggcggtgccgtcggcggcgtgctcggcacccaggattccggcactgtggacggcgcgctgggcaagaacggcatcagcggaggtgctgccgccggaatacggcagccgggaaacgccaagggtaatggcggcgtagccgcagccaaaatcgccgggccgctcggtgtaccggattcggccgggcaaggtgcggacgatgccttcgatgattcggtcggcgcgcccgtacagcccttggccccgaagcccacgctgctgcaacaggccgtgacccggttcgactgggtggacctgcgcggatttgcccctcactccaacgcgcgcgaggccgggcaagccaccagtgccatcaccttaagcatctggcacagccgccagcggttctgtcccacctgtggcgcggcggtccggccggcgctcgccggatgggcgcagcgatgcaccaacgaggcggacggcaaccgtgtgctgttcccacgcgtggagccggcggtcattaccgccatcgtggacgggcacgaccgtctgctgctgcaacacaacgcggcatggaaggattcgaggctgtattcggtgtccgccggatttgtggaggcgggggagaaccttgaacacgcctgccgccgcgaggccatggaagagaccggcatcaagcttggcgaggtgcggtacctgggttcgcagccgtggccgttcccggcttcgctgatgatggcgttcaaggcacatgcgatcaccaccgacgtgcgtgtggacggcgaggagaccatgaccgcgcgatgggtcacacgcgacgaatacacggccgagctcatcgccggccgtatggcggcgccgggccgcgccaccatcgcccgctacatgattgaggaatggctcggtcgcgagctgtgacggaccgcgaagataggttaggcttatgactatgagtgatgacaacgaaaacgaacagccgctgaatctcgacattcccgaccacctcgaatactccgaggaacatgcatgggtggaccgttcggtcgaccccgcaatcatcggcattaccgaatacgccgccgaccagcttggcgaacttgtgtttgtggatctgcctgagcctggcgcccgtgtggaggccggcgacgagatcgtggagcttgaatcctccaaggccgtccagccgctgatcagccccgtggcgggtacggtcaagtatgtgaaccgtgacgtggcggacgacccgtccgtggtcaacggcgatccgtacggcgaaggctggctgctgaaggttgagcttgacgacgatgagccggagctgctgagcgccgacgaatacgcgaaggtcgtgcggtagttccttttgagctcccctctctgaggggagccaagaaaatgaggcgtatggcctatattggtgtctatgagaagcccacgcgaggattttgaggcggcaggcaagcgactgccttgggatgctgctgctcgcagtgcagcgctgtccgccaccgcgccagtctctgacgtcaaggcatccgccaatggtgccgacaatgccagcaacgctgaacattccgatgacatgcccaccgtgccgattcccgcacgcaaggctgccacgacgttcgacaccccctccaagcgtgagcgcatcgaagtcaagccgccgatcacccgattcatacgtcgtgccgtcacccgcgtgttcggcgtatggtcacgcatctccactcaggtggtgcgccaatgggactggtatccgcgagtggaaccctatgtgggttatggcaccggcgattactcgcgtctgatctgccgcacggtatacgcccccaggcacgcgcaatccggcgaactgatccgcggcatccgcggcatgcttgccatacccgcgccgcgcacccacgtgcaggccagcattgatgacatgccgctcaacaccgtgcagatcggcgtctccgaggtctatgacaaggtggaccgcacgcgcgatctcggcagcgaatacgccatctccgattccgccggatatctcgacctcgtggccgagcatcgtctggtgcccggcatccatcgcgtctcctacagcgtggccaaccgcaaacccgtgagcgccaacctgtacaccatccccgccagtgccaaagtcggcatcatctccgatgtggacgacaccatcatgatcacgcaggccccggtgccatggaaggccgcgtacaacctgctgttcctcgaccccaagaagaaagcctccgtgccgggcatgagcgtgctgttcacccgcatcgccgacctgttccccggcgcaccgttcttctatctttcgacatcgccctggaatgtggagagttcgattcgcaacttcatcactgaccatggttttcccgaaggcccgctgctgctgcgcgacctcgacccgaggcccaagaccttcgtacccaccggcccccagcacaaacttgagtttgccgaacaacttatggccgacttcccagacatgaagttcattctggtgggcgatgacgggcagaaagacccgaccacgtacgccaccatcgcccgcagatatcccggacgtgtactggcgatcgtcattcgtgagttgagcccgcgcgaatcaaccggattggcgtcggtgacggggctcacctcgacccagccgactccggtaaccgatgtgccagtattcaccggcaccacaggctcgaacattctgaagaccatgctgccgtatctgaagacggtgttgcgataggcgcggcgtgatgaacactgaatgcgtcccggtgcggtgcctcgcctataatcgcgtggtatgactgacgagagcacaaacgccgcggccgcgatgccgccttacgccaagcgcgagccgaagcgccgcgaattccacggtgacgttttcgaagacgattacgagtggatgcgagacaaagactccgatgatgtgcgcagctacgtagctgccgaaaaccagtactgcgagcgtcgcatggcgcatctggcggatttccggcatacgttgtttgaagagctgaaatcgcatgtggaagagactgatatgtcggttcccacgcgcgtcaatgattactggtacttcacccgcacgcagcagggcaaacagtatggcgtgcaatgccgcatccccgtgcgcgatgccgatgactgggacccgccggtcgtggatccgcaaggcgcgcccggctccatgcccggtgaacaggtcgtttttgatgcgaacaaggaatccgaggggcatgacttcttccggctcggcggcttggatctgagcaaggacggccgttggatgctgtacggcgtggatgttgcgggagacgagcgatatgatttccgcattcgcgaccttgccgggctggagaccggggagccggtcagcgaactgcccgaacagttcaccggcattggcagcgcatgcttcacgccggacggccaatgggtgttctgggtggaattggacgattcctggcggccgctcgctgtgtggcgtcatcgtgttggcacggcggtcgaatcggatgtgtgcgtgtaccgagaaaccgatgaacggttctgggtgggcgttggcatcagttttgatgagcgcaatatcgtgatcggcaccggttccaaaaccaccaccgaagtgctgatgctgccggtggccacgcctgaaggcgaattccaagctttcattccgcgtcagaacgatattgaatatgatgtgagctttgcctgttttgaaggcgcgggggagaacggtgcggatgtgccactcgccgtggtctatcacaacgctgccaatccgaatttcgaaatcgacgtcattgacatgcgtggccatgagccgccgtaccgactcggcgaaggcgtgtgcattgccgccgggtcgccgtacggctgtgaacatggtgagccggataagccgattaccgaggcatacttcaacgccgtcaatccggcgatattgcagggtgcccacggtctgggcatcgaaggcatcgcgttgcatcgcaactttgtgtccctgagctaccgtgccgacggccagccgcacgtggcatacatgaccaagagcgcggctgccgccgacttcctggccggacggccgtggcggtttacggaactgctgccgcctgccctggaggacgactgggacatggttgccgacgatcgcgaaaacttcaccggcgatcatggcgaaatcttgtggaccgaagatgaggcccccacggatcacacgtcatcttccgatggtgctagcgacgaccacctgcccggtgagacccggcgcttgtacaccatcggcgtcggcggcaacccctcgtatgaggcgccgcgcatgcgctactcgttcgccagctacacccgcccgggcgagttgcacgaaatcgatcccgccaccggtgaagatgcgctgctgaagcgagccaccgtgttgggcaacttcaatccacgcgattacatggaacgccgtgtgtggattaccgcgcgcgacggcgaacgcattcctgtttccctcgtctggcaccgcgattgcccggcgcaggattcgccgatgttcattaccggatatggtgcatacgagatttcctccgatccggggttctcggtctctcgtctgagcatgttggatcgcggtgtgctgtacgccgtgccgcatattcgtggcggcggcgaaatgggacgcgcctggtatgagcaggggcgcagactgaacaagaagcattcctttgaggacttcgtggacgccacacgcgcgctgcagaaggcgcatttggctgatgcttggcgcaccgtggccaacggcggatccgctggcggcctgctgatgggcgcgattgccaatatggcgcccgaatgctacgccggtgttgaggcggatgtgccgttcgtggacgcgttgacctccattcttgacccggacttgccgttgaccgtcaccgaatgggacgaatggggagacccgttgcatgaccctgaggtgtatcagtacatgaagtcgtacacgccatacgagaatgtgccggtcgccgtgctcgagggcggcaacgacgaggctgccggtgacggcagtgctgatggggctgccaccggcgcggtcgccgccgcgcaattcccgagaatcttcattaccacctcgatgaacgacacccgcgtgctgtacgtcgagccgctcaaatggctggcccgtttgcagtccgccggcgtggacgcggtggccaagattgaggtcgaggccggtcacggcggtctatccgggcgttacaagcaatgggaagaggtttcctatgagaacgcttggtgcatggatgtgatggggctcgctcattaggccatgtccactagctgagcgggttcgggccggcaggtgatagcgcgagtaggctccttgaactatggcaaagacatataaaatcgccgttattcccggcgacggtattggcaaggaagtcactccgtgggctcagaaggctttggaaaaggccgctgaaggcgtagctgacttcgagtacgagaacttcgacttgggtgccgagcgctatctgcgcgatggtgcgatcctgcccgaggacgaagaggagcgcatcaaggccaacgacgcgattctgctcggtgccgtgggcgatccgcgcatcaaggccggcattctggaacgcggcctgctgctcaagctccgcttcgacctcgaccagtacgtgaacctgcgcccctccaagctgtacaagggcgtcacctcgccgctcgccaaccccggcgacatcgacttcgtggtggtacgtgaaggcaccgaaggtctgtactgcggtgccggcggcgcggtgcgccgcaacaccccgcaggaggtggccaccgaggtgtccatcaacaccgcatacggtgtggagcgtgtggtgcgttacgccttcaagctcgctatgaagcgcaagaagcacgtcaccctggtgcacaagaagaacgtgctcgtcaacgccggtgatatgtggcagcgcatcgtcgacaaggtcggcgaggaataccctgaggtcacccacgactaccagcacatcgatgcggccaccatcttcctggtctccgacccgagccgtttcgatgtgattctcaccgacaacctctttggcgacattctgaccgatgaggccggctccgtggtgggcggcgtgggctactccgcctccggctgcatcaacgcctccgacgagttcccgtccatgttcgagccgattcacggttccgctccggacatcgccggtcagaacaaggccaacccgaccgccgccatcctctccgccgccatgctgctcgagcatctcggctttgatgatgcggccaagaagatccataccgccgtcgaagcggacatcgaggagctcggctccaccgtgcgctccaccgaccaagtcggcaaggacattctggcccgcatgtgacctcaaacctggctcccctcactgaggggagccagaaaactctctatactgagttgcatgcaaatgcgacatggggaatgcaaaaccgttggcagcaaactagtcgccgtgaccgtatccgtcgatgatgacggcaccgcacagtcatgccatatcagcggtgatttctttattgaatcagtttcggatgccgaatcccatgctttgttgcatgacctggaacgagctctaattagcgatgattcattgcggtccgtattggacgctcaccctagttgccaaattatcggcacagatgaaattgccatcaaaaccgcatacagccgagccgtaagcagcaacttgcccccgctggcgggggctccagcgcagcgggtgggggtgggcagccccgatgcgccgaacatcccagcatccatcaatgcacaaaccaagcagcccgacaaaagctctgaataccgggagcgctggaacgccctcaagcctcaactcaccgtgatccacgaccatccgcgtactccggacgagcaaatggccattgacgagacctgggcgcgtgaagtcgcagcaggaacacgacagccgaccatccgattatgggagtgggcgggcccggctgtggtcatcggccgtttccaatcggcccaggacgaggtgaatctggacattgccaagcagctcggcttcgacgtggtacgccgttgcacgggtggcggagcgatgtttatcgaacagggcaacaccattacctattctctgtatgcgccgctcgatttcgttcagggcgtaagcatcgaagaatcctaccggctctgtgactggtggctggtcgaagcgctgcgcgaacttggcttggatgtgcggttcgcgggcctcaatgatatcgcctcgcagtacggcaagatcgggggagcggcgcagcggcgcttccccgtaggctcaggcggcgcggtgctgcaccatgtgaccatggcgtatgacatcgatgcggccaagatgagccgtgtgctcaacaccagtcgcgagaagatgtcagacaaagcggtgaaatcagcggtcaaacgcgtggacccgatgaaaagccagacgggtctcagccgcgaacacatcgtcgagcaccttattgactggtttgcggcgtgatttcaccgatggccgtatacgattttgccggtggccgtgcgcggttttgtcatgggcgagcgcggtaaccgcgacagtgccgtttttcgcggtaacgcattcgtcagcatgtcgtacggctatcggatcgtgccacacatgaagtgacgaatgagggcatgctcctgacgaaacctgtgggacgcgttacaatatgacggatgggcgacgacggtcataggacaataaggatggtgcgatgagcttggaaacgccaaacgcttttgctgacgaggaaaacatcctgttgcatacggcattgttcaagcaggtatcgccagccgaagccgaggagctgttgccgcatttgaagcatgcgacgttcgataaaggcgactatatcttctccgaaggcgataccgatcagcgcatgtatttactggagcaggggcgcgtcaagctgattcgcacttcttccgatgaccgcgtgcagctgctgtccatccacgcgccgggcgaagtgcttggcgagattccggtattcgaccctcatggtggcccgcgcaccgcgtctgcggtgtccatgagccatggcacgcgcgtggtctggctggagcatgatgccctgttcgcatggcttgatgagcatccgcgtgtggccatcgacatgttgcaggtcatggccaaccgccagcgcggcaacaacgaacgcatctccgacttggtattcatggatgtgccggcgcgtctggccaagacattgctcaacttgggctcacgtttcggcgagccggtggaacagggcctcaaagtgccgcatgacctgactcaggaagagctggcccaactggtgggctccagtcgtgagaccgtgaacaaggcgttgatggacttttccaaccgcggatggatcgcacgtgacggccgatcgatcatcatcttccagcccggtatgctgattcgacgctcgcggcgctgaccgttcggctgacttccagccaatgttacgctagtgcgattcttgtgatgatatgttcacgggagctgaccgtaagcccggttggtagggcaccccatttagaatggggcccatgcccaaaaagaagtccctcactctccaacgtgtgcttgttctcctcttggcctatatcatgcttgccgtctgcggcggcgtggcggccagcgtgttgtttgtaccgggtgtggtcggtgccaataaggccgccaaagcggtgattccgtcgctcaaggtagaaaacgtggacttcgacgtgactagtctgccccagaagtcgacgatgtacgcgcgagacggttccaccgttatcgcgacgttctacaaccaaaaccgtatcgtcgtgccgctgaagaagatttccaaaaccatgcagcaggcagtggtggcgcgcgaagaccgtcgattctggactcacgccggcgtcgacgtgcaaggcgtgatgcgtgcgttcgtgcagacctacctcgtcaaaggctcccagcagggtggttcgtcgctgacccagcagtacgtcaagaacgtgctgctgatgcaggcgatcgaggatgacgattcgatcgcccagtaccatgccactgaagacaccatcgcccgtaagattcgcgagatgctgatttccgtgcagatggaaaagaagtattccaaggccgagattctgcagggctatttgaacatcgcccagttcggcaacaacctgtatggcgtggaaaccgcggcccagcgctacttcagcgtgtccgccgccgatttgaacgtggtgcagtccgccaccatcgcggctatcaccaagaacccaagcctgtacgatccgctggtcgaagagaaccagaaggaaagcgaaaaccaacgcaatatcgtgctcaagctgatgctgcaggaaggctacatcacccagaagcagtacaccgaagctgtgaacacgccgttgaaggacacgctgaaagcacaggacgtgaatgtcggctgtcaggacactggcgattacgcgtacttctgcgattttgtggtgcatcgcatccagaactccgaagaattcggcaagactcgtgccgagcgtaacaagctgctgcaggagggtggcctgaaaatcgtcaccacgctggatgtggaagcgaattccacgatgatggagaccgcgcgtaataccattccaccggacgatcccagcggcatggagatagccatggccgcagtcaaaccgggaaccggcgaagtgctgggcttcggtctgaatcgttactatgacgccactccggcagccgcgaacgatcccaccaagacgagccagaactatgccgtcgatttggcggatggcggtggttctggttggaccatcggttcgtcctggaagccgatcaacctgattgcgtggatggaagcgggccattccatcaacgacaacctccagacctcgacgtcataccccactacggacttcgcctgcagtaactattcgggcggtgccgattcgtggaacgtgtcgaacgccatgggcgcaggtacagtgaacccagaaagcccattcctcggtctggtccgttcgcataacactactcaggcttccatgggtgccatcctcaaactgtgcaaggtggcggacaccgcgactgaactgggataccatgacgccgccacgggtgagaccatcgacaaaacccaggtgtatacaccatccatgatgatcggctcggtgaatgtgtccccgctgaccatggcgagcatcttcgccgtatacgcctcgaatggtgtgcaatgcaacccgattgccatcagcaaggtgaccgataaggacggcaacgatctcaaggttccatccgcgaactgccatcaggcggtggataaggacatcatccaaacactcgcttataccctgaaccaaggtacggtgcggccggatggtgccggttggtcattcagattggctgacgggcgtaagtcgtttggtaagaccggtaccagtgaggatcttgcggtgtccggtggatcgttcattcctaatcagattgcggcgttcgctgtggtcggcgatgcacagaacccgtacaccaaccgtatttccaacattgccatcaacggccggtacaacagctattgggatggttcgacaatcgcggctccggccgttaccaacttcttcaatagctacatttccaagaagaaaataccgattgacaacgattacggccagcccgtctcgaagtacaccacgactggcaagtatctgggcattggcggacgaacgttcagcgtgccgcagaccactacgaatggcaacagccaatcgcagagcagcaacaatcagtctcagtcgcagaacactgggcaaaacaacacccaaacccagggcaccaattcagagcagtcgaatgatggccagtgattggtgattggcgtttgacatttggtgattgcatgccggctgagtctgcgtaacatggccgactgcgatacccaaattacgtagtttgcgggcgttacctgtttcaggtgacgcccgttttacaatacttaatgacaacgccatcgcgttcatcgaatatttgccatgaacgtgcatcggaaaggggaacgatgagcaacgacgatctgacgcatgagaattttgattttcgtggattcgacgtgccggatctcaaagcggtgacgctggcttcgtcttcggacggcgatcagtccaagcagccgaagaccaagcacgaggatgcatcgaagaaccgtaagcacggtaagaagaagtcaaaatccgatgcacggtccaagaagcgggccggcgcgggcaagacgagcgaatcgttcgatgattatgaggaaagggaagctgtgagcaaggcagataagaaagtcagcaaggaccgtccggggctgtttgcgccaatgacgctgcgcgaggtgaccgtgcgtaatcgtatttggttgccgccgatgtgcacgtattcgtcgttcgcccgcgatggtaggcccacgccgttccactaccagcattacgtgtctcgcgcgttcggcggattcggcatggtgattgtcgaatccaccgccgtggctcctgaggggcgtatcacgccgtgcgatctgggcctgtgggaagacgggcagattgatgcttggcgctggatcgtggacggtattcgcgaggcgggtgcggtgcctgccatccagctcaaccatgcggggcgtaaggcttcgactggttgctttgccgttggttacgacggtcagaacgtgccggaggaggcgggcggctggcctaccatggcaccgtctgaaatcgcgttcggtgggttgcgtacgccgcgcgcgctgtccgtggatgagattcatggtctggtcggcgcgttcgccgtggcggcgggccgtgcggtggccgccggcttccaggcgattcagattcatgccgcgcatggctatctgatttctcagttccttgacccgctgagcaatgagcgtgatgacgaatatggtggcgatttgaccggtcgctctcggttcctggtcgaggttgtggatgccgtgcgtggggccgcccctgagggcgtgccggttctggtgcgcatttcggccacggattgggccgccggcggttgggatttggaccagaccatcgcactatccaagatgctgaaggagcatggcgtcgatgtgatggacgtatccaccggcggcatcatgtcgggagtgtcgattccggtcaagccgaactatcaggtgccgttctccgagcaggtcaaggccaaggccgatattccggtgaccgcggtgggtcttatcaccaagccgaagcaggcggccaagattctggcccatggcgaagccgatgccgtggagattggccgcgccgcattgcgtgatccatactggccgttgcgtgcagccaacaagctgggcataccgtccaccgagatcccctacgccccgcaatacgtggccggtgcgtactaaatcctcatggggcggtaactttcccatggggcggtaaaaccctcatggggcggtaacccaaaacggcggtattctgcggaatgtgaaatttggctaaccgccccatggggcaatcaccgccccatgagggttttaccgccccatgggtaatagggcaatatgtgagttcactccacgtctacgccgacggcgtcggagacgtgctcgaatccgtcgcggcgcagcagctgggccagaccgcgcttcaacacggtaatctgctgcgggcctcggtacatcagcgaactgatgaacatgaccaagctggagccggaacgaatcttcgcataggcttgctcgggggtaaagacgccaccgatgccggcgatagcgaaccggtcgccatactctttatacaccttgcgaatcagctcggtgctggcgttggtgcacgggccgccggacaggccgccctcccaatcgcgcggaatctcgaggccggtgcggtccttctgcagattggcgatggacagcccctgcacattgtgctcggccagcacatcgagcagctccttgtactcgccccacggcttgttcaacggcatcttgaccagcgtgggctgcgggcggtcgatcttgtcgagcgccgtaaacagacggtcgagcgcttccggagtcgcggtgaacggttcgccgacgtgcgtgttcgggcaggagacgttgacctccaccatcgcggtgcggccggcggcgcggcgcatcgaaatgcagtaatcctcaatgccttcgtccaaatcgccgcactggtcgtcgttggtgcgggcgatcgacacagacagctgcatctggcgggcctgagtccaagccttctcggcgcgctcgatgaccttgtccgaaccgatgttggcgaggccgacgtgcaccatcatcgaatcgtattcaggcagacggtggaaccacggcttggcgttgcccgggcagggacgcgaggtggtggagcctacggtttcaaaaccgaagccggcatggtccagcaccacgggcatgtcgcagttcttgtcgaggccggcggacaggccgaacgggttggtgaaatcgacgcccatcacattcgtttccagaatggggtcggtgtagtcgagcatcagctgctcggcgagcagcagcggcgggacgttcttgacgacgtggcagaactcgatcatctgatcgtgtgcctcatcggggcggtggttgaacacgaagttcggtttgatgatgtgcttgtagccgaaggtgaacagatcggtggtggctttgttgacggcgtcgtgccagaagctttcagaaacgtaagtcataccgcctattgtctcacgcttgggctggtgcggctaggcgattcctgcctaggcgaattggggaaggggctaccgcgtgtcgaggcgcacgcaggcgtcggctcggcagaagatacatgaatcgggatgcaccaggtatcaggcgtgactcgccgctgagcaacgcgctcgggagagtcgtcggtcgtgagtcatcgcgctagtggtcgctgcgagaatatcggttcgcacaatgtgcgattttgcgcggttttgtggaaatgaacacctgaattgcccggaattttcgagagattgtccccaaaacgctcaagccggtttggtttgtgagcttttgtgtgcgataatgttcacatgatttcgtcacaacgtcagcacctcatcttgagcaggttgcgcacgcgcggggcagtgcgcattacggcgctatcgaaggaactgggtgtgtcagcgatgaccatccgccgcgatatcgccgaactcgccgacaagggactgctgaagcgcgtccatggcggcgcggtgactaccagtaccttgctcagcgaacccctgttctctgtcaagtcccagatggatatcggcctgaaggacgccatcgcccaggaagccatcaaatatgtggctcccggcgatgtgatcgccatcggcggcggcaccacggcctatgtcttcgcccagcatctgctcgaatcgcagcagtccagcggcatcaccatcctcaccaattcgattcccgtggccgaactggtccaggccctcgaatccaaggacgtggaggtgatcgtcaccggcggagtgatcacccgatcgaactcgcttgtcggtccgatcgcggacaaggtcgtcgcctcgctgcgtgtcaacaccgtattcctcggcacccactcggtgtcgattccccgtggcttcctgatgccgaattcgctggaagccgcaaccgatatggcgatgatggacatcgccgatcgcaccatagttttgaccgatcacaccaagtggagctgcacatcgctgtcgctgtttgcgcgcttcgaccaagtggacacggtcattactgacgacgggctcgaccccgactccgccgccaaaaccaaggatttggtaaaggaactcgtgctggcccaccagagcgagatcattgaggaaagtgagtaaacccatggctgatttcgccaactacacccccggggagtatgcgaaggagcacatccgcatcacgccgacgacgcttgccgacggtcgtgacttcttctacctggacgacgaccccgagttcgtctccggtgccaagtcccgcgagctcaaggacccgcgcccgctggactaccgtttcgccccgcacctggacgccgacggcaacgaagtgccgtacgccgccccgcagatgcgccgcgacccgctgaccggcgactggatcccgatggccaccgcccgtatgaaccgcccgatcaccgccggccccggcgctaccgccaagggcaacccgctggccgcccgcaagcccggtgacccgtaccaggacggcgaagtgccggacaccgactacaacgtcgtcgtgttcgagaaccgcttcccctccatggtgcgcgtgcccggcgtctccgaggacgtgacctacgttgacggcaacccgctgtgggagaagaagctcgccgccggccgctgcgaggtcatctgcttcgacccgaacgaggacggcctgccggccgatctgccggtctcccgcctgcgcaccgtggttgaggcttgggccttccgtaccgccgaaatctccaagatggaaggcatcgagcagatcttcccgttcgagaaccacggccaggaaatcggcgtctccctcgctcacccgcacggccaggtctactgctacccgttcatcgccccgaagatggagaaggaactccagcacaccgaggcctaccacgagaagaccggcggcaacctgcttaaggacatcatgaacgccgagctcgaagccggcgaacgcatcgtgatgcgcaaccacagctgggtcgcctacgtgccggccgccgcccgttggcccctcgaggttcacgtggctccggtgcgcgacgtgctcaccctcgaccagctcaacgacgaagagcgttgggaccttgcctccatgtactcgcacctcctgaagcgcggcaacgccttcttcgacaagggcgacggcaagggcatggacctgccatacatcgccgcctggcaccaggccccggtgcacgacaagcgccgtgagaactaccgcctgaacctgcagttcttctccttccgccgcgccgccaacaagatcaagtacctcgccggctccgaatccggcatggccgcctggatctccgacaccacgccggaactcatcgccaagcgcttccacgagctcggctccatcgacatcgccgactgatagaaagaaaacatcaatgactgctgttgaattcattgagccgctgacccatgaggaaggcgtctcgcaagctaccaagctgttcgtcgacacctacggcgctgcgcccgagggcgtgtgggctgctccgggccgtgtgaacctgatcggtgagcacaccgattacaacgccggcctgtgcctgccgatcgctctgccgcaccgcaccttcatcgccctgaagccgcgcgaagacaccaaggttcgcgtcgtctccggcgtggctcccgacaaggtcgccgaagctgatctcgatggcctcaaggcccgtggcgtggacggctggtccgcctacccgaccggtgtggcctgggcgctgcgtgaagccggcttcgacaaggtcaagggctttgatgccgccttcgtctcctgcgtgccgctgggctccggcctgagctcctccgccgccatgacctgctccaccgctctggctctggacgacgtgtacggcctcggctacggcgattccgacgccggccgtgtgaccctcatcaacgccgccatcaagtccgagaacgagatggccggtgcctccaccggcggtcttgaccagaacgcttccatgcgttgcaccgccggccatgcgctgctgcttgactgccgcccggagttgaccccgctggagaacgtctcccagcaggagttcgacctcgacaagtacaacctcgagctgcttgtggtcgatacccaggctccgcaccagctcaacgatggccagtacgctcagcgtcgcgccacctgcgaggaagccgccaagattctcggtgtggccaacctgcgcgttaccgccgacggcatctccaaggccgatgaccagttccaggccctcaaggaaacgcttgacgccctgcctgacgagaccatgaagaagcgcgtgcgccacgtcgtcaccgaaatcgagcgcgtgcgttccttcgtgcgtgccttcgctcagggcgacatcaaggctgcgggccgtctgttcaacgcttcccacgattcgctggccgccgactacgaggtcaccgtccccgagctggacatcgccgtggacgtggcccgcaagaacggcgcctacggtgcgcgtatgaccggcggcggcttcggtggctccatcatcgcgttggtggacaagggtcgttctcaggaagtcgctcagaagatcgccgacgaattcgaaaagcaaggcttccacgcaccgcgcgcgcttgccgcgtacgcggcgaaatccgcttcacgcgaggcatgataataaatcacaatgctaaatggcgggtgtcttccctatacttgggtagtcacccgctttttgtatacgaccagggagagccatgaacaaggcaatcatcaccgtcgtcggtcaggacaccgtcggcatcatcgcgcgagtctgcacctacctgtcccagcacaacgtcaacgtgctcgacatctcgcagaccatcatcgacggttacttcaacatgatgatgattgtcgactacgccaacgcggacaaggacttcggcgcgatggtcggcaaccttgaggacctcggcgacgacatcggcgtgcgcatccgctgccagcgtgaggaaatcttcaccaagatgcaccgtatttgaggcggcccgctcagcaggccgcctcacgcgaggaggtggaaagcccggtgggctttccactgacggagccatccttatccctctgatgagggtgaccgccaaactagtctttaaatatcctgtaaggaacaaaccatgctgaacatcatggaggtccacgagaccaatcagatgatcgagcaggagaagctcgacgtccgcaccatcaccatgggcatctcgttgctcgactgcgcctcggacgatgtcgacaagacctgcgacaacatctaccgcaagatcaccacctatgccaaggacctcgtttccaccggcagggccatcgaacgcgactacggcatcccgatcgtcaacaagcgcatcaccgtcaccccgatctcactggtcggtgccagctcctgcaagacgagcgaggatttcgtcaagatcgcccacgcgcttgacaaggcggccaaggaagtcggcgtcgacctgatcggcggctactccgcactcgtttccaagtccatgaccccggccgaggagctgctcatccgctccctgccgcaggctctctccgagaccgacatcgtctgctcgtccgtgaacgtcggctccaccaagaccggcatcgacatgaacgcggtcgaactgctcggccatatcatcaaggacgttgccgagcgtaccgccgacaacgactcctacggctgcgtcaagttcgtggccttctgcaacgtgcctgacgacaacccgtttatggccggaggcttccacggcgtcaccgagggcgacgcggtcatcaacgtcggtgtctccggccccggcgtggtctcccgcgcactcgatgcggccaagggcaaggacttcgagttcctgtgcgagaccatcaagcgcaccgcgttcaagatcacgcgcgtcggccagcttgtggcccaggaagcatcccgccgcctcggcattccgttcggcatcatcgacctgtcgctcgccccgaccccggccgtgggcgactccgtgggtgaagtgctggagaagatcggcctcgagcaggtcggcgctcccggcaccacagcggcgctcgccatgctcaacgaccaggtcaagaagggcggcatcatggcgtcctcctacgtgggcggcctgtccggcgcgttcatcccggtctccgaagacaagaacatgattgacgcggcttcttccggttgcctgaccatcgagaagctcgaagccatgacctgcgtatgctcggtgggcctcgacatgattgccattccgggagacaccaccgcagccaccatttccggcatcatcgccgacgaggccgccatcggcatggtcaaccagaagaccaccgccgtgcgcgtgattccggtggaaggcaaaggcgtaggggagatggccaacttcggcggcctgatgggctatgcgccgatcattccggtgaaccagaccagctgcgaggccttcgtgacccgtggcggccgaatccctgcgccgattcacagcttcaagaattgattcggtagggtatctgctttcagagaggtacatttggcccctcgcggagagctatctgctttcaaagaggtacctatatgcggaaaccccgggtatgagcgttggaatatcaacactcatacccggggtttctcgattgcggtacctctttgaaggcagatagcattctgcaaacgctcgaatgtacctctttgaagacagataccagctcgaattacctttctggaggtctattcccgtttcgaggggctgattccgacctttctggaggtctacttccgtttcgaggggctggtatatatgaagaccccgagtacaagcattgatatttcaacggccatactcggggtctcgtcctttgacagccccttgaagcggcagtagacctccggcggatgccaaatccgcccctcgaaacgcaggtagccttatattcagcgttcatcactgcgcgaagctcagtgtttccgctctcgcgcctgtcggcgttcgttcggcgtcgctactcgaaggcccaccgggccttctcctcacgctccgcccgcaaaattgagctggcgccaggcttcgtagatggcgatggatgcgcagttggtgaggttcagggaacgcagggacgggcgcatgggcagccgcacttgttcggccacatgagggccctccatgatgtccatcgggtcggggatgtcgccgggctcggggccgaacagcaggatgtcagtcggcttgtattccacctcggtgtagagcttggtggcgtgcgcggtgaacgcgatgatgcgcgaattgggcatcgactccaccagattgtcgaaattcgggtgcaacaccacgtgggccatgtcatggtagtcgaggcccgcacggcgcagcttggtgtcgcgcaggttgaagcccagcggctccaccagatgcagaatcgtgccggtcactgcgcacaggcggatggccgaaccggtgttgccgggaatacgcggcgagtaatagcacaggtgcggcgtcacggtttcggtggcggcggccttctcggcggaaagcatcgcgtccaccacggagatggggttgccgtgtgcgtcggtcaccagctcgtccggcccgtaattcgacttgcgatagccgtattcgaacattttctcgactttggtttcgggattggctggattcggtgtgctctgggggttgtgttttgcctcgttcgtcatagctgctaagaataagaacgatgaacgacacagcaatttctttgcgattgggagcatggtgggaggccaatgcgcgtgacttgccatggcgcttcggacgggccacgccgtggggcgtgctggtatccgaagtcatgagccagcagacgcagatgagccgtgtggtgccgtactggaccgactggatggaacgttggcccgacgcccgctcactcgccgaggcccccaagaccgaggtgatcaccgcatggggtcggctcggctatccacgccgtgcattgcgcttgcaggaatgtgcccgcgtggtggccgagcagtacgccgacaaactgccgcgtacgtatgacgaactcactgcattgcccggcatcggcgattacaccgcctccgcggtgctgagctttgcgttcggcgaacgaatcgccgtgatcgataccaacatccgccgcgtgctgagccgtgtgttccttggcgtcgaatcgcgcgggggagcggccagcccggccgaacgcgcgctggcgaaccgcatgctgcccaaagacgagattctcggacgcgatgctgacgtcgccgataatgccggtagcgccgaacatgccgtgaacagcactatccgtggcggcaaacgctcccgactgcatcgtggcgaacgcccatcggtcacatggaaccagtcggtaatggaactgggggcggtgatctgcacggccaaatcgccgttatgcgacacctgcccgattgccgacgattgcgcgttcctcaaggccggccgccccggactgggggagcgccgcacccgcccacgccaacgattccaaggcacggatcgacaggtgcgcggtctggtgctcgccgcgctgcgcgagcttcccgctggagccacgttgcccagggaagatgccgacaagctttggaaggaccagattcagcttgccgcctgcatcgccagccttgacgatgacggcctgatagagattctggacggcggcctgcgactacccagctgacattgtgaaaaatggtgggctccccaagcgtgtatgggcgtggtgaccgtagactggaagagttatggcagtgcagaggaacacatcaggcgcgagaacggcacgcggagccggcaccggggccaatgggccatccggcgggccctcccaaaacaaccgttccggcaagccgcgcaagcgcaggatcagcaaaaagcagcaggccatctatcgtcgtcggcgtatcgtggccggtacggtgctgctgctgataatcgcgctgattgtattctgcgtgtatagccttggccggggtatcggtgccgtgaactcgatgatccaccatgacgaggtgtatgcgatttcccgcgacgccacgccggcgccgaagaaagtcagcaacgtcaaggattgctcggccagtgatgtgacattgcagctttccgcggcctcccaatccgtgccggtaggaggatcgcttgatttcaccgcgaccatcgtgcacgaggggtcaggcaactgtttagtggacgggtccgattccggccgtgtgctcaccattacttccggtcaggaaacgatttacaagtccgatgtgtgcccggcggattcacgtctgctgctgatggctaagggcgataaggacgttcagaaggtcacgtggaataccaatgcgaacgccacgctcgccaaatgcacggatgagtcaggttgggccaaagtcaatgtgggaacgtacgtggcgcagctgagtttgaaggatcatccgaaggtgaagagcgatccggtgacgtttacggtgcagtaaaagtcttgccttagcgctattcttttgactttgcatgaggtgtgtcatattgcgggcatgccgtcgacaatgaagcgtccgcataggcatatggtggccatgccggcgctcccaggggaattaccacatattagcgagcgataaggaacgtccattggctactgagtctacgacgaacaccaccaccatcatcgcacgcgccgaccagcatgatattgacctgcacaaggcgtcggatcgcgtgaacttcggttccatcaaggaacccatcgatgtgccctacctgctgggcgtgcagaccgacagcttcgattggctgatcggcaacgaacgctggaaggcgcgcgtcgaggaggacgaaaagaacggcactaacaccgtggcccacacctccggcctcgatgaggtcttcaacgagatctctccgatcgagaacttcgctcagaccatgagcctgaccttctccgatccgtacttcgaagagccgcgtcacaccgtgcaggaatgcaaggagaaggattacacctactccgcaccgctgtacgtgaatgccgagttcgagaacggcgacaccggcgagatcaagtcccagaccgtgttcatgggcgatttcccgctgcagaccccgcacggtaccttcatcatcggcggcaccgagcgagtcatcgtctcccagctcgtgcgttccccgggcgtctacttcgaccgccagcaggatcgcacctccgataaggaagtcttcggcgcgaagatcatcccgagccgtggtgcatggctcgagttcgagatcgataagaaagaccagccgcaggtgcgcgtggaccgcaagcgtaagcagtccgccatcgtgttcctcatggccatcggcatgaccaagtccgagatcgcccaggcattcaaggactacccgctggtgctcgacgcactggagaaggaaaccctcgagacccaggacgaggccctcgttgacctctaccgcaagattcgtccggccgacaccccgacccccgaggccggcaagaatctgctggactccttctacttcaacaccaagcgctacgatctggcccgtgttggccgctacaagatcaaccgcaagctgggtgtcgaggccgatttcaacgatcgttccctccaccaggaagacatcatcgccacaatcaagtacctggtggccctgcacgacggtgcggcgaccttcccgggcaagcgcaacggcgaagacgttgacctgcgcgtggacgtcgacgatatcgatcacttcggcaaccgtcgtatccgccaggtcggcgagctgattcagaaccagctgcgtaccggtctgagccgtatggagcgcgtggtgcgcgagcgtatgaccactcaggacgccgaggccatcaccccgcagtccctgatcaacatccgtccggtgaacgccaccatcaaggagttcttcggcacttcccagctctcccagttcatggatcagaacaacccgctgtccggtgtgacgaacaagcgtcgtctttccgcactgggccccggcggtctgtcccgcgaccgcgcctccatggaggtgcgcgacgtgcacccgtcccacttcggccgtatgtgcccgatcgagtctcctgaaggcccgaacatcggtctgatcggctccctggcaaccttcggccgcgtcaacccgttcggcttcatcgagaccccgtaccgcaaggtcgtcaacggccacgtgaccgacgaggtcgagtacatgaccgctgaccgcgatcttgaccacgtcattgcccaggccaaccaggagctcgacgagaacggcaacttcgtgcagaagtccgcccttgcccgagtcggcgaagaagaggcggtcgatgtgccggtgagctccgtggactacatggacgtctccccgcgccagatggtctccctcggcgcctccctgattccgttcctggagcatgatgagggccaccgtgcactgatgggtaccaacatgcagcgtcaggccgtgccgctgatcgaatccgagcgcccgctggtgggcaccggctccgaatggcgcgccgccaacgactccggcgacgtcatcaagtccgagaaggacggtgtggttacctacgtgtccgccgacctgatccgcgtgatgaacgacgacggcaccaccagctcctacaagctggccaagttccagcgctccaaccagaccacctgctacaaccagcgcccgatcgtccacgacggcgagcgtgtggaagccggctcggttatggctgacggccccgccatccagaacggcgacctggccctgggcaagaacctgctcatcgccttcatgccgtggaacggctacaactacgaggatgctgtgatcatctcccagcgcctcgtgcaggacgacaccctctcctccatccacatcgaggagtacgagattgacgcccgcgaaaccaagctgggtgccgaagagatcacccgcgacctgccgaacgtcggcgaggacgccgtggccaacctcgacgagcgcggcatcatccgcatcggcgccgaggtcgaggccggcgacatcctggtcggtaaggtcaccccgaagggtgagaccgagctgaccccggaggagcgcctgctgcgcgccatcttcggcgagaagtcccgcgaggtgcgtgacacctccctgcgcgtgccccacggcgagaccggtaccgtcatcggcgtcaaggaaatcacccgtgaggatgccgaggaggacggcgacgagctgcccaacggcgtcaaccagatgatccgcgtctacatcgcccagcaccgcaagatcacggtgggcgacaagctctccggccgccacggcaacaagggctgcatctcccgcatcctgccggaagaggacatgccgttcctggctgacggtactccggtcgacatcatgctgaacccgctgggtgtgccttcccgaatgaaccttggccaggtgctcgaactgcaccttggctggattgctcactccggttgggacatctctttggatccgaatctggaagccgagtggaagaaactgattccgtccggtgccgagaaggccgagccgaacaccccggttgccaccccggtgttcgacggtgtcaagcctgaggtcctgaagggcctgctgtccaccacgctgccgaaccgcgacggcgaccgtctggtcggccccgacggcaaggccaccctgttcgatggccgtaccggtgaaccgtacaccaagccgatttccgttggctacatgtacatgctgaagctgcaccacctggtcgacgacaagattcacgctcgttccaccggcccgtactccatgatcacccagcagccgctcggtggtaaggcccagttcggtggccagcgcttcggcgagatggaggtgtgggcccttgaggcctacggcgccgcctacacgctgcacgagatgatgaccaccaagtccgatgacgtcgacggccgtgtgcgtgtctatggtgccatcgtcaagggcgataacctgccgccggcaggcatccccgagtcgttcaaggtgctcctgaaggaaatgcagtccctgtccctgaacgtcgaagtgctcaacgccgaaggcgtggccatcgacatgaaggatgaggatgacgatccggccagctccgctgacgacctcggcttcaacatcggcgcccgccccgacgcggccgccaaggaagaccagaaggccgaagagcccgaataccagtgatccctcgggctgcatgcggtcaatacgccgcgtgtagctccgccaacgtgaaataaataacgtacagagacctttccggtttgcactacccctcagtcagccttggctgacagctcccctgacaaggggagcttgggaaggtctcaagaacagaaacggattaacaagtgctggacgtcaacgcatttgacaagattcgcatcggccttgccaccgccgatgacatccgtggttggagccacggtgaggtcaagaagcctgaaaccatcaactaccgtacgctgaagcctgagaaggacggtctgttcggcgaacagatcttcggcccgacccgtgactgggagtgcgcctgcggcaagtacaagcgcgtgcgcttcaagggcatcgtctgcgagcgatgcggcgtcgaagtgacccgcagccgcgtgcgccgtgagcgcatgggccacatcgagctcgccgccccggtgacgcacatctggttcttcaagggtgtgccttcccgcctcggctacctgctgaacgtcaccccgaaggacctggagcgcgtgatttacttcgcctcctacatggtcaccgaggtgaacgaagacgagcgtcacaacgatctgcccggcctgcaggacgagttcgattccgagatcaagcgccttgagcagcgccgtgactccgacatcgaagcccgcgccaagaaggtcgaagaggatctcgccgcccttgaggaggccggcgaggccaagggcccggcccgcaccaagttgcgtaacggtgccgagcgtgatatggctgccatccgcacccgctacaacgaccagatcgcccgtgtggacgccgtcttcgacaagttcaagaagctcaagcccggcgacatggtcgacgacgtggacctgtggcgcgagatgcaggaccgctacggcgattacttcgacggctgcatgggcgccgaagccatcaagaagcgcctgcagtccctcgacctggagaccatctccaaggaactgcgcgaggagatcaaggacgcttccgaacagcgtaagaccaaggccctgaagcgcctcaaggtcgtcaacgccttcctgaccaccggcaacaagccggaggccatggtgctcgacgtgatcccggtcatcccgccggacctgcgcccgatggtccagctcgacggtggccgcttcgccacctccgacctcaacgacctgtaccgccgtgtgatcaaccgtaacaaccgtctgaagcgactgatcgagctcggcgcccctgaaatcatgctcaacaacgagaagcgcatgctccaggaagccgtcgactccctgttcgacaacggccgtcgtggtcgcccggtcaccggtgcctccaaccgtccgctgaagtccctgtccgacatgctcaagggtaagcagggtcgtttccgtcagaacctgctcggtaagcgagtcgactactccggccgttccgtgatcgtggtcggcccgtccctgcgcatgcaccagtgcggtctgccgaagccgatggccctcgagctgttcaagccgttcgtcatcaagcgcctcgtggacctgaactatgcgcagaacatgaagtccgccaagcgtcttgtggaccgcggcgacgccgaagtgtggggcgtgctcgaggaggtcatctccgagcaccccgtgctgctcaaccgtgcacctacgctgcaccgtctgggtattcaggcattcgagccgatcctggtggaaggcaaggccatccacctgccgccgctggcctgcgccgccttcaacgccgacttcgatggtgaccagatggcagtccacctgccgctctccgccgaagcccaggccgaggcccgctcgctgatgatggcttccgacaacatcctgaagccggccgacggccacaccgtgaccatgccgagccaggatatgatcctcggtttgtactacctgtccaccgtgctggaaggcgtcaagggccagggccgcgtgttctcctcgctggaagaggccgaaatggccctcgaccgccacgagatcgacatgcaggccaaggtgctcatccgcctgcccgagagcttcgtgctgccgaagaactgggagcccggcgaagtcaaggtgctcgacccgcgcgaaggcgaggacgaggtcgtcaaggaagaacgcttccacgacggcaccgtgctgttcgccacctcctacggccgcatcctgttcaacgagaccctgccgaccgactacccgttcgtcaacgagcaggtggccaagggccgtctgtccaagatcgtcgatgacatcgccatgcgttactccacccagcaggtggccgccacgctggatgccctgaaggatctcggcttcacccgcgcaccgtggtccggcgtgtccttcgcgttctccgacgtgaacgagccgcctgagcgcgacgagaagatcgccgagtacgaggccaaggccgacaaggtcaacgccaactacgagatgggtctgttgaccgaggaagctcgccgtcaggaactcatcgacctgtggaccgagtgcaccgccgaagtgtccaaggaagtcgaggagaagttcgacccgacctccaacctggccatcatcgtgcagtctggtgcacgaggcaacatgatgcagatcaaccagattgcaggtatgcgaggcctcgtggctaacccgaagggtgagatcattcctcgtcctgtgaagtccaactaccgcgacggcctgtccgtgctggagtacttcatctcccagcacggtgcacgtaagggtctggccgataccgcactgcgtaccgcagaatccggttacctgacccgtcgtctggtcgacgtctcccaggacgtcatcgtgcgcgaagaggactgcggcaccaaggccggtctgcccatccgcgtcgccgagcgcgacaacgacggcaacctggtgctcgtcaaggccgccgacggtggcccgtactcccgtctgctcgccgccgacgtcatcgacccggccgacggacagaccgtgctgtacaagcgcgacgacgccctgtccatggacgtgctcaacgacctcgtggcccacggcgtcgaggaagtcaagtgccgttccgtgctgacctgcgagtccaagcgcggcgtgtgcgccaagtgctacggctggtccctggccaccaacaagctggtcgatgtcggcgagaccgtcggtatcgtcgccgcccagtccatcggtgagcctggtacccagctgacgctgcgttccttccactccggtggtgtggccgcggcctccgatatcacccagggtcttccccgtgtcaccgagcttttcgaggcccgcaccccgaagggtgaggccccgatcaccgagttcgccggcagcatcaagatcgtggagaacgatcgcggtcgccagatcatcctgaccccggacgccgattccggcgcaccgaaggaagacggcgtgatcaagccgatcacctaccaggtctccaagcgcgtgccgctcaaggttgccgacggcgaccacatcaaggtcggcacccagctggtcgaaggttctgtggaccccaagaagatcctcaccatcctcggcaagcgcgccgcccaggtcaacatcgtggaggaagtgcacaccgtgtaccgctcccagggtgtggatatccacgacaagcacatcgaggtcatcgtgcaccagatgacccgtcgcgtgaccatcatcgactccggcgacaccgacctgctgccgggtgagctggtggacaacgcccgcttccgcgagatcaaccgcaacatcgtcaagaacggtggccgtccggccgtcggtcgtccggcgcttatgggtatcaccaaggcgtcgctggccaccgactcctggctgtccgccgcatccttccaggagaccacccgcgtgctcaccgaagccgccctctccgagaaggtcgacgacctcaagggcctcaaggagaacgtcatcatcggtaagctcatcccggccggtacgggcctcgcgcgctaccgcaacgccgtggtcgagcctgacaaggccatccgcgacaccatctacccgaacttcggtctgggcggcgatggcgatctcggcgacgcgagcttctccgacgccgacctgtctgacctgaacttctcgaacctcgagttcggcgatctgaagctcggcgacgacttcaacccggatgatttctactccgatcagggcggtcagcctgacatcgaggagtaagtgagaaggtcctagaaaggatgccccttctaggactcagatcttgcgttaatcgcaataagatggcccggaactatatcagttccgggccatccgtatatttgccattgtgattttcctgttgaacaagagcaggcagccgctcgttgcttgattactcaagcctgtttttcggtgaactggaagaactggtctccgatacgcaccgtggcaggcgcgctgagcttgagcggtgtgcccttggtgacttgtgtctcttggccattggtgatgatgtaggtgccgttcaacgagccgtagtcctcgatccacagcgcgccatcggtgtcgatgctgatggcggcatggttgcgggatgtggtgcgggtcgggtctacgatacgcaccgccttggcaccctgcggcacatccatggaaggcttgcggcccagcaacgtgctcttatcgatcacgatggtctggccggtgacatcgttatgcagcaggtacgtcttcttcggtgccttggacgtgaacgaggaggagagcacggtgctgtcccaatcctcgatgtcgttttcggcggcgtgcggtgtggtgtctgccggagcggtggcagcgggctcagcggcggcggccgtggcggcaggctctgcggtaaaagcggtattggttgccgcttccgcggtactgggctgcccgtagtcgttctgcggttcggctgtgccaactgcggaatccggggtgccttccaccggatcgtcagaataccaacccagttcaggtgctggagggtagggaagtttggccatgatgatgccgtcctttcactgacgggaagccagagcggcgttgattgccgggtcgccgagctggcccagccattcgatcagtgccggataggtgttgggattacgtgcgatgcaggcgcgtagttcaggcgcgtactgggcaatctgggcgatttgcatctggtcggtggtggtcagggcctgttcggcggtgaaaccgtaaggattggtggccacaggctcctcgaatgccgcctgagccgcgggctgctgagcctgttcggcggcgggctgctgggccgcctgtgccgtggctttctgatcctgaaccgggccgccgaatgcctcggcagtgaacccgtattgcgccagggtctcgcgggcgcgatcgtcaccgaactcggcgatccaacgcttcaagccgggataacagcgcggattcacggcgacattggcaccgaattccggattctcgtaggcgatttttgccagcagaatcggatccgcgttcggatcttgtacggcagcgaccgcagcatcataatcaaccatgggattacctccttatgttcgctcggttatgccgaacgtatggtccgtagtgtttgtagtgttgcgtcttcaatggcgccgatatcctcaccttcgtccagcctgaatgcgctgaacgcatgatgttcgggttcggtcaatggcatatcggccacaatcacagtgatattgtcggttccgcccgcatcaagagcggccgccaccaaggcgtccacggcctcctgcggactggaatgcgccgcggcgatggccgcgatctgttcgtccggcacctcgccatgcaatccatccgaacagatgatgaagcggccggtcagatcggcgacatatacgtcgggcatgatgccatccggatcacccagacattgtgtgatgatgttgcgtggaatggtcgcctccgcctcttccggcaacatctgcccggaatcgatggcttcctgacgttgcgaatggtctcgcgtgatgcggatcagcgaagcggcgtcccacacgggaatgatatccgtggcgggagcatcggcatgcgccaacggactgagatggtaggtgcgggaatcgccaacattgaccacataggtctggtccgagaagtcctgatcatcggcgtcactgaacaaagcagcgctgcgggcgctggtggaatccgcatgatcttggggcagtaccaaaccggagcaggtcgtgccggccacgccgccaaggcggtctcccagatcaagaatgtcgtgctgggcccgtgccaaggtgtcgtcgatatcctgacgggtgcgtgaaggcatggcggccaattgtgcgaaatgctgggcagccaactggcttgcctgctcgccgcccatgccgccgcccatgccgtcacagaccatgaacacgccttgttgcgcgaatccggtgtcttggttgtttttgcgcctaagacccacgtcactggtcatcgcgatacggatggagcctgtggtcatgacgccttccccttcttacgcgtgcgcttgacatgcgtcgtgtgcggctttgctgcgtgcccatttgacagtatagccacgcttttcagggaaagtcgtgtacgtatcctcctgaaacgcggcaaagaagcgagcattgccttgcgtaattggtcgactcctgtccaatatgtggtggcttggcccgattcaatgtcttgccccgagaacgtggcgtagtcggcttcccggccaagctggatcaaagcctggtcatctgtgccgagttgacgggcgatggcaccggcctgatctcgacgagtgcccttggctgtgatgccgctttgctcggcaagcatgcgtatggcattccaacctgctgccacacgggctttcggactgccatgccgccgcgctcgtaccagcagtatggccttgaacatcagaatcagaccgcaggcgatgagtagggtccacaatgggctgccgtacagggccaccttgcgggtcactcgccagaaccgcgcccagaacaggttggtcggcgaatcatcggcgtcggcgccggccaatgagctttggcccttggcttgcgtctgatcgcgcagcggatcggtcaacggcactggtggttgccggaccagcgtctgcggattcggcggcgtcaggttctggttttcatcaggcatcttggtctccttgggcgtcggatagaacgccacccatcccaggccctgcaatttgatttccacccaagcggtgacatcgttgccggtgaattcgattttggtgccattgcccgaggtcttctccgtgcgggcatcggtgatttcgccatcctcgtttttcggcaggaagcccaggaccacacgggagggcagtcccagatcacgagccatcagtgccatggcggaggcatattgctcggagtcgcccaccatggccgtgcctgccagcagcttgttgatgcggtagttgccatggccggcatcggagggatggtcgccttcaagtccatgagagaaccatccggagtctttcaatgtgtcagccaacgccgtggctgcggcaccgcccgaggactgcccgccggcaatggacgtggccagtttgctggccgaatcgggaacatcctgggcttctggttgggtgatgcgggccgcagccgcactgctgatctgcttatcggtgggcttgcgggcgataatgccggattcggtataggtgaggcctttacgcgtgccggcgggaataatggcggaatcggtatccgtgttgtagtaaaacgtgtcattgccgttgtcggcatcgttggcgaagctcacgccagtggccgctcccgccagcggcagccaggtgtcggtcagtccctgatcgacggtgaaggtcgcagtgaaggatttaccctgctcatccgccttgatcgtggtgcccacgcgatgataattcgaggagtccgtggcttcggaagaatcggacaggttccatactgtgccatcgaatcgatccatcaccgcaagtttgaccggtgttccggccggcagattatgaacggtcagcaacacgtcttttttgtggtccttgatataggatcgcatgccgctgagcgggctggtgtaatcgtaggggcttaacggcggatcgtagcggtcacgcagcacgaaacggtcctgtggcaccagcaacgtgcccccgaaagcaaggccggcagcgagcacgacgatgatcagcgcggatatccagcgcccccattccagcagttcaagacgccaagacagccagataatcagcagcaaggcaaaggcaataccgcagatggcgcgttgccagccgctgtctgtgcccagcagggcacatacggccacggccgccgcaaggggcagcactcccaccagagacaaccatgcgttggcattaatggcaaacacgccggtgaagaacgtaagccacaggccgatggtccataccgccatcagcacgccgtcttgcgtgcccagaggcggatcgacggaaataatgtacttgaacgagccaaacgtcatttcccaacctgaactcaaggtcttcaaggtgggaaccacgtaatgggacgtagtggaactcagcgttaccaccgggccgatgatgaattgggcaaacgccagaaacacgatttgccaccacagtcgcaacgccggcaacatgcccgccagagcgatgatcgcgcccagcaaggtggccggtacagcggcaatcgcccaagtggccacgccgccgtacacgtcgatgagattggcttgcgccagcaacatcatcgccgctatgagtacgaggctggcgattcgtttgccccacggctggcgactgaggcccatgccgcgaagcacattgcctctggtcatccagataaccgaatgtgtggagtcggcccaggagccggtggtggtggaggtcccggtgtacgtgccggaggaagtgccggtgtatgtgccgctcgattcggcgtacgcagcggtattggtattggtgatactggactggtcgaaggtcatgcgagcacccccatgatcagcgggagatcatcgaggtcgccgatggtggccaatgtgaagttggcgaatcttctgatgccgcgattggcgccggcgctggcctgcaataccacgcagctggccgatcggggcaaggccaaggtcatgcgcttgatttgctcgatgtctttcagcgatccaacagtgaaaaaatagaacgaagcatcaggactgtgcttcagcgtgccctcggcgagattcggattatcctcacgatcaggctctatggcactggcgttgtcgaggaactccatggcgttgcgcggctggccgtgcgcgttgcccgcgtggcagaacaatggacgatcctgcagcaggcatttgacgccgatggaggagtggatggacaccgccatctcgaattcctcgccgttgacgtattcgtccgggttcacgctgatggtcaccgaggtgtcggtgcggcgcgtggcctcatattggcgaatcatcaacgtgccggttttcgcggagctcagccagtggacgttacgcacgtcgtcgcccggctcgtattcgcgcaatccgtagaagtcgagatcatcatccacgatctggccggatggttggccttccaggtcgcggggcacgccggcattcagagtatcgagacgcacggtacgagggtggatgaatacggtgatgcggtcggccagctccttttcgtgacgcaccagaccgaacgggtctcccttgcggatgcgcaatgggccgatgggcagtattgcgcgcgatacggtacggaactccacatcggtttgcttggattgcccgggagccagcatggggatgttgaatcgttcatgcgcatcgccgattggcagatatccgcgtgccgtggtcgtcggcgttctgccggtgttgtcgatgccgacgataacggatacggtgtctcccacggtcacgcgatgattggatacgacgatggacgcgtggaagcgtgtgttgccgagggaaagcacgattgccgcgagcatcatcaccatcgccacgatgccgaatacgagcagctcataccagcccagaggcaggaacgcaataagacatgcgatgcctgcgcccgttaccgcccagcccaagggcgagacgtaggatgcgaagaaccgtctgatgcgtcttaccgcgcgcttgaacatgcgttcagcgcgccggcgacggcgtaatgcggcggatgtagatgccatggtcggatacctttccaggccctatcaggaaccgatggtgggggagggaacgtcttcgagcacctgtgcgatcaggctttccggagtcgcgccatcgaaggtggcttccggagtcagcgtgatacggtgtgcgagcacggccactgcaaggtccttgacgtcatccggcaccacgtaggcacggccatcggccgcggcccagatacgggcgcatcgggtcagcgccaaagcgccacgcatggaggagccgactgtgatcttctcgttgtggcgggtcgcctcgacgagcctgacgatgtattcacgaatcgcatcatccacatagatttcggtggccacctgacgcagccgcatgacatcgtcaccgctcagcaccggggaaatggtctgcgcacggtcggtgatatcgacctgcttgaggatatcgacggacacatcatggcccgggtagccaatcgacgtcttgataaggaagcggtccatctgcgcctcaggcagcttataggtaccgagctgctcgatggggttctgggttgcgatcacgatgaacggctgcggtacatcatgggtgacgccgtcaacggtgactttctgctcttccataacctccagaagtgcggactgcgtcttcggcgatgcacggttgatttcatcggccagcacgatggaggcgaaaatcgggccctcgcggaactcgaattctccgcgcttctgatcgtagaaagtcacacccaccacatccgaaggcagcagatcaggcgtgaactgaatacgcttgaaaccggtggaaatggagttggccaagcctcgggccaactgggtcttaccggtgccggggttgtcttcaagcagaatatggccaccgaccatcagtgcggtgacgcattgcttgatgggaatggtcttgccgataaccaccttggagacattctcgaccagcgcattgaaggactgctggaaatcccggacctgagccgtgggctggggcagtagtccggaattgatgctggcgggcagtgccgatgcggctgcttgcgcggctttgctcgactgacgctgcggctgggattgcggctgggattgcgcggcggcctgctgattggctaccggcccgcgaccagccacggtttcggcgttggatgctgcggtcttgccggcggttgtggtcgtccattgacgggaggtctgggtggcgggggcagcattcgcagtagcggcctgcttgccggatttacgtccgaagtgcggaagcgcgactttgggcgtgctggtctttgccggcatgccgacctgctgcgggatggctggcgtcgcgtccttgcgcggcttgagcacggtgctgtcatcgcccgcaggaatggaggcggcatcagtagtaggagacggcttttctgacgacgcttgtgacggccgctgcggcaggttaggcaacgcaacgggttgctgtgccgtctcggtgttcggggtggtgccagtgtgcggttccgatgccagatgtgtggcatcggacaagtgcgtggcgtcggatagctgcgtgctgtcagacagctgcgtcgcgtcgtcgatgttctcgctcatggatgttctcctactgcttgtgaatggtggttgacgatattggggtattaccgaaaccaagaatccaagggttcttggccaaagtggtgacatcggtaccggatttgagcgactcggtcccctccgaggaatcagaggggcgtgtgcccgcgacgctgctgccgtccgccgtattgtcgagaccggagtatcccggcccgccggtgactttgacgctccacgtgtagttgccatcggcggccacggccaagtcggtgacgtccaatggctggccggggttccacgtgaacggttggccattgatgatgatttgtacggtggcctgcttgccatagacctcaaccgaaccgccggtgacgttaatgacgtgagcgttgtctgaccagcgcagctcctgcggtttgttgattgcagccttcttctcataggtgtaaggagcgccattgtacgggcctccggtggcggcatcgctggtagcgccgttgaacacctgttgcaccgatgcggtattgcatttggcccaaggactcattcggaagtcgagtgagttccggttagtagctgtaccggaatcgatgccatcggcagtcacgttgtaggactgcgcatgcccctgcttggtccaatgcacggtgcatgtactgccggatccggtggtgtagacgtcagtgggcggctggacattgtactgcgggacaaacctgctcttgcctgtgccggcggaagcatcgcgctgcggcaccacggtggccgttacggtgatttcccgggtgttcaaatcgttctcattgatatcgaacgtagcgccaccgtcactgcaatcgatggtgtccttgacgtctcctcccaaggaaattcgccggcagccggcattgcggttgttgccgagagtgactttcgccgttcctgtggtgtcgtcgttcgacagcgcaatggtcggcgcatccgggtctccccagatgtcctttggctgtgatgaggcggactcggcactccaattgattttgttatgggctttgacggtcgccgtaatggcggtgccatcggaaatgtcgttgttgttgaacgtaaacgacagctcggtggccgtattgccggtttccttggtctgcggagcacctgcaccggtgacggtcactgaatagttgtcgacggcgctgaaatcaccgctcggcgctttccacgtcactttggcggttttattgccacctgtgaccgtaacatcggtgggagcggacggcaccttgtccggtgtggcttcgacggcggtggacggtttggaccaaccgacgtcatttcgcgcggcgacggtgaaggaataggttttgccgttcttcagacccgtgacctggcatgaggtgacggcaccgcaatccttctctccggtggcggcgccggtccaactgaccttgtagttggtgatcgggctgccattggcggcaccgggcgtccatgtgaggctgaccgcgctgtcctgcggttccccggctacgggggagagcagtggcggctcgggcttgtcgatcacggacacggtaatcgatgcggtgacttcacgatccttggacttgctgccgtcttgcacggtgacgagcacggtgttcgtggaagcacccggatcggatgcgacggcgatggtgacgtttccggaggcatcgcatccggcgatagtgagtttggcggcgtcatccgccttgcagctgatgacggtcagcgaggaatcggggaacggattgtacgcgccggtaagcacgttcacggcatcgctggcaccggccttgatcttcagcgtcttgtcgccgacgcgtgccagcggacgggtggaagacactacgcgcacggtcacaccggcattcacggtgcccgcgccgtatgcgatttgcacgggaatggacgcggtggtgccaggagcggcatccttggtggcggaaacctgcaagctgccggaacgggacaggttagcggtgattcgcccggacgatgagcttccgccggaatacgtgtattgcttctcgtcgtcatacacgccggacggtgcatgggtgagcgccgtcagatcaacggtcttggggttcgcgcccgcctcgacatcaatagtggaggacgagaacgtgggcggcggcacatcgcggcctatcaccgtgatctggagagtgatcactgcggaattgatgatcttggtcttatccgatccctgcttgccatccacagcggtaaaggtaatggaggcggggcctgcgtagtcttttgccgcagtgaacttcagggtcttgtcgttcacgtagaaatcggagttggaagccttggtggcgctgacggaatcagcgctttcgatatacggttccttgccggcaccgacgcgaacatagtcattgatgttgatttcaatggtctcacgcgaattgaccttcaattccggtgccttgggacgcaacgtgggcggaaagacaccataggccggtacctggatgaacgcggtggaggtgatgttgtatttcgtattggtcaccgtgtaaggcacggctcgcgcctgtgacgtcaggtcgacggtgatggtggtcgaatgctcaccgcccttgacgtgagcgtgagcgctggcggagggatgcacgccgaccttgagctcattggctgtgccggaaggattggcgatccactgggaaacatccacatccacggacttcttatcgatggtggcggcggacggcacacgatagtcgtaggcggtaggcggctcgatggcggcattcggatccacgtttaccgtgagggtggccgtatcggacaagccggccttgtctttgaccgtgtaggcgatataggcggtggtggcgctgccgggcgtggtgaaggagatcatgttgtctttcacgctcaccccgtcgagaccttggacctcgacatgcttgtcgacggtcagattggtgttgtcgccggagatgtcgttctgcgcgaccggcacggttgcggccgtattgggcctcaacgtgatttcgtcatccctggcgtatacgccggagtcggacgatccttggaatacgcccacgcggatctgcgcctgtgcgcgctgaccggtccaatcctccacggcataggagaaggtgtcggtgccggacgaatccggatacgattcatagaccaagtagtcggaaccgacttcggatatgcggcccagcgtgggtgccttgttgcccagacccaacagctgatcgtcgtcgccatccgtgtctatgccggtcagtgtgatggggatgcggaccttctgtccggcggcaacctgcgcttcggcgtcatgcggggttggcgcggccttgctcgctgcgtcgctcttatgcacggtaatggtgatattggcggaagccacattacccagattgtcttcaaccgtataggtgatggggaagttgccggtctcgctggatgcttggtagcggaccgtgtctccagagacgaaggccagacccttgaacgtctccttgtcgtattgcaggttgttcttgagcttgaccgtggtgccatccgagtaggccacatggtcaagcacatccacggacacgatgccgccggtgcgcacctgggcattgatattgctggccttgggcactgaattcgaggtggtcagagccggtggctgcaacacgatggtgcccttggcggttccggaggcgttggccacggtgtaggtaagggcgacgggtttcgtgggcacctgacgcgcagtgatatacacgcgcttatggctgacgagaccaaccttgatgccggagtcggccggtgcgctcaccgtggtgacggacagcacgccgcccatcggatcgacgtcattggtgagcggctccacaatggcggtattatccgcgccaagcagggcgacatcgttggcggcaaccggtttggcggcctcgccggtggcgggctgtacctcgacgcgagccaatccggtggccggaatcgagccttgagtaatggtgtagggcacataataggtgccgggattggtggccttgaacgtcaacgacatatccgccgcattggtggtcgtcgaagcgccgttgggcgtatccacctgagtcagctgtgccggctgcaaggaagtgccatgcacgtaagaggacagcttgacgacggtatccgtgttgggaacggtggttttcgctaccgggtcgatgaccgcggccaaggtgttcgcgggcttgaccgagaaatacaccatgccggtgccggtcgccgtgccgtcggagacggtgacctcgacgcccacgcgtcccgacgccagcgcaccggtgttgaacgtaagctggccgtcggctcgggtggacacctgcaccgggtcggtgttctgggccacagcggagaccagagtgagcgggtctccatccggatcgttgaagctgctcagcgcattggcggtataactggctccctgctccacatcgatctcgggaggagtgtcgaactgtacgggagcgtggttgcctccatcattcagggttacggtcaccgtggcggaagaggtctggccgcggccatcggaaatatcgtaagtaaaggtaacggtgcctgcggatgtggcggaggcatcgagttgcagataccggccgtcgtaaatcggcgaaatggtgacgtctttgttgtttggtgcgccaaccttggtgattttcagcacggaacaatcggtctgctcgtcattgcgcagcacgtcgagaatctgttccgaaccggctcgtgcgccgatttcatcatcctcggctttgatttggccggattgtgcggaacaggtcttggagaagtcgtggtggttgttggccgagtcgttgttctgctgttctttctcggtctgctcggcctgtattttgttccactgtattttgatgactttggtggaatcctcagggttccacacattgccgttaaccgtgtcgttgagcactacaaggcgatggttggtgcggaacaccaattcggaagtagtattgacggattcgagggtttgcggcttgacgctggtatccgcgggggagcaggcgcgaatgtagttgctggccttctggctccaagccgagtacacgcagcccttggacgataccggtcgtgccggattcgccttgcccccgttggctatgaaattcgccttggcattggacttcaacgggataagcgcaaggcctctcggtgatgccgcggccacccaatcggactgtacgtcatcggtgggaggctcctgaagggtgagggtgccggtcgtgtcgacatcgacgcggccgcccttgaatatgacggttttgccggttgcgattaccggcgtgctcccgatgacggtaaagctttcaacggtctgctgcttgccgtcggtcagcgattcgagggttttggccttggcgctgctggaattgtcaagacgcagcaccataccgtcggatggacggtatccgtagaccttgccatcgtgggttactgcgatgcgcccgccctcgcccagcttcattttcggatcggaagtggtgggggccacggaatcaaggttttccgacaagccggtccacacattgccggtcttctcgttgatcagggctacggtatccccgccgaccacagtggtggtgttggctttgatgtcggtcttgacaccggtgctgaccgtggatgccttgatggtggaggctttggtcgtttcggtcaggatggtgtcgccattatgctgcgcgatgtcgaatcgtggggcggaggaggagacgccggcgtcggcctccttgttctttacgttgaatcgtgcggccttctggttcttcagcgaagtgacccatacggtgccatcgtccagttgcacatggcggcgcgtgacggtgctcatgatcaccgcgccggcaacaagtcccagaagcagcaggagcgtgattacgggaaccgtccacgtatgccctccggagggcataaggcggcgcaaagccgcgctgatgcgtcggcgacgatcgtatgactgggacgatgtggccatctgaactccctgaaccctggtttctctggttgctagtgtaatgacaacgctttacggttccaatacctgccgttcctgttgtccatttggtgaattcgccactgccgggcgcatgcctgatgcgatacgcaatgctaaggtggtatgcccggcagtggcgagcggatcactcttgcggcttggccgcacaggcgatggcggggctgacggacatctggcggttcttgcgcacaatggacacctgaatgcaggtctgcgagccttcctgcgcgttgacggtcaccgtgggatctgacgttgtgacggtttgcgcgctctggtcggtattgctgccctgcactatggcccacgtataggtatcaccgctttgcgggtctggattcgtccaggtgaacgtcacggatgacccatccgccgcataggtgccgttcagattctccggggaaggaatctgggcgttcgcggtatcggtgatcacgtcatcctgattattgcggttgttgtcatcatccttggtgccgggcgtcgccacctgtttggtatctgatccggtggcgctgtccatgcggggaacgaccacgaaggcgaatatcagtgccgctgcggtgatcgccgcaagtataccgacggtaatacccaccggtttgacccatcgccgtgacgaacgggtgatctgatctcgctggtccgtggcccggcgccgacgctcgatgtctttgggataggccggcatcccttccacggtaacgggagtggcatgcccgaaatatgcgaattgcacacgctgcatggcacgtgcgaactccaacgcggagtagtaccgctggtcggggtccttgttcagggcccggcgcagcaccgtttccacatcggccggcacgtcggggcggttgaggcgaggcaatggctggttgacgatcagcgaaatcagttccgattgcgaacgtggatgatattcgtgctggaatggcgagcagccgacgaacatggcgtacagggtggccgccagtgaatagatgtcggcggcttccgaaccattggtcagatgctgaagcacctcaggcggtgcccacggcggcgagaatccggtttcggtgcggtcatacacatcggtggagataccgaaatcacccagaacaggcaagccctgcgaggtgatgagaatgttgctgggcttgatgtcgtgatggatgatattgctgcgatgcgcggtgaacagcgcgcttgacagcttgatgccgaggtcgagtacctgctcgcaggtcatggaccgggccttcatgatgctgttgtaggtgccgcccggcgcatattcgatgacgatgtagccatggccatcggaggtgacgccggcaccatataccggcagaatgtacgggtgggatgacagcttggccatgaagttggcctcgcggttgaacagggcagcggcccgtgggtcaagggttttggcgctggcctttaccgccaccgggcgtgcgggcatacgctggttatataggtacaccgtggcggtggcaccgcttcccaacatctggacgaaatcatatccgggcagcttcggcggtctcatcggaatgttgtccatctgttccctccctccttggaaaatgcgctctccctgcattcgttctacaggataccgtcaagggtacgattcttcgtcgggttcggtaaaatttttccctctgtgacggtcgggtttaggctggagccatgatgacgagacttgaacctggaacagtgctggacggcatcgaccgtgatggagcggcgaggctgattgtcggcacgcctggaagcggcaaaactgaattcgccttatcggtgttgatggcggggctgcgccgctacggtggcacgcaggcggtgatggccgtatccggccgtgtggccgccgacgcattgggcaatcgggtgattcgtgagctcgggttttccgtgcaggccaggccggtcaccacgctgggtgccgtggcattccgggccatatcggcttcgcgcgagggaactggattgccgtcgcctcgattgctgaacggtgcggaacaggatgctttgctgcgtcaagtcatggccgtgcatctgcgccatgccgtagcgggagatgattgcggcacctgtgatttgctacgcgtctactttgcccaggatgactgggcgagactcatacgcgatgccggtgccggcgagatgcccggctctgccgcttccgcacaatcaagcctcccgcaacaagggtcggattcgccgtctccgacgtcggcaggcggctcgaccagcgcggataggttcacgcgaggtatttcagatgcgtttatcagccagttgcgcgatatgctggcccgattggatgagctcggtgtaggcgttcacgaagagccacgtctcttggacgccgtgacggaggacgcgcgattgtcggtgcaatggcgtttggctttcgcgttgcgccgtgaatatattgcagcccaaagcgcggtatatccggggcaataccgtttggatgcctcgtatttgctggtggcaggagctcgtgtggtgcatgaggcattcgccgccgatcacgcggatgattccgaccggcctatgcgtatggaggcgttgggcttgccccggctgctggttgtggatgatgttcaagacaccacgctggccggcatgcgcttcttggaggagttggggaatgccggcgtcaagttggtgctggtcggcaacccggatgaatcggtgcagaccttccgtggatcgtatccggaatatctgatgcgccgtgccgtggaagggtggctgaaagccaaggaagaacagctggttggcggcagtaccggcgctgatcagtcgcacatgacgatggctgatgtgatcgcgtctcgtatttcgctgtcgattccctcgccggaagacgagccgctgcctccggccgagcgtcccggcaagctgaccgccatactgggcggagtcgatgcagcgaattatcagtcggacggcacggtgaccgccggcctgtaccgatcctcacgtgaggagctggatgatgtggtctggcgcatcaagcggacgcatcttgaccggcatattcggtggaacgacatggcggtcatcacccacgacaatgccgccgtgcggctgttcggcgaacgactgcgccgagatggcgtgccggtgcggtattcgtcggtcacccgtccgttgaaggacgagactttcgtgcagggattgttcgcgcttgtggagcttgcccgattgcgtgccgagggaatggcggaatgccagatgacgttggcttcctgcgcggcatatataaggactagagtggccacgttgatgaacggcccgttggtgagtgccgggggcagacccggtcaagggcgtcccgcaaggcttgcgccgatcgaatcggccatggggtcgttggagtcgctggcgcatctcgccacggatgatgccatgctgacctctctgacgacggcatgggaggcattgcgtgaaacataccatgaaacacggcgtgaaacaggtcgtgaaacatcctcgtcagtggtttcgtcgccagtgtctgtcgaaatactcggtgaaccgtccgacgatgacttggcctttggcgttgacgcgctgtacgtgatgcttgccgttgatgatgccgccgcgccggcgcaggctgcgctcgcatccatccatgcggtgcttggcaacgaccctcaggcccgcgcttttgcgaacctgtggcatctggtgggcagcgttgcttccggcttggagcggctgccggcaagccagcgcgtacagccgcgttatgcactgtctgttgcctggaacgccaccggtctggcaccggtctggcagcgtgcggcattattcaacacggcagaggggcgcacggccaatgaccggctggacgcggcaatgcgcctgttccagttcgccgatgattccaccgccagccgagacatcacgtcattcatggcacaggttcggggcatggaagtgcaggccgattccttggcccacatagggccggtggaagacgctgtgacattgaccacgccggcaggcgcggccggacgccactggggatatgcgtggataccggtggtccagcaagacgtgtggccgaacctcgccgggcgcaacaccatgttcggtggtgaagaccttgccgagctcgtgctgaggggagcgcttgaagaaagtgacaaaaccgggcatgatccgcagttcgcggctgtgctgtcgggcgagaagaagggtttcctggtcgcgctgacccgtgcacggcgaatcatgatcagcgcggtatggaacgacagcatgagcccctcggactttcttttcgggtatctgccggaatactatccgcgcaaccggcaacaggcgcctttcaccacagtgggggcgcatacaggatccgccgaatatgatctggccggattggacgccgacccacgtgggttggtcagcgccgcccgcgcggttctggccactgctcaaccgcagcaggctgccgcaaaggacgccgcggttgcgttgacactcctgtcggagcatggtgtgcgcgccgcaaatccgcagagctgggcgttcgtggaatcgccggcccaatcggatagcgcgtcatctggcggtgcgtcatctggcggtgcctcatctgacagtgcctcatccgacagtgcctcatccgacagtgcctcatccgacagtgcctcatccgacagcgcgtcatctggcggtgtacagtctgacggtatccaaacggggaaaggcaagacggatgcgcaggccgcacccatggtcaccctgtctccatcggcggtcgacagcctatgggcatgtccggtgtgctggatgctggagaaccggttcgccggtcctcgccccagctccgtggccaccagcttcggaaccctcatccatgcggttgcgcagcaaggcagcgaggaagggctggaccatctttcccacaatgcccagacgttggccacactgggcttggactccacggccggcacggaacgccgcatcgaggctgtcacggcacggcttaatgccatctatcagagcaaacgccccgatccgaatgccatagccgacacccggaaccgctatgaggccacccgtaaggacgagtccgcggcagatgccctgcgcaacatcgccgattactttgtgcgcagcgacgccgatccggaaacgtatcttggcaagaactccagcaacttcagcattggcgcattggccggtgccgaatgcgaacgggagtttgccgcacgattcgatgtgcgtgacatactcgacgcatacaatgccgtgcccggcatgcacccgatcgatcggaacatgctggtccgtctgatgggagcactggtcggagggtggccggaaggcatggacgagcatctgaccgtgagactgtccgggcgcatcgaccgtatggaaacccgcgtactcgcagacggcggcgaatgcattcgcctcattgactacaaaacaggcagaacgcccacggtcaaacagattttcaatgatctgcagctcgtgtgctatcagcttggcctcgtgttccccgaagacgggccgcgcggtgccaaggcacttgccgcaatgccgcatatcagccaaagcgcgctgttccatgtcgggcagaatgcggcaccagccagaagctacgccccggaaggtgccttccagccgccgctgttcactgatggttcgttgaatgccgaaccgttcacgccacgatactggtataaagaccccaaccgtttcttcgacatacccgccatagatccggctactcctcccgaaggtgtgagtgccgaagcgtgggcgcaattcgccgcgctcgccggtacgcagacgttatggtcgctgaccatgatcgcccgcgtattctatgccgcggcggccagcaggtcggccatcatcgaggcccatccgcaagacacccatatcggattctgccgtatgaagaacgtctgccctgcctgtgcaggccagatcgacacgattttcgaaacgaggcaagcatgagcacgttcactcccagtgcggaacaggccgccatcatcgatgcgccagtcgatgctgacgtattggtggttgccggtgccggttccggcaaaacctttacgatgacccaacgcatcatcgcgcttatcaatcgaggtgtggcacctgaacgcatcctgggcctgaccttcacacgcaaggccgcaggcgaactgctggaacgcgtctccgccgcagtggccggtgatatggcgggctctacgaccgccacggtgtctgatcgggcattcctcaagccggccattttcacgtatgacgccttcttccagaccatcgtgcgccaatatggactgcttgtcggattcgatcagaacacgcaaccattgagcgcagccggagcgcttcaattggccaccgaagtcatcgacagtcacatggatctggcgttcagtgaggattttggcgccttctccagtttggcgaaccgtgttctggcgttgtcggatgccattggcagtgccatgatcggtgccggctgcaccagcttcgatgatgcgatcaatcgagtacggcaatgggattcggcattcatcaatcgattgcaacaagccgttgcagatgaacccatgcccgaggacgagccgaaaatccccaagatcaaacgactgaagaaagataccgacgccagctggcaagccaagctcgatgaccgtgccgaacatttgcacgcccgctgcacctatcattgcggtgcgctgctggagaccacacgcaaacgcgatattctgctccagctggtggaggcctatgcccaagccaagcgggaacgcaatatggccgaattctccgacttcaccattgccgcgtatcagcttatcgagcgcttcccctccatcggagagcgtacgcgccgcaggtacagccacgtgctgctcgacgaatatcaggacacctccaccacgcaggccgctctgctggcagcactgttccacgtggatgcgtcacagaggtccgccgtcaacgcggtgggtgatccgttccagtcgatttacgcatggcgtggtgccagccctggtgcattccgtatgttccagcaagatttccacctgtctgccggatacaagccattcccgctgtccgtcaccaggcgaaacagccgtatagtgctcgaagccgccaataatctcacgctgccgttgcgctccaatccgtcgcgtccttccagctcattgatgcgtgaggtcgatgtctcatcgctcgaccccatgcctgatgcccccgaaggaacattgggagtactgggcttcgccacggccgggcaggagatcgacgccgtagtgcgtttctgcaagacggccatcgcacggcaccgttccgcagccgaacaacaggaacagatgccgggcgaacagaaagcgccggtcgccgtgctgtttcggtccaaatcacatatgcccgaatatcaggcggcattggaacaggccggattgaccacattcgtggtcggctattccgcgctgttggaacgtccggaaatccgcgatctgatggcgttgctgcacgtggccgccgaccacaccgatacgggatcgctgatgcgcttgctggccacgccacgattcaccatgtccgcagcggatttgaccatgttggcccgttttgctgaagaacagaacacggaacaacgcttccaagcattggtgcaggccggccttgcccaaccggatacaccagcgaatgaatgggcggctgtggtgcgtgagtaccgcgatcaggtggccaatgcggtattcctgccagacgtattgctacgcggcgacctggtaaaactgcttgaacggttgagcgcacacgggcgcaacgccataacccgggccgcggtgatgctccgtcaggtgcatgatgccgtcgggcggccactgggcgacgtgattcgcgccggcatagaagcgttggatcttgacatcgacaccgtattggccggtgtgctgcataatccgcagcaccgcgccaatcccgctttggcgcatatgcctatggatgcgattgtggatttggtggatacgtacacgcaagagattgccgctgagcaaactccctcgttgcatgggttcatcacatgggtggatcatctggcttcggtggaggatgaagccgccagtctccctgacgctccggtggatgtggaactgatgaccgtacaccagtccaaagggttggaatgggatgccgttgcggtagtggggcttaccgccgtcggattccccagcaatcagggcgaccatctcaagatcgtgctggacgagcaccatacgggaggcaccgagcaaggtcactggaccgcacccgaatatcatgagaccgccgactcctggctcaccaaccccaccgccgtacccgtgcctatgcgtgccgatgccggcattctgccgcgattcccccatgatgccgatgtggaagccgaccccatcgcatcgttggcggctttggatgatgtggagcttattgatgatgaagtgttcggctccatgcgcgaattcggcgatggcgtggaagaagtggatgcatccggctggtatttgacgcaggcggaggaatatgggcgccggctgcatgccgacgaacgtcgattgatgtatgtggcgcttacccgtgcgcgagaagatgccctgatgacctattgcgcctatacgggcgaatccgggcgggacccgtcagtggtgcccaaaggctctcgcgccgctcagccatccaatttctggcttgaagtgcatgacgcgctccaagcccgtgaacatgcgatatcggctcaggactgtgtggaacggctgcaagccgccaatgccgggaagcccatgctgatctcggcgcaaggcgaagcgattgccactcccgaagggttctttatcggagagcatgccgcggcatacggtgacgccgtggtgggggaggcatggcagacgccgattacgcagacggatgccgctgtcggattgccgtggccggctaccctcagcgacgcagtgcatgaacagctgtcacgtggcatcgatgttatcgccgcagattcctcgtcacttgagcagcaccaagacgccggtccactgctgcaacgggcgcaattgctggtggacgacgccgatttgatggccgatgccgccagcggccagtcgcttgatgaggcagtcaaagccaaggcgcaacgcattctggccgtcggacgtcagaacgtgacaagcctgcaagcccgcgtaggtggcatgagcgaacgggaggagcgcctctactggcgtagcattatccgtccgattccacgaatatcgtctccggcggccgaagccggcacgcagttccatgcgtgggctgagcaattcatcaatgccggtaagccggatgaagcggtactggcatatgaagccgaatcaagtatgccgcatacaggtcaggatgcgggattcgtttcccgggaagccatgttggccgatttggccgaacgggagcggcaatgccgcaagccatccacacggcagcccgctgtcccacagcccacggctcaacaatccgcatccgccgtatccgccgcctccgccacttccataagtagcgacaatgccaccgagtccaagctggtggcgtggcagcgcagactggccgaatcatcgtgggccaagcgcatcccggcgtggacggagcgtgccattgtcgtggacgtgccgggcgtgggcctagtcaatggcaaactcgatgcggtattcatcggtggacttgacccgtccagcaccaccgcacgctttaccgtggtcgactggaaaaccggtcgtcggcccaccaagccagacgacatcacccgcaaacttgcccagctcgacatgtaccgactgctgctggcagcggtcgaaggtgtggaattggacagtatcgacgccactctctactatgtcagtgagcccgacgagggcttgcgcgagcttcacgcccgtgcgaaaaccaaacaggaaatccttaccgagttgagctccggcattcccgaacaatctgacaacgactgagcccaaaggctcatgacctgtacagcatcggacggccttcaccggtggagagaccttatgcatcgcaaggcatctccgacgatgaggacgactggccacgtaccggtccgcggttgaaacgcaccgcgtgacgttgctggggaaccgctaccctcggatggcacgtgtgggcgggcgcacgtgccggacaacgcaccagtaaggagttattgtgtccacgactcgcgcggtttcgaagtcgtctgctgcccactcgccctatcagcgcctgttcatgctgcccggagccaaggcgttctgcctgtccggtgcggtggcacgattgccgatttccatgatgagtctcggcatcgttctggcgctcaaccatctctacgacaattggaccatcgccggcaccatgagcgccgcctatgtgctggccatgagctgcgtcaccccgttctacgcccgcgccttcgaccgtttcggccaagcccgcgtgggccggtttgcgctcgccgtgcagatcgtggccatgctcgccttcgccttcgcggcgttggtgcgcgtgccgattccgctgttgttcgccctggccatcatcatgggtctgacgcagttctcattcggcgcattggtccgaacccgttggtcctatgcgttgcgcggtgtggaagatggcgaacagctgctcaacacggcctacgccatggaagccgccattgacgagatcgtctttattctggggccgattctggcggcttggctggccacctccgtgcatccggtatcccaactgttcgtgcccaccgtggcatgcggcatcggcggcaccatattcttctcgctgaaatccacccagccgccggtcatcgtggaacaggtcagcgtggccgcgcacgatgacggcagccccgctgcaagcgaagatgccgaccagctgaccctacgccagctcaaacgcagcggtgccaagcccaaaagcgtattgctctataccggcgtactgccgttgctcgccgtgttcatcgtgttcaatatgagcttcacgtccttcgacgtgtccatcaccgccaccatgaaatccatgggacttgagcccttcctcggtctgcaattggcgatgttcgcggtcggctcgtgcatcggcgcgctggtgttcggctctcgccaactcaaaggctcccattgggcgcatatggtgatgttcctgtcgctgctgaccgtcggctacgtgttcttccggctgtcaatggacaatctcatcctgctgggcgtcttcgaaattctctccggcctgaccgtctcgccgacgttcgccaccggcaacctcatcgtcaaggatctggtgccggcggaatccctgaccgaaggactgagctgggtaaccaccgcaggcacggtcggcacatcgattggctcgtccgtggccggtattgtgcttgacgcctccaaccctcatgtgggcatgatgctgccattcatcttcacgctggcgtccgtgccattggcgttggccggatgggccttggccaagcggcatgggtgaaacgggatcgggctacgaccgatggatggttggcggcttcgccggggtctctccctcagtccgcttcacggacagctcgaacgcaattaatgatggctttcagccaactgaattattgctcactgtcgttcgccctcacctaaaaacgcctccggcgttttcttcacggttcggctcatcagagggagctcgacttcacggttcggctcgtcagagggagcttgattctgtggacggggtattggcgtgagggcttggcggtgataggctgattgccgattggaaaacgtcccgggtacattgccgggcaggtacgggtagacagggaagaagacatgatcaaggtttcggtggtcggagcaaagggccgcatgggctcgcacgtggtcgaagcggtgaacaacgccgaggatacgcagctggcgctcgcattggatgccggcgacgacctgacccagatcaccaccgacaacaccgatgtggtcatcgaattcaccgtgccgcccgtcagcctgaacaacgtgctgaccctgatcggccaaggcgtggacgtggtggtcggcaccaccggctggaccgacgagaaactcgcccagatcaaatccgccatcgccaacggtccgaagcccgaaacccagaaggtcttcatcgcacctaacttcgcgatctccgccgtactggccgactactttgccaccaaggccgcgaaatacttcgaatccgccgaagtcatcgaactgcaccaccccaccaaggtggacgccccctccggcaccgccatccacaccgcccacggcatcgccgaagcgcgcaaggccgcaggactcgcccccgtgccggacgccaccgaaaccgatggcggctcacgcggccaggtggtcgacggcatccacgtgcacgccgtgcgtctgcgcggcctcaacgcccacgaggaagtgctcttcggcaatgccggcgagcagctgaccattcgggccgacagcttcgaccgcaccagcttcatgcccggcgtcctgcttgccgtgcgcaagctcgccggcgacgctccggccggcctgaccatcggcctcgaccacttcctcgacctgtaatcgacccgcagtcgaccagtagttgcccccgcatttcaggcagggaagcgcgccgggacgcgcatcacggcattgccaccggctccggccataatgccacgcattcagcaacaatcaaggtacgtagtataagagtccacaatgggaagtacggtaaacactatgagcgagcatgacatgcaccttcttgattcagcacctttcggccgcattctgccggctatggtcaccccgatgaaatccgacggcagcgtcgatttcgccgccgcgcagaagctcgccaaatacctcgtcgccgatggcgcggatggtctggtggtcaatggcaccaccggcgaatcgcccgtcacccatatggatgagaaggtcgagctggtcagggccgtcaaggaggtcgtcgacgttccggtgatttccggcgccggctccaacgacaccgcacacaccgtgcgtatggtcgaacagactcaggaagcgggtgccgacgcggtgctcgtcgtcatgccttactattcccgcccctcgcaggacggtatcgtcggccactacaaggccgtcgacgaatccgccgaaaagccgatcatcgtctacgatgttcccggccgtaccggcttgaaggtcaaggtcggaacctacgaccgactggccgaacttgaacacgtcaaggctgtcaaggacgccaccggcgatcttgcagccgcagtggagaagcagcagcgcaccggcctcgcctggtattccggcgatgacggcctgttcctgccgttcctctccatcggtgccgtcggcatcatttcggtgattgcccacgtcgcctccaaccccatgcagcagcttgtccaggcattcgatcgcggcgatatcaccaccgcccgtcgcctcgccaaccagctcgccccccttgtccacgcgttgaatggcgacggctatcaggccgtcatggccaaggctgcgctcaaggtcaagggcgttatcccctccaccaccatgcgtctgccgaacatcggtcccgacgccactcagcttgacaaggctgaagagggcatgcgcgctgccggactgctgtaagcccgaaacgctgcatacgggttgccagcccgccgcccctgcatgacagagcagaggcaccacaacagaaatcccaaaaaggttatggcacaagaacaaaagaaaacaagcaagaacacgaattctcgccgtcgcggttccgcgcgcggccgcaacgccaacggatccaacagccgtacgccgtcccgtaagatcaacgccacccggcaggccaccgcaccccagcaggatgccgtgctgatcgccccgccgaagtaccgcaagggctccatgcgcatcacgccgctcggcggcttgggtgaaatcggccgcaacatgaacgtgatcgaatacaacggtcacctgctgctcatcgactgcggcgtgctcttccccgaggaggagcagccgggcgtggatctcatcctgcccgatttcagctacatcaagaaccgtctcgacaaggtcgacgccctggtgctcacccacggccacgaggaccacatcggcggcgtgccctacctgctcaagctgcgcccggacatcccgctgatcggctccaagctgaccctcgccttcgtggacgccaagtgcaaggaacaccaccagaaccccaccaaggttgaggttgccggccgtgagaagctcaaggtgggtcccttcgacctcgaattcgtcaacgtcacccactccatcccggacgccctggccgtctatgtcaagaccccggccggctccctgatcgacacgggcgatatcaagctcgaccagctgccgctcgaccaccgcatcaccgacctcgtcgaattcggcaagatcggcgaaaagggcgtggacctgctgatgatggactccaccaacgccgaggtgcccggcttcgtcaagcccgagacctccatcggcccggcccttgaccaagcgttcgcccaggccacccgcaagatcatcgtcgccagcttctcctcccacgtgcaccgtgtgcagcaggtggtggacgccgcccacaagtacggccgcaaggtcgtgttcgtcggccgttcgatggtgcgcaacatgtccatcgccgccgacctcggctacctgcacatccccgaaggcaccgtcgtggacctgaagcaggccaacgacattcaggacgacaagctcgtcttcatgtgcaccggttcccagggcgaaccgatggccgcactcggccgcatcgccgacggcaaccaccgcgatatccacatcaacgagttcgacaccgtgattctcgccagctccctgattccaggcaatgagcacggcgtctacaaggtgatcaacaagctcgtgcagctcggcgccaaggtcgtcaaccgcgacaacgccgccgtgcacgtgtccggccactgcaacgagggcgagctgctgtacatgtacaacatcgtcaagcccaagtgcgccatgccgatccacggcgaaaaccgccatctggtggccaacggcctgatcgccgtcaagaccggcgtggacccgcagaacgtggtcttggccgaagacggcgatgtggtcgacctgtaccacggcagggccgcggtcgtcggctccgtgccgtgtggttacgtgtacgtcgatggcgattccgtcggcgagctgaccgatgacgagctggaaaagcgccgcattctcggcaccgagggcttcgtctccgcgttcgtggtggtcgacaccgacaatcacgaggtcgtcaccggcccgaagatctacctgaatgccgtggccgaggacgaaagcgagttcgacaaggttcgtcaccagatcgtcgaacagctcaacgaccagatgatgcagggcacgcgcgacacctacaagctgcagcagaccatgcgccgcacgctcggcagctgggttgcgcgccagctgcaccgcaagccgatgatcgtgcccgtcgtggccgacatcgcccaggacgtcgaaaccgtagaaaccaagtagtccggattatccagggacgaccgtaaggagtaattgaagtcatgcccggttctaatctcactcgtattgaagccgaagaacgtaaggccgttatcgaagcgccgattcactatcacgtcgaccttgacctgacggtcggcgcgaagaacttcggttccaagtcgttcatctgcttcaacgcgaagcctggttcgtcgaccttcctcgacctgatcgccgacgaagtgacctccatcgacctcaacggcaagtccctggacccggccgtggccttccaagacaaccgcatcgaactgaccgacctcaaggagaagaacgaggtcaccgtcgaagccaggtgccgttactccaacaccggcgagggcctgcaccgctcggtcgacccgtccgatggcaacatctacctgtactcccagttcgaggtgccggacgctcgccgcgtctacgccgtgttcgaccagcctgacctgaaggccaccttcgacttcaaggtgctcgctcccgccagctggatcgtcacctccaacatgccggttgccaccatcgaggacgatccgcgcgaaaccctcgacggcaccctcggcgacaagccgaacgaaagcacccgtctgtgggacttcgagccgaccccggtgatgagctcctacctgaccgccatctgcgccggcccgtacgccgaatggcacaccgaatacctgaacgaagacggccgtaccgtgccaatggcccagtactgccgacagtcgttggccaaggccttcgcgaaggacgtcgactacctgttcgacatcaccaagaagggcttcgcgttctacgccaagacctggggcgtgccctacccgtacgccaagttcgaccagatctacgtgcccgaatacaacgcgggcgccatggagaacatcggcatggtcaccatccgcgactcctacgtgttcgaatccaaggtgaccgacgcgctggccgagcgccgcgtggtgaccgtgctgcacgagcttgcgcacatgtggttcggcgactatgtgaccatgaagtggtggaacgacctgtggctcaacgagtccttcgctgaattcacctccacgctggccactgccgaagccaccgaatggcatgacgcttgggccactttctgctccggcgagaagagctgggcgctgcgccaggatcagctgcccaccacgcacccgatcgtcgcgccgatcaacgacctcaacgacacttacgtcaactttgacggcatcacctacgccaagggcgcctccgtgctgaagcagctggcattctacgtgggccgcacgcagttcttcgaaggtatccacaactacctgaaccgtcacgcctactccaacgccaccctggccgacctgctgagcgaactggaaaagacctccggccgcgatctcaaggcctggagcgccaagtggctggaggaatccggcatcaacacgatcgccactggcctgaccgtaaacgcggacggcaccatcgccgaactgaagctcacccagagcgcgccggccgaacacccggtgctgcgcccgcatcgcctggccgtcggcttctacaacgaagacgccgcaaccggcaagatcgtgcgcaccgagcagttcgaactcgatgtagatggcgaaaccaccatcgtcgaggccgcagccggcaagccgcgcccggcattcgtgctggtcaacgacgatgacctgacctacaccaagattcgtttcgacgccgaatcccaggcattcgccgaagccaacctgcatcgtttcgatgatgccctggcccgcgccgtgacctggctcgccttctgggatatgacccgtgacggcgaattcccggccgaacgcttcgtggacatgaccctgcgtcttctggccacggaaaccgaatccaccaccttccgttacgcgctggcctgcatgagcaccaccgcccaccactacgtggcgcccgcccgccgcgacgatgtgctgcgccacgtggccgccgaactgtggactctggccaacgccgccgaagccggctcggacacccagttccagctcgtcaccgcctacttgggctacggtgaggagggcgacgccgcattcgccgccaacgcacacggtctgctggacggcaccgtgcgtcttgaaggcctcgaaatcgacaacaacttcacgtggaccatcgtccaagcgctcacctccgtcaacgagatgaccaacgacgacgtggacgcgcagctcgccaagaaggagaccacggaaaaccgcgagttcgcctacggcgcccgtgcctccatggccaccgctgaggccaaggaatgggcttgggatcaggcgctccacaacgacgagctgaccaactcccagctcgaggccgtggcccgtggcttctccgccaccccgcgctccgatctggccgagccgttcgccgccaagtacttcgagactgtagactgggtctgggccaacaagacctaccacatggccgacgccctgctcaacggcctgtacccgggctacgccgatcccgccacgctggtcaagctcggtgacgcctggctggacgagcacattgccgccgacaatgccctgaagcgtctgatcgtcgaaaacgtggcatcctcccaccgcaccctcaaggttcgcgaatacaacgaagcgctctgatttccttctggctcccctcgggcgcgaggggagctgtcgcctcaggcgactgaggggagtcgcttccgcgagaagctacgtccacattccaacataaaacccgcaaccaatcctcaacagcgtattctcgctcaaggccggcaatgtgccggtcgatgagcgacaaggatacggggaatgattgcgggcttttccataacttcattactgctgattctgttggccggaatcggcgcaggattcgtgggctatgcggtaggcgcatcgtcactggtctcatacccggccttgctcgcgttcggcattccgcctgtattggcaaacgcttctaacaccgtcggcgtggtcggcacgggcatcggtggcgtgatgggtgcgcgcaaagaactcaaaggccaagcggtacgctccattacgtatgtggtcatcggcgcattcggcggggtggccggtgcgtttctgttgctcaaactcgacccgagtgtctttgaatttgccgcaccagtgctgattttgctgagctcgctgatcatcgccatcaatccgcgcggccgcatgcaggccaagcaagccgccgcggatgccaccgcgcaactcaagcacatcgaagccactgaagccactgaagccactgaagccactgaagccactgaagccactgaagccgctgaagccactgaagccgccaagcgcgcaaccacccctaccgcacctcaccgcccgccggaacaactcgtgcagcccatgagtcaggattcctggtgggtatggctgggcgtagcggcggtcgccatctactccggctacttcggcgcgggcgccggtaccttggctctcgccgtgcttgatgccgccaaaatcggcccattccacaagatcaatgcattgaaaaccctgatcggcacaggcgcgaacatcagcgcctcagtggtattcatcatccaaggcgcggtcgattggccggccgccatcatgctgtgcatcggatgcttcatcggcgggtacatcgccccgtccatcacccgcaagattcccgcaaacatcatgcgcgccgccgccgtaatcgccggcatcattcttaccatcgatctggggctcaaaacctattgattcgtgccttacactgatgcagtgaagcatacagcatggccgtcaaccgcagcgtggtcgcagaccccgataaggtggccaatgtctggcatttggcgactgcggaacctgagcgcctagaaaccagcgcggcaggcgaagcggtgaacgacttcctcgatccgccagacacgtcgcagattcacggcattgcgtgtcatgctgattggcggttcgcggcgcgagcaggtgctgttcgccggcgttatgaaggagctactcgcgcccatcaacaatccgcgatatgtcatcatcggtaaggaatggggcgtgcgcgcttactgcgtgagcttcccctgcccgtccgtatttgcccgccgccagcaggacgccgagatactgagccggcagttggaccgctgcctgacgcattgcaccatggtatacgcccgcactgaggaaggtcggcatacgctacttcgctgccaaacgcgttctttcctcaaccgcgacgagcaactgccgcacatactgaccacaacatcggagtaatagatcgttgcattcatggccgagaccaccccggtagaggagatgccgttgggcatgttcatcgcatggctcagcgtgttcctcgccgtcgttctgtttggtgttgctttgccggttatcgatgtacgctgggtagttccgttcgtcgtatttgccgctgtattgtttacaggcgcgtttgccggcccgttcttactagtgcgatggcttcgttcccgtgccggagtgcatcggtccgcccggcatgcccgctaacgaatgtatctcatcattcatccgccgaacaagatgaatatgcgggtttgtgggtgatgccattgcggctgttgaatgctgatttccggtcctagagcagattccgtggcggttttttgccgagtcgggtcctagggtggagcacaacgactacgatggtgcgggtaacgcgatacaaggagtggaacttcatatgccgaagatgtttggaaccgatggtgttcgaggactggccaatagggatttgactgcacgactggcgctcgacctgggcgacgccgccgtgcgtgtgctcggcgacgccggcacccaagacgatcagcctgaggggcgccgccgcgcgctcgtgggtcgtgacacccgtgtgtccggcgattttctggcttccgccctgtccgcgggcatggccgccggcggcttcgacgtgatcgacgcaggcatcatcccgaccccgggcatcgcgttcctgaccagcgtgctcaacgttgagatgggtgccgtgatttccgcctcccacaacccgatgcccgacaacggcatcaagttcttcgcacgcggcggcttcaagctgcccgaccagaaggaagacgacatcgaggccgtgctcggccaggactgggaccgcccgaccggtgccggcgtgggccgcgtgagccacgaccagaccaccgccaccaacctgtacatcgatcatctggtggccaccatcgctccgctgaacgatgacaaaacccagcccaagccgctcaagggactgaagatcgtggccgactgcgccaacggcgccacctccgtggtggctcccgaagccctgcgccgtgccggtgcggatgtaatcgtgatcaacgcctcgccggacggctacaacatcaacaagaacgccggttccacccaccccgagcagctgcaggccatggtcaaggccaccgatgccgtgatgggcgtggccttcgacggcgacgccgaccgttgtctcgccgtggacgaagacggcaacatgatcaacggcgaccagatcatgggcattctggcccgcgccaagcagcgcgaaggcaagctcaaccacgacaccctcgtggtcaccgtgatgagcaacctcggtctgaagctcgccctgaaagatatgggcatcaagaccgtggaaaccgccgtgggcgatcgttacgtgcttgaggaaatgctcaagggcgattactcgctcggcggcgagcagtccggccacgtgatcaaccgcgaattcgccaccaccggcgacggcaccctgaccgcactgaccctgtgcaacgaggtcgtcaagtccggcaagagcctgaaggagctcgccgccgacttcccgcagctgccgcagaccctcatcaacgtgccgaacgtggacaagaaggccgcctccaccaacaagcgcatccaggatgccgtggcccgtgaggaggaactgctgggagacaccggccgtgtgctgctgcgcccctccggcaccgaaccgctcgtgcgcgtgatggccgaggccgccacccaagcctacgccgacgaagtctgcacccgcctcgccaagatcgtcgccgaagaactcgcgctgtagcacccttccctaaggaaaaaaacaatgtttggaaagaacgccaaagtcgacctcgaactcaaccgtgatgtcgaacaactcatcaaaaccggcggcaaggagaagctcctgcccatcgtgcaggccggcgaaccggtgttgcgccaacggacagtggcctataatggccagctttccaagcgtacgctcgccaaactcatcgatacgatgcacaccaccatgctggaggcacccggcgtggggctcgccgccacccagatcggcttggggctcgcgctcgccgtggtcgaagaccacgtgcgcgacgacgaggatgatccgcgcgaaatcgcggaattccccttccacgtgatcatcaacccgagctacaaacccaccagcgacaaaaccgcctcgttctacgagggctgcctgagcttcgacggataccaagctgtgcgcaagcgttggctcgacatcaccgccgaatgggatgatgaagacggcaaacaccacagcgagccgctgcacggctggcccgcacgcatcttccagcacgaaaccgatcatttgagcggcgagttgtatatcgatcgcgccgaaatccgttcgctgaccaccaacgagaacctcgaggactactggtgcgaagacccggtgcccaccgaggccgctgaagagctcggtttcgcactatgaccgaccgtgcatggttcgacgccgccaagggagacattccccaatgggcggcgtccatgcccaaggacgccgatggcaccaccatcgactgggactgggtgcgttctctggacctggcgcatggcgtcggcacaataccggaatccaccccacagtccatccacgacgcattgaaggccgactacgccacacgcgagcatctggaatcaatcatcgcccaatgcaacagcacattcatgaccgattacgatcgattcatcggctcctatcgtctgcctcgcgcgctcgcctacgccaatcgtcggctcaacgacaacatcaacacgctgttgcatctgggcgaacagcaacacctatgggtggtcagtcgcgaacggcgggggaggactaccgttgccgtgctcaggccgtactccggcagccgcccatcgaacgatgaccaaggcatgctgaatctgagcggtgaaaccggtgacgcatctgccggaaacactgctgccgaaaacagcgatgtcaagttccccacaacagtcgccttggacgatatccaagaccgtacggcggcgattcttgacgcacgcgccgaacgacgtaaggcccagcgcttccagaagcgtgcgggcgatgcggcgatggcccgcgccaatctctccggcgcgacttcgccgggtggtgccgctctgccgggtggtgccgccgcgtctggcaacgctaccggacaccatcccaagcccgactggcgcgacgcctacctgcccggccgcgacgtggacgcggtgatgggcatcgacatcgaaaccaccggcatcgatccggcacgtgactacatcatcgacgtcggcttcgagttcatgaacatggccagtccgcgcccggccggcgaacccgagacatacgcctatgagcagggctattacgccgccggcgacgcctacggccagtcccgcctcgcttttggcgtgccgccggaaaacgcggcgctcggcaacgccctcatcgccaaactcaccggcatcgatgtacgcggccgcagcagcgaggccgggtaccgactcttcgacgaatggccccaagcccaggccggcctgctcgcgcggcttacccagcagccgtacgtggcgcataacgccaccttcgaacatagctggttcatgctgaacgtcgccggatacgcggaaagctaccgcgccgggcgcatcaccatcatcgataccctgccgatgagccggcagtgggaccccggcgcggtacccaccaacgagcatccttacggagacaacacgctcgacgcctacgccaaacgtcagggcgcgcttgattccgcccacaacgaacgccacttgggccttgaggattcgcacatcatgctggtggccatgaaacaccatctggcggcgctgaaagcgcaaaggaaagggccgtgggggtccaccggcagggcgggcgtcggcggcaagtcctgcggtcgtaagcggtgagtacactattggtctcgtgagtaactatcaggacagccgacagcagcgtgagaaccgccgccgcaccatcgtgcgtgtggtgtgcgtggtcatagctgtggccatgctcggctccctgatcatcccggcgatttacgcggggctttgacgttgccttcgcatattcgtgcccgcagttgaacacgtctgatgcgagggattcgtgaggtcgcccggccggctatcggcaaggcaggcccggaaccttctgacagcatggattgcaggcggatgcgcgtgtggcgcggcaatgcccgccaacgccagaggaatgtgcgaaggctgtcaacaaggacgtgacttcccaaagaatctcaaagaatcaacagtaaggtaaaccacgatggcagaatttgactttacccaggcgatcggcgaagcccgcgccaaatacgaatccatcgccaaggcgctggacgtcgaccgactcaaggccgatatcaaggatctcgaaacgcaggccgcggccccgggcctgtgggatgacccggaaaacgcccagaagatcaccagccggctgtccgccgcggaatcgcagctgaagcgtctgaactccgcctcccagcgcatcgacgatgtggaaacgctcgtcgaactcggccacgaggagggcgaccaggactctctggacgaggcgcaaagcgaaatcggcgagatccagaaggatctcgaccagatggagatccagaccctgcttgacggcgaatacgacgaacgttccgccgtggtgaccatccgctccggtgccggcggcgtcgacgcggccgacttcgcgcagatgctgctgcgcatgtacctgcgctactgcgagcgtaacggcttcaaggccaaggtcatggacacctcctacgccgaagaggccggcatcaagtccgccaccttccaggtggacgccccctacgcttacggccgactgtccgtggaaggcggcacccaccgtctggtgcgcatctccccgttcgacaaccagggccgccgccagaccagcttcgccgccgtggaagtggtgccgctggtcgaggccaccgatcacatcgacattccggatacggacatccgcgtggacacctactgctcctccggccccggcggccagggcgtgaacaccacgtactcggccgtgcgcatcacccaccttcccaccggcatcgtggtgaccatgcaggatgagcgttcgcagattcagaaccgcgcctccgccatggccgtgctccagtcccgactgctcgtgctgcgccacgaggaggaggccaagaagaagaaggagctcgccggcgacatcaaggccagctggggcgatcagatgcgctcctacgtgctgcacccctaccagatggtcaaggatttgcgcaccggctacgaaaccagccagacccaggccgtgttcgacggcgacatcaacgcgttcatcgaggccggcatccgctggcgccacgaacagcgccgcgccgccgaaaccgaggagtaaacagcattatggcactgatctcactggacaatgtgtccaagatctatcccaaaggcacccgaccggcgcttgacgacatcaacctcgatatcgaacgcggtgatttcgtgttccttgtgggtgcgtccggctccggcaagaccacgctcttgagcctgctgttgcgcgaggaagaggccaccaacggcgagattcgcgtggccggcaacgatctgcggcgcatcaccaaccgtcaagtgccgcagtaccgccgttcgctgggcttcgtgttccaggattacaagctgctcaataacaaaaccgtatgggagaacgtggcgttcgcccttgaggtgatcggcacacggcggtccaccatcaaatcgttggtgcccaaggtgctgaataccgtggggctcaccggcaaggaaaagaactatccgcatgagctctccggtggcgagcagcagcgtgtggccatcgcccgcgcctacgtgaaccacccgcagattctgctggccgacgagcccaccggcaacctcgacccgaccacttcgctgggcatcatggaagtgctggacgccatcaaccgcaccggcaccaccatcgtcatggccacgcataacgaagagatcgtcaactcgatgcgcaagcgcgtggtcgaactgcacaacggcaagatcgtgcgtgacgaggctcatggctcctacgattccgccctgttcttcccggatgccgaagtcgaagccaagtccgacaccgcccatcatgtgctggcggcggcgaccaaggccatcgagggcagtgacgagccgtccgaaggcatcgcccgtctggccaactccgtgcattccggccgcaccggccgctatggcgagacgttcgcgccgctggaagacacgctgacctggggcaagggcattccgttggatgagcaggccgccgccctggaaagcacccaggcgttcgacccgttcaaggacgagtccgccgcgaccgccgcggttgccgatacgtccgtgtcatccgccgccgagccaccggccccgccggagccgcccgcaccgccggaaccgcccgcaccgccggccaacgagcagtccgccgccgagcagcctgctgacgagcagtccgccgacgagcagtccgccgcagaccaaacatccgacgatcaacccgctgagggcgcgaaggagtaagggggatcatcatgcgagcacgattcattctgtccgaaacgtgggccaacctcacccgtaacctgtcgatgctgctgtcgctgacgctggtcaccttcatctcattcctgttcatcggcgcttcggtgcttactcaggcgcagatcaccaaagccaagggcgactggtacgacaaggtcgaggtcgtggtgtggctatgtcccgacggcaccagccagtccgcgaactgtgcttccggcaaatcgccctcagccaatgagatcacggcactgcagaaaaccattcgcgatgaactcaacgacgtggtctccaacatcgactatgtcagcaagcaggatttctacgacaacaccttcaccaagcagtacccgaacggtgaattccaaggccgtacgctgaccgcggacgatatgcaggactccctctggctcaagctcaaggaccccaccaaatatcaggtggtctccgaagtgctctctggcaaggagggtgtggaagacgttaccgatcagcgccagatcttcgacccggtgttcgccgtgctcaaccgagccacggcggttacggctgtgctcgccggcgtgatggtggtggtcgccatcctgctgaccggaaccaccattcgtatgtccgccgcatccagacgaaccgaaaccgaaatcatgaggtacgtgggtgcctcgaactggacgattcgtctgccgttcattctggagggcgccatcgcctcgctgatcggctcggtgctctcgtgcctgatgctttcggctatcgtcaacgtgttcgtcaccggctggctggcgaaatccgttacatggattccttatgtgaatcagctcacggtactggtgatatcgccgttcctggttgtgggcgcgatactgctgtccatcatcgcttcaaccatctcgttgcggcgttatttgagggcgtaacgcgaccggcttacccgcgagaaatgtgatgacatcatgtgcaagcctctcaggttcgcatgttatggtattggcttaagtgagcgaaaggactattcacatatgacgaacgtacgtgtgatcaagcccgcactggcggcactggtggccgccgcagcctgtgtgggaggtctggcgttcagctcggcacagcctgcccaggcagacacctattccgacctgatcaatgcgcagaaccagcacgccgcgtcggtacagcgcgaggccgaactcaagcagcagctggccggtgccagccaggacctggcgaataaggtacttgagctggacgatctgaccaacaacaagattgtcgccgcgcaggccaaggtcacacaggccaacgaggatgccgccaccgctcaggacgaggccgatgccgcatccggacgtctttccgccgcgcagaaagacaaggagacgcttgaggagcagatcaagcagaccggcaaggactacgatgacgcgcacgccgccgtggcccagctggcccgtgacgagatgcacggctcgaatgcttccgacgtgatgagcgtggtgacgggtgccaccagcacacaggacttcgtcaactccatgcagtcccgggacgcgttgtcccgcaacgaggcgaatgcggcttcctccgccgcgacctcactgagcacgtcgaagaaccgtggcgagcgcttggcggccatcgaaaagcagatcgctgtgctcaagacccagtccgatgagaaggccgcttccgcacagaccgccgccgaaaccgcgcaaagcgaacgtgacgctttggacaagctacgccaggagggtgagacgcggcgcaacgaactgtcctccatggtcgacagtctggattcccaatccgccaagcaggcggcccagaccgtactgatcgcctcccaggtcgattcctacaatcgtcagttccagaaggagcagcaggacgccgccaaccgggtggataccggtaaccagggcggcacgccgtccactccggtgacccccgctccggcgcccgctccggctccggcgccggctccggctcccgctcccgcccccgcccccagcgtcggcggccaaggcacgtcgaacggcgactatggcaacgcctatgccgccggccagtgcacgtactgggcgtatgaacgtcgcaggcagatgggcatcggcacgccgtcctatctgggcaatggcggcttctggtggcgcagcgcccccgcgtacggcctgcgcgtggaccacacgccgcaggtcggcgccgcactctccttcctgcccggccaggatggcgccgacggcacctatggccatgttgccgtagtcgaagccgtgtatggcgacggcacattccagatctccgaaatgaactggggtggtccgtggaacatgcactaccgcaccttgaccaatttgggtcagtactggttcgtccactgaccggttggttcggccgatatatgcggttgaagggttcctcttgaagaggaacccttttcgtattcgaggccggtccgtgatatcgtcggatgttgcgttgctacccacgagttgctacccacgagttgctactcacgagttattgcccacgaaaggaggagacatgcccaaggaaaccggtgagaaactcatcgtccagaacaagaaggcccggcatgactatgccatcgaagacaagtacgaggcagggctggccctgaccggcaccgaggtcaagtcgttgcgcgaaggccgcgcatcgctgtccgaggcgttcatctccatcgaccgccgtggcgagatgtggctggagggcgcgaacatccccgaatacctgaacggcacatggaacaaccatgcgcccaagcgcaagcgcaagctgctgctgcaccgattgcagatcaccaagctcgcccgcggcatcgaggccaagggatacacgattgtgccgctgagcctgtacttcaaggacggtcgcgtcaaggcggagatcgcactggcccgaggcaagaaggaattcgacaaacgccaggccctgcgcgaagagcaggacaagcgtgaagccctacgcgccatgcgctacgccaacatgcgccactagtcccgccccttggctcccctccggaggggagccaagagtaggatgtccacgttgtgggccatttcgcccacgattaacgcttccgtagcattgcactcctacgctctggaaccatctgggaaacatacccgcccagctgactatccggagagaggaaatccaatgtctctaagcaagggaatacaatccgctgcggccgccgccctgagcgcggccatgctgatcgccgtggcggcctgtggcacgactgacggcaccgacaccgcatccaagagcggcgattcatccaaggactcgtccagcacttcgattcaaggcttcgacaccagcagcatccagaaggacgacgagattgccgcactgctgcccgattccgtggccggcgacggcacgctgaccgtcggcaccgatacttcctatgccccggccgagttcctggccgaggacggcaagaccccggtcggctttgatgtcgacctgtccaaggcgctggccgcagtgttcggactgaaggaaaacaccgtctcctccacgttcgattcgattatcccgtccgtcggctccaagtacgacatcggcatctcctccttcaccgtgaccaaggaacgcatggaggctgtggacttcgtgacctacttcaaggccggttccacgttcgtggtgcagaagggcaacccgaacaaggtcgactcctcgaacctgtgcggcgtgaaggtggctgtgcagaccggtaccactcaggaagaggaagtcaacaaggccaacgagcagtgcaaggcggacggtaaggatgccatcgacatccagtcctccaagctgcagaccgatgtgactaccgccgtggcttccggtaaggctgatatcttctacgccgatacgccggttgccggctacgccatcaagcagaccggtgatacgctcgaggccctcggcgaggacgttggtgtgacccctgaggccgtggccgtcaagaagggcgattccaagaccgccgaggccgtacagaaggccatccagaagctgatggatgatggcacgtacaagaagatcctcgacacgtggggcgtctcttccggcgccgtcgacaaggccgagatcaacccgtccgtcgagtagtttcggttactatgaagactcccgttgccctgcggcgggagtctttttgtatatgtatgcactgtagtgtataaatatgcttaaccgttgatcgttgccgttgaagcggcgtaagagagaagaagaaacgattatgcagtccaccaaactgaagtccattatggccattgcactgagctcggccatgctgttcgccaccgccgcttgcggcacctccgacaaggccgatgccggtacggattccgccaagggctccgatgccgccaccatcaccagctacgatgtcagctccgtggagaaggatgacaccatcgccgcactgctgcctgaatccgtgaccaaggacggcaagctcaccatcggcaccaacccctcctacgccccggccgaattcctcgacgccgacggcaagacccagatcggctacgacatggatctcgcccgcgccatgggcaacatcttcggtctcgagaccgaaatcgtctcctccaacttcgatacgatcattccggccatcggctccaagtacgatctgggcatcgccgccttcaccatcaccaaggagcgcatggaatccgtcgacttcgtctcctacttcaccgcaggcatgggctatgcagtggccacaggcaaccccaagaacgtcgacgagaacgacctgtgcggtctgaacgttgccgtcgagaccggcaccgtcgaggaagaggccatcaacaagaccgccaagcagtgcaaggcggacggcaagaaagacatcaccatccagtcctccaagcagcagaccgacgccaccaccgctgtggtgaccggcaaggccgacgtcttcttcgccgattccccggttgtcggctacgccatcgcccagaccgatggtcagctggaacagctcggcaaggacttcgatgaagtgccgaacgccatcgccatcaagaagggcgattcccagaccgccgaagccgtgcagaaggccatgcaaaagctcatggacgacggcacctacaccaagatcctccagcactggggcgtcgaatccggcgcactggacaaggccgaaatcaacccggccgtcgaatagtcgacaagctgtcgcgaaaattcgaatggggcgcactgtttgtaacacagtcgccccattcgtgcactaaggttcaatgctagttgcaacttgcagttcaggctgcccaacacatccaaggaaccagattatggcgaagaaagaagtcgacggtgaggggctgaacatccccaatcgcatcaaggcgctgccggtcaagcgccccggcccgattgtggccgcagtgatcgtggtactgctcgccgcgatgctcattcaaggcttgattaccaatccgcgactggattggcccaccgtctggaagtacctgttcaacgagaacgtgcttgaaggcattcgctataccttggagctcaccgtgatctccatggtcgtggcgatcatcctgtcggtgattcttgccatcatgcgcaaatccatcaatccggtgctgcgcggcgtcagctggttcttcatctggttcttccgcggcacgcctgtgtacacgcagctcattttctggggtctgttcgccgtgctgattcccaagatcagcctcggcattccgttcacctcggtggagttctggagcatcgactccaacgtggtggtcaccgcattcaacgccgcatggattggtctggccctgaacgaggccgcctacctgtccgaaatcgtgcgtgccggccttgaagccgtggaccccggccagaccgaggcggccaaggcgctgggcatgaaccgcacgctcatcatgcgccgcatcgtgctgccgcaggccatgcgcatcatcatcccgcccaccggcaacgagaccatcggcatgctgaagaccacctcgctggtcaccgccgtgccgttcaccctcgaactgcagttcgccaccaacgccatcgccaaccgtatctacaagccgattccgctgcttctcgtggcctgcttctggtacctgctgatcacctccattctgatggttgtgcagtcccgcctcgaggcgcacttcggcaagggcttcgatgcccgaccggtgggcaccaagggcaagcagacgccattgccgggtaagaccgacggtgaaccgaaggatgacgtggacaagctcaaccagaccacatttgtcggattgaatgcataaggcgggagcgcgattatgactacgaatgacatcaccagtgttgccccggtcgtgcgcaaggcggctgacggttccgtgattcctgctgtcgaggccgtgcaggtgcacaaggcgtttgggccgctgcatgtgctcaagggcatcgatctaaccgttatgcccggtactgtgaccgtgattctggggccctccggttccggcaagtccacgttcctgcgtctgatcaaccagctggaaaccctgaccggcggttccatcgaggtggacggcgaactcatcggctacaagcacgtgaccaaaaacggccaggacatgctgcagaccctggacgataaggagatcgccgcacagcgctctcgcctcggcatggtgttccagcgcttcaacctgttcccgcacatgaccgcgctggaaaacgtgatggaagccccgatccacgtgcagcaccagtccaagaaagccgcctgtgacctggccgtggccgagcttcagcgcgtcggtctgggcgatcgcatggactattacccctcccagctgtcgggtggtcagcagcagcgcgtggccattgcccgtgctctggccatgaagccggagatcatgctcttcgatgagccgacctcagcccttgaccccgaactggtgggcgaggtgctcaacgtcatgcgttccttggccaaggaaggcatgaccatggtgtgcgtgacccacgaaatcggcttcgcccgcgaagtcgccgaccagatcgtgttcatggacggcggcgtagtcgtagaaaagggcggccccgacatcatcgaccaccccaccgagcctaggtttaaggacttcctacagcacgtgctgtaggaaggctgttatattacctcagcactgtcgtgcttcggcgtcgcctacggggagcccactgggctccccgctttacggctccgcctacagcacgtgctgtaggaaggctcgttgttgcagctccaaaagcgtacgctgatgaactcagcgtacgcttttcacgaaggggcatgttccaatcctgcaaaggcggcgggttggattcgctttgcgcaataatcgtccgctaggctggtgagccatgtgtggaatcgttggatacgcgggaaatattgaaacggcatgcggcaagcctttggaggtttgcctgcaaggcctggaacgtctggaataccgaggctatgactcggccggtgtggcgctgaccgcgcccggcatggataaggtggtcgtgcgcaagaaggccggccgtttgaagaacctggtcgaagacatcgagcgcaagccgatgccgctcgccacggtgggcatcggccacacgcgctgggccaccaatggcgagccgagcgacgtgaatgcccacccgcacaccagcatggacggcaaggtggccatcatccataacggcatcatcgaaaacgcctctcagctgcgtctcgacctgcaagccgaaggctaccgattcgcctccgccaccgacactgaggtggccgctaagctgctcggcaagatcgtggacaagattatcgcggacgaaggcaagccagacttgttcaaggctgtgcgccgtatggcccgcatgcttgaaggcgcgttcaccattctggccaccgactgccgccagccggacatcgtggtcggagcccgccatgattcgccactggtcgtgggccttgacgagggggagaacttcctcggttccgacgtcgccgcattcgtggcctacaccaagcgcgccatggaagtcgaccaggatcaggccgtatgcgtgtccgccgacaaggtcatcgtcgccgatttcaacggcaacgtggtcgaaaacccgaagacctacaccgtggattgggatgcttcggccgccgaaaagggcggctgggattcctttatggacaaggagattcacgaagaccctgccgcagtgcagcgcaccctgcttggccgcttcgacacgaatggcgacatcacccttgatgaagtgcgtatcgacgaacacgacttcaagtccatcgacaaaatcatcgtcgtggcctgtggcaccgccagctacgccggccaggtagccaaatacgccatcgaacactgggtgcgtatccccgtggaaatcgaactcgcgcacgaattccgttaccgtgacccgattctgaccccgcgtacgctcgtggtggccatttctcagtccggcgaaaccatggatacgctgatggccctgcgccacgcgcgcgaacaggggtccaaggtgctggccatctgcaacacgcagggtgcctccattccgcgcgaatccgacgccgtgctctacacacacgccggcccggaagttgccgtggcatccaccaaggcgttcgtggcgcagattaccgccgcctacctgctgggcctgtatctggcgcaggtcaagggcgcgatgttccgcgatgagattcatcagatgctcgactccctgaaagacatgccgcgcaagattcagtgggtgctcgacacccagcccaagaccatccaggcggccgccgagcgcatggtgaacgccaactccttcttgttcctcggccgccacgtgggctacccggtggcgcttgagggcgcgttgaagctcaaggaaatcgcctacacgttcaccgagggcttcgcggccggcgagctcaagcatggaccgatcgcgctggtggacgagggtgagcccgtggtgttcatcgtgccgccgcagcgcggccgcaatgtgttgcacgccaaggtgatctctggtatcgaggaggtcaaggctcgtggcgcgtacatcatcgccgtggccgagcagggcgacccggatgtggaacggtacgctgacgtggtgttctggcgccccgcctgcccaacgctgatgagcccgctggttgacgtggtgccgctgcagctgttcgccatggacatggcaaagctcaagggctacgacgtggacaagccccgcaacctcgccaagtccgtgaccgttgagtaagccacatcggtatgtgattgacgagcctcatattccgtttgagatggacgtgctgtatgaggacgagcggatcatcgtggtggacaagccgcattttctggccaccatgccacgcggcatgtggtatcggcagaccgcgctgatccgattgcgtgagcggctgggggagccggacatcacgccagcgcaccgattggaccgcatgaccgccggcgtattggtgttcgtgcgggattcggcctgccgcggcgcgtatcagatgctgttccagaaccggcaggccgtcaagatctatgaatgcctggcaccctgccggccgatcagcggcccgcgattcggcacgatcatgcaggtcgaaccgccacgcccgttcccattgctgcgccgatcgcacatcaccaaggaacacggcacgatggccgcattcgaggaaccgggtttggccaacgccgaaaccctcatcgagcgcggcgacctctgtttccctcccgctggcgggaggtggcgcgaagcgccggagggtggtccccatccgggaaatcaccccatctgccgctacacactccacccgcgcaccggcaaaacccaccaattgcgcgtccacatgaattcgctcggcctgcccatcgtgggcgacgacttctacccgcgcatccagacacgcccctacgacgatttcagccagccgctgcaattagtggcgcgtgtgctacgattcaccgatccaataacaggcgagaagcgcgaattcgtttcccgtgtgccgcttaagatctgatttcttaggggggatggcgagaccaatccccgcccgtccgaatcactgtccctttcgactggccatccagctcattgcatcgtcgtacaccatcatgatgcgcttgcgatagctatcgatgaattcctgcgcaccaatgctcgcgataacgtcgtgagcgggttgcacggtgctgtcgaatgcctccggcagcctatccaccaaggtgtggaatcgtaaaatcacggattcctcatctaatcccatccgctgtgcgaatcgttccagatgtttgcggcgcaatcgaagaagatctcggcgtccgccgatgttcatcgccaaagtggcatttatgatctgcttgccatgccccaaataagggaacaccgaagcaaggtcatagagcggggcaagccgcacggacgcgccatcgagcaatagcgagtagttcttggcgtggctgtctgttgccccgacgagataactggcgaggatgccgtcggtgaaggctcggatattgctttcggcctgaccgggcagaccgtgcttgcgcaacatttccgcatatgcattggacgttgggccgttgtgttcctcgtatttcagcgatgagggaatgcccagcgcttgggtaaagtcttcttggtgcagggccgtcaccgtaccattggcggacactatacggtcataccgctcgctgatgatggctgggaccccatcaaagatgtgaaaagaggtgtgggccacgggtattcccatcgcctccacaatgcgcatggtgatgtgttcgttgaatgcttggtgtggaagggtcggtatgccgggcttgatgatatgagtcgtccgcgcgattccagtggtggagaaccatgatccattgcggttcctcagtgcgatcttgccctgctgtcccgcgaccgaccaatgctcgtctacgcttgcggactggatgcctgtgggggcggctgcgcgtagtcgattcgcgatctgcgaatcgctgattggaataagcgaatcgtcatctatgggcaagtgcgggtcggcggacagccgtaatgcgccggtggcatcgaatccgatggcttgcaacagatcaaatgcgcttgtcgatcgggcatgatgcaatcgcatggcttcatctcgggcctgaggggattccgggaccagggcctcaaggaaattacgcgggatgtcgcctgaatattcggctgcggtaatgggcatggaaagcgatattggtgtgggtgattgcgaccaacgataggaatcgtgatattggaaaataatgctgccatcgtttgttcttcgaaactggccgatgggtgtttcgccgagaaatgcattgagagtgttttcgctcatggtgtcaccattcatagagttcggcgggctgcggggttttgcggacatccagcgacaagccaagctcagtcagagcgctgagaatggtggagaatccgggattggggactcgggcgtgttcaaattcgatcagccagcgacgtgacacgcccagccgttgggccatgtcggtctgactgatgccctggcgttgcctttcatccttgataagccgcgcgtattcggcgatatccatgacaatcatgtgcaaaatatatcacagtatagtaaagtgtgcaatattctgcacatagttggaaatgtgcagaatattgcacaaccgagtcgattggtcggtgcggaattgcctatggatcactggcaggtgaatcactgacaggtaccagtggatgccagcacatgccgctcgtcagctgatgtcgcgcacggaaccgcgttcgatcagttccggcgggattacggttttgacgccgaccggtatcttctcgccttcgcattgacggcggaccatggagaaggcggtggcgccaatgtcgtcaaagcgcagcttcatggtcgtcaggttcaagcgcggaaccatatctaccagcgaatcatcgacgcccacgatgctgacatcctcgggcacgcgcttgcccgctgactgcaacccgagcattgcgccgtatgccatttggtcgttggcggcgtagatggccgtgcagtcggggtcgtgggccaacgccacgccggcctggtagcctgaatccgcgcaccaatcgccgatgtacatgctcggtacgcgtgctcccatttgttccaacgcttctcgccaaccgcgggcgcggctttcggcggcgcgcgaggtggacggtccggcaatgtggtagacggtcttgtgccccttgctcatcaggtaatcgacgatagcggtcgagcagccatactggtcggcgtcaacggtggggcagtggtcggcggcggattcgcagatgagcacgactggaaattctcgcggaggcttgtatccgacgaaatcggagatgcgttcctccagcactacgatgacaccatccaccggctgacgctgcatgcgatcgatggcggcggaaagcgtgcgttccgcaccgtggcgcatggtctggatggtgactgaataatcgtcatcggccgcgttggccacaatagaatcaaggatgcgggcgttgccgaacgtggcggtgttgaacatcaccacgccgatatcctggaagcggccgtgctttagggctcgggccgcataattcggacgatacccaaggcgttccattgcagcttcgacacgctggcgtgtttcgggtttcaccgcatcgctgccattcgccacgcgggacactgtctgtggcgaaacgccggcggctttcgctatgtcttgcatggacacctgtgttggcctcgacatttcaccctcgcttgactcattaatgtcggtgtttcgtttgcagcgcttatcttagggccgcttacggtaacgataacatcgttgtcttcgtgaccattgtagcagagtgactgagaaacccttaattcaacacggtactcaacacgattggacaatgttacaaatggtgttatgatgataacgcaaacattttggtcaaccttcgaaggagaggggttgggaatggcttcagccgatatcgcagctgcgcccgtgcattcgggcaaggctcgtgtgaataagcacaaggccgattggcgtggatggaaattcatgtggccttttgcggtggtgttcgtgttcgtgttcatcgtgccgatcgtgtacgccgtttatatttcgttcttcaagaagcagatgatcggcggcaccaagttcgtcggcttcgagaactacgcgcgcctgttgggtgatggccagttctggagcagtgttggtcgtgtggccctgttcacgtgcgtgcaggtgccgatcatgctgtgcctgtcggctttgatggccctggcgttggattcgatgaagctgcatggcacgaggttcttccgtatctcgacgttcctgccctacgcggtgccggcggtggtgtcgacgttgatctggggtttcgtgtatggcgcgaagtacggcctggtgggttcgttgaacgatttcctgggtacggacatcgacgtgctcgcccccagcgtgttgttggccagtatcgggaacatcgtgacgtgggagttcacgggctacaacatgctcatcttctacagctcgctgtcgaccatcccgcattccctgtacgaggcggccagcatcgacggcgcgtcggagtggcagatcgtgaagagcatcaagcttcccgaattgcgcggcagcctggcgatcacggtgatcttcagcatcatcggctcgttccagctgttcaacgagccgagcattttgcagaacatggttcctggtaatgcgatcacgacgtattacacgccgaacatgtacgcgtacaacctgagcttctccggcaaccagtcgaactacgcggccgcgttggcgatcgtgatggccgtgatcaccatggccatcgcctacatcgtccagttgaacagcctgaaggagcagatgaagtgacgatgaccgctgttcgtgttgaggaatcgatgatgatcgtgaaggagcgtatgtgatgagtgcagcaacgacttcggccgccggtcgcctgaccgacggcgagctcaaggcccgggagaaggccgccaggaaggcggagaaggcccgccagaagaggatcgccgccgacgaggccgccgaacgcaggcgcagcgcgaaggcggggttcgcgaacgtgaacaacccgaggcgttccacgttgttgaccgtcctgtgcgcggtcttcgccgtgtactgcctgttcccgttcgtctaccttttgatcaacgcgacgaagacgcaggccgacttcaccagtacgttcggcctgggcttcggcaagacgttcgccctgttcgacaacatcgcgaccgtgttcacataccaggacggcatcttcgggcgctggctgctcaacacgctcctgtacgtggtggtcggcgccggcggcgcgacactgctggccatcatgggcggctacgctctggccaagttccgcttcccggggcgcaaagcggtgttcgcggtcatcatcggcgcgatcagcgtgccgggcatcgctttggcggttccccagttcctcctgttcgccaaattgggcctgacgaacaccccgtgggccatgatcatcccgtcgctgatcagcccgttcggtttgtacctgatgtggatcttcagcgagcaggccgtgccccaggagctgctggaggcggcgcgcgtggacggcgcgtccgagttccgcacgttctggcagatttccttgcccctgttggctccgggcatcgttacgacggccctgttcacgatcgtggcgacgtggaacaactacttcctgccgttgatcatgctcaaggacgcggactggtacccgctgaccatcggcctgaaccagtggaaggaccaggcctcgaccgcgggcggccaggcgatccagaacctggtgatcacgggctccctgatcacgatcatccccctggtgatcgcgttcctgtgcctgcagaagtactggcagtccggactcgccgcaggcgccgtcaaggagtgatggagtcggctccgccgacgcggtgtcttcaccgcctcgcggcggggtctctccctccgtcccggctccgccgagacaaccttcctcatcagagggaggtaatagtgccaagccccccctctgacgagctgagccgttaggcaaacagccctgtgggctgtttattcccgcggacgcagattatcgataaaattcaataaaggagctgaatcatcatggaacgtaaagagttcaagtggccgcagccgcttgcgggcaacaagccccgcatctggtacggcggcgattacaaccccgaccaatggcctgaggaagtgtgggacgaagatgtagccctcatgcagcaggccggcgtcaacctcgtctccgtagccatcttctcctgggccaagcttgagcccgaagaaggcgtgtacgacttcgattggctcgatcgcgtcatcgacaagctcggcaaggccggcatcgccgtcgatctcgcctccggcaccgcatccccgccgatgtggatgacccaggcccacccggagatcctctgggtcgactaccgcggcgacgtctgccagcccggtgcccgccagcactggcgcgccaccagcccggtcttccttgactacgcgctcaacctgtgccgcaagatggccgagcactacaaggacaacccctatgtggtctcttggcatgtgagcaacgagtacggctgccacaaccgcttcgactattccgaagacgccgagcgcgccttccagaagtggtgcgagaagaagtacggcaccatcgacgctgtcaacgacgcctggggcaccgccttctgggcgcagcgcatgaacaatttctccgagatcatcccgccgcgcttcatcggcgatggcaacttcatgaatccgggcaaactgcttgactggaagcgcttcagctccgacgccctgctcgacttttacaaggccgagcgcgacgccctgctcgagatcgcccccaagccgcagaccaccaacttcatggtctccgccggcggtaccggcatcgattacgacaagtggggttacgacgtggacttcgtgtccaacgatcactacttcacgcctggcgaagcccacttcgacgagctggcttactcggcctccctgtgcgacggcatcgcccgcaagaatccgtggttcctcatggagcactccagctccgccgtcaattggcgcccaatcaactatcgcgtcgaacccggcgaattggtgcgcgactccctagcccacttggccatgggctccgacgccatctgctacttccagtggcgccagtccaaggccggtgccgagaagtggcactcttcgatggttcctcacgcgggccccgactcccagatcttccgcgatgtgtgcgagctgggtgccgacctcaacaagcttgctgacgagggcctgctgagcaccaagctggtcaagtccaaggtcgccgtcgtcttcgattacgagtcccagtgggctacggaacacaccgccacgcctactcaggaggtgcgccattggaccgagccgctcgcgtggttccgcgcgctggcggacaacggtctcaccgccgacgtggtgccggttcgcggctcctgggacgagtacgaagccgtcgtgctgccgagcctgaccatcctgtccgaagagaccacgcgccgcgtgcgcgagtatgtggcgaacggcggcaagctgttcgtgacctactacaccggtctggtggacgacaaggatcacgtctggctgggtggctaccccggttccatccgtgacgtggtgggcgtgcgcgttgaggaattcgccccgatgggaaacgacttccccggtgccatggaccaccttgacttggacaacggaaccgtggcgcacgatttcgccgacgtgatcacttccgtggccgataccgctcacgtggtcgcctccttcaaggcagataagtggaccggtttcgacggcgctcccgccatcaccgtcaacgacttcggcgacggcaaggccgcatacgttggtgcccgtctcggccgtgagggcttggccaagagcctgcccgcgctgctggaggaactcggcatcgagacttcggctgaggacgatcgcggtgaagtgctgcgcgtcgagcgtgcggacgaaactggcgagaaccacttcgtgttcctgttcaaccgcacccacgatgttgcggtcgtggacgtggaaggtgaaccgttggtcgcctcgctggcccaggtcaacgagtccgagcgcacggccgccatccagcccaacggcgtactcgtcgtcaagctgtaaaaccgcgcatagcgcctaattactcaacggctctcttgctgctcatcgcagcaggggagtcgttttcgtatctccagcaaagtcgggtagggtggtcaccgtgcgaggcaaaaacagagtgacgatggcggacgtggcccatgaggccggtgtttcggtagcctcggtgtctaattttctgaacaaacagccatatatgagcgaggcgatggccgcgcgtattgcggaagccatcgacaggctcggatacaaagtcaactcgtcggccagaaacctgcgttccgggcgtacccggttgctcaagctggttattcccgatctgcggcaggtgtacttctccgaactcgccgaggatattctggccgaggcccggcaacatggctacggcgtcatcgtggaatccaccactaacaatcgtgcccgcgagctggaaagcatcgcatcgatgggcacgcacagcgcggacgggctcatcttaagccctctgatgatgacggttgacgatatcgcggctttggatggcgattacccgctcgtactgttgggtgaacgtttgttcggcgtcaacgcgccgcacgtagtgattcgcaatcgcgaaggggccgccgccgcgacttatcacctgcttgatgccggttgccgccgcatcgccgtagtcggtgccgtgccccaccccgagcacgatttctcgtcgggctccatccgcacccacggatatcgtgaggcgctggccgcgcgcggcatcccctgtgatgacagtctgcttatcgaaacccaaggctgggggagcgccgacggtttggtcgcggtggacaccatgctggagagtggcctgcaattcgatgccgtgttcgctttgaatgacttgctggcgtggggcgtgctgcgtgaactgcgcgaacgcggcgttgccgtgccggatgatgttcgcgttatcggcttcgatgacgtggaggaatcggcctacatggtgccgtctctttccaccgttaaccccggcagggaagccatcgcccgactggccgtcgaatccatcatccaacaggtcgaatccggcagtcgcgctcctgcccaaaccatcgaggccccctatagcctctccctgcgcgagtcctcaccggcgttggcctgcgcctgatgaatccatggttcgaaatatccgaagtgaatgacaaggcccgtcaatcgtatggtgattgacgggccctggtcgtattggacttgactgtacttggtacgggcgtgactctccgtcttttagccgtggaattccacgctgatccaggagatggcgggaagcgttgccgtgcaggtgccggtggcgttcatcgcaatgccgagcggttgcggcgtgacggcttcgggcgcttcggcggtgttggtgcggtacggatcgtcctcatgcaacagttgcgccttgctgagcgcgagcgtgccgagaccgggcaggccgggcagcccggaaaggtcgatggtgagcgtgtgcggggtgttggcgtcgcggttgacggcaagcagcagaccggtgcgggcctgttcatcccacgtgactaccgcgtcgatggccggcacgtcgccatatgcctcggtatggatggtgggggagctgatggccggagcgtaggcctggccgcgcgcgtgaagggcggcttcggcgaacgggtagaacgtggtctgccgccatgccgggccgtgttcctcggccatgatgggggcgatgacgttgaccagctgggcgcgcgaggcggaacgcacgcgatcgcagtgcttgagcagggtgatcatcagggaaccttcgaccaccgcgtcggccgcggtgtagatgtcttccagcaaatgtggagacttgggccatggctcgtggtgcaaaccctgcgcggcctccgccttccactggtcttcctgctcgttccacttgtccgaataccatacgccccattcgtcgaaggacagggcgatgtctttggtgccgttgttggcttctcgcgcctgatcggccgcgtccgagacggtggcgatgaacttggtcatgtcttcggaagaggccaggaagtcctgcatggaggcggcggtccgggttttatggccgcggtcgaagtagtaggcatggcaggagacgaagtcgagattctcgtaagccttggtgagcacggtcttctcccacgtgccgaaggtcggcatataggcacccgaggaaccgcaggccacgagttcgagaccggactcggcgagcttcatggcgtgggccaccttatccaccgcgccggcatattcttccgggctcatgtggcccacctgccacgggccgtccatttcgttgccgatgcaccacatcttgatatccatcggctcctcgatgccgttggccacgcgctgatccgcccaagcggtgccgggcgcgccgttgacatactcgagctcgtcgagcgcggctttcagcccccgggtgcccatgttgacggcaagcatgatttcggtgccggctttctggctccagcggtagaagtcgtcgatgcccatctcgttggtttcggtgcaatgccaggccaggtcgcggcgcacggggcgattctcgcgtggaccgatgccgtcttcccagttgtagttggatacgaaattgccgccggggtagcgcacgcaggtgacgcccagctccttgaccaggtcaagcacgtcttggcggaagccgttttcgtcggcggtgggatggctgggctcgtagatgccgccgtagacgcagcggcccagatgttctacgaatgagccgaacagacgcgggggaacgtcggctaccggagtggcgtcggcgttgagggcgatgctggcgtccggcgtggttgcgttgccggttgtggagacgttactggccgtggtgccggcggcggtcggcgccgggctgctttcctgcttgtcgggatgggtggtttcggcggaatactggctgttgtgagtggtcatgagcgggatgcatctccttcggtttgcggttagtcaccatggtgcgacgtgtcgtgtttgcgtaaacataaaacatgtggtaccgtttcttaaaacgatacaatacttggaacaaaacgccaagtcccgtcgtttcccataacaaggaaggaaagaacgatgaagttcggcaagaagacaattgccctgattggtgctgtggccatgctctcctctgtagctgcctgcggttccacctctgccggggatagcggaagcaccggctcctctgataagaagatcgagctgaccgtgtggtcctgggattccacactgcctcgtacggtcaagggattcgaggccaagaacccgaacattaaggtgaaggtgaccaatgccggcaccaacaaggacgagtacaacgcactgtccaacgccatcgaggccggctccggtgctccggacatcgcccagatcgaatactacgcactgcccgaatacgtgattcgcggccacctcgagaacctctccgatctcggcgcctccgatttcaaggacttctacaccccgggcacgtggtcctcggtgagcatcaatgacggcgtctacgccctgccgatggattccggcccgatggcctggttctacaacaaggacgtcttcgacaaggccggcgtcgatccgacccaggtgcgcacgtgggacgacttctacgaggctgccaagaagattcgcgccgtggactcctacatcacctccgattccggtgacgccggcttcttcgactccatgacctggctggccggcgcgaccccgttcgagacctccaaggacggcgagaccgtgaccatcaacctgaccggtgacaagaacgtcaagaccttcaccgacttctggcagaagatgatcgacgaagacctcatcgacaccaagaccgtcggctggaccgacgattggaacaagggtctggatgacggctccatcgcatccctgctgaccggcgcttggatgccgtacaacctgctttccggcgctccgaacggtgacggcaagtggcgcatcgcccagatgccgaccgcagacggctccgagaccaactccgagaacggtggttcctcgctggtcatcgtgaagtccgacgacaaggccaaggtcgccgccgcctacaagttcatggaatacgcctgccacgacgccgagggcattaagacccgtgttgacggcggtgccttcccggccgacaacgacaccctcaagtccaacgacttcctcaacatgacctccctgaccgactccgacggcaaggcccacgagtacttcggcggtcagaagttcaacgaggagctggccaaggccgcagccaatgtgtccaccggctacaagttcctgcccttcgaggtctacgctcgcggcaagttcggcgactacgccggcgatgcctacaccggcaagaccacgctctccgatgccgtggcttcctggcagaaggacctgcaggattacgccaagcagcagggctaccaggtgaagtaacggcaatcgcagcagacttcctcctgtggtttctgtagcgggaggttgcgataacaggatcgggcactcttcggagcgcccgattttcttatgccatgggagcagtggcgcgcggattgcgataccaagatggcgtgttgccgaagaatgtgtataataaaagatgttatcgcaaccatagctacaaagtggcgaaacaaagccgttttgtgactactgaaccatagagtgatggttcacgatagcatgacgacgaggagagttgccatgctgttgtggtgacaatcactgcagaccgccgaaaggcgatccaaggaaggagaacagaacgatgaagttcaccgttgctaagaaggccattgcacttaccggtgcggttgccatgctgggttccgttgccgcctgcggttccgacaccgccagtggcaagccggctcaagataaggacgttaccgaaatcaccgtgtgggcttgggagcccacgctgacccaggttgccaaggacttcaccaagaagaccggcatcaaggtcgatctcaagaacgtcggcaccaacaccaaggaatacacccagcttgataacgccatcgaggccggctccggtgctccggacgtcgctcaggttgagtactacgccatcccgcagtacgccatcaagggcaacctgctggacatcaccgacaagacctccggctactccgacttctacacccctggcccgtgggcttccgtgcagttcgccggcaaggtctacggcctgccgatggattccggcccaatggccttcttctacaacaaggaggtcttcgacaaggccggtgttgacgccgagcagatcaagacctgggatcagtactacgacgccgccaagaagattcacgctctgggcgacaactactacatcacctccgacaccggtgacgccggcttcttcgactccatgacctggctggccggtgcaaagccgttccagacctcttccgatggttccgaagtcaccgtcaacctgaccgaggacaagggcgtcaagaccttcaccgacttctggcagaagctgctggacgagggcctgctcgacaccaagaccgctggctggtctgaggactggttcaagggcatggtcgacggcaccatcgcctccctgttcactggcgcttggatgcctgccaacctggccaactccgctgctgacggcgctggcaagtggcgtgtgacccagatgccgaccgctgacggctccaccaccaactccgagaacggtggttcttcgctggctgtgctcgcctccaccaagaaggctgacgctgcttaccagttcatcgagtacgccaaccacggcgacggcgtggccacccgtgtggccggcggtgcattcccggctgacaaggcctccatggagtccgactccttcaagaacaccaccactgtgaagaacgccgatggcgaggacgttgactacttcggtggtcagaagtacaacgaggttctggctcaggctgctgagaacgtgtcctccgactaccagttcctgccctacgaggtcaaggcccgcaccatcttcggcgactaccttggcaagtcctacaccggcgaccagaagctgactgacggtatcgccgcttggcagaaggcactgcaggattacggcaaggatcagggcttcaccgtgaagtaagccttgaaccctcgctgagactgcctagctaatctcacctgatacacaaagccccgtgacgaatcccgtcacggggcttttaccgttttaagccccgcctagtacactcgtcaccatgcgagtgatcggacagcgaatcaaaagaatggcaaccatagcagtgactgccatcctttccgtatccctggcctcgtgcgggcaggccacggacgacaaccgtacggagatcagcgtatggagctgggaaccgagcatgggggaggtcatccgccgtttcgaaaaagccaatccggacatccgcgtgaaatggaccaatatctccggctacggcaatcttaataccgccattcaagacggttacggcacgccggacgtggctcaaatcgaatactatgcactgttgcagtacgcggtctccggccaattgcttgatctgaccgacaaaatcggctcggattattccaacttctttaccctcggcacatggtcgtccgtgcagctcgccggccgtacctatggactgcccatggattcgggcccgatgggcttcttctacaacgaagacgtgttccgccaagccggcgtggacgccaccaagatcaagacttgggatgactattacgaggccgccgaaaagctcaaggagatcggcgcgtatatcgccgccgactcgggcgacggcagtttctatgacgcgatggtctggctcgccggtggtcagccgttccacacgtcggccgacggcaaaaccgtgaccatcgatttggatgaggatgccggcacccaacggttcaccgaattctggcagaaaatgatcgatgaggggcttgttgacaccacctccgccacatggtcggatcggtggaaaagcagagtgggcaccggcaccatcgcctccgtgttctctggggcttggatgccgtcgctgctgctgtccaatgtgccgggcgcggccggtctgtggcgcgtggctcccatgcccacctatgatggccagcccaccaacgccgaaagcggcgggtcggcactgaccgtactgcaattgacccgtaagccggatgcggcttatcgtttcgtggactttgtggcgcatgacgcccaaggcattagcgcgcgtgtggatggcggtgctttcccggccgattatgccaccctgaattccgctgattttttggataaaaccacgattaccaatgaccggggcattgaaatcccgtatttcggcgggcagaagttcaaccgtgtactgtcggaggccgccgaggatgtgtcggtcggataccagtatctgccattcgaagtgtatgcgcgcagtgacttcaaatcgacggtgggccaggcatacgagtggtccggcagtttccacgcctatcagcagcgacaggaagccattgagatgggcatgaaggacgaggaaggcaacccgctcgaaccgttggagaagcccggcaagaaagtcagtctctccgacggcctggcccaatggcagaaagacctccgagaatacggcttcaatcagggctttacgattaagtagggattcggggttgggtcggaatcgaccgcgctatacgcggccgattcctgcatactacgtcacttcacattgcgcgagtagatgtgcgccatgcccttgaaaatcaaatccgggtcatacacgtcaatcagctcggtgtcattctcaaacactcgaccgaggccaccggtggtgatcaccttgaaatcctcgcctccgagctctttgcggaactgacgaatcgtgcgctccacaccgcccaagaacgtgtaatacaaaccggcctgcatgcaggtcttggtgttggtgcccagaatcgtatctggtcgcgtaatttccacttccggcagctgggccgtatctccccacagagcggccgcaccggcacggatgccggtggtgatgacgccggaatcgaccacgcccttgtcgctcacgtgtgtgaacgtggtggcggtgccgaaatcagccaccagcactgggccgccatactcgtaataggcaccggcgcagtcggccagaatatccgcacccagcgatttcggatcgtcaacgcgcacgttcataccggtcttgatgcccggtcccaccaccatcggatcaatgtcgaggaatttgacgatggacgaacggaaggagtgcatcactttcggcaccaccgaacagatgatcacatcgtccacatcggatggctgaaaaccgctcattctcaggaattcagtcagaaacagcccatactcatcagacgtatggttggctttggtggtgatgcggtaggtgccggcgatggtatcgccatccaaaaagcccagcacgatgttcgtattgccgatatcaacggcgaccagcatgataaccctccagattcaagatggatttcatgcgcaattctacagtcccatggctatgatggcctgcggtggtcgacccagcgtggcggccaaccgtagaacacaacatatacagaggaagaaccatgtctcaagacaatggtgcgcacgtcgaagacggcgcaaccacagatgcgagccttgcctcgcgcgcaaagaatccgaaaaaaagcggcccgaagtggtggctgatctcactgattgccgtcatcgtggcagtggcggtcgtcatcggcgtcacgctcgctttcggcggtaagaaagatgacaagtcggcttcgtccagcaaccaatatgccgacaccgtgaccatcggcctcaaactggcccccaccaatctggacatccgcaacaccgccggctccgcgcttgaccagatcctgatcggcaacgtatacgaaggcatcgtggcacgtgactccaagaaccaggtcgctcccgccatcgcctccagctgggagacgtccaaggacggcctgacctacaccttccacctcaataagaacatgaccttcttcaatggcgacaaacttgacgccgaggacgtggcctggtccatcaacgagctgatcgctaagggctaccacgacgccgacgcgctcgccgccgtcagcaaggtggaggccaaggacgccgacaccgcggtgatcacgctcaagacgccgaactccaacctgttgtggaccctgaccggtcgcgcagggctcgtgttcgacaaggacgccaagtatgacctgaagacgcaggccgtcggctccggcccctacaccgttgccaagttcgtggaaaacagctcgatcacgctgaaggccaatgagaagtactggggcaagaacaaggccaagacgcccaccgtggtcgtcaagtatctggccgacgacaacgccgcggtcaatgcgctgaagtccggtgacgtgcaggtgctcgccccgattaccgagaacctcgccgaaccgttcaagtccgattccgccaagtacacggtcaaagccggcaacggcaccgacaagttcgtgctcggcttcaacaacgcttccggttccaaactggctgacaagcgcattcgccaggccatccgttacgccatcaaccacaaggagctcatcgcctctcgcggcggtgcggacaaggcgctcggcggcccgatcccgtctctcgaccccggctacgaggatctgacgaatctgtacccgtatgatcagaacaaggccaagtcgctcatggctgaagccggctattccaccgacaagccgcttcaacttacgctgacctacgccaacatctacggcaccgagctcggagaccagctgcgctcccagctcaagcccatcggcatcgacctgaaggtgaatgtggtggagttctccacgtggctgcaggatgtgtacaccaaccacaccttcgatatttcgctggtggaccacaacgaaagccacgacttcgcatcgtggaccgatccgacatactatttcggttacgacaacaagaatgtgaccaagctgtacaacgagggtgttgccgccacctccgacaaggagcgtgatgccaagttcgccgcggccgccaagcttgtctccgaggatgcgccggccgactggctgttcaactaccgcatcaccaccgccacggccaagggcgttgaaggattccccttcgacctcaaccagaccgttctgcccctctacaacgtgacctacacgaagtagttcgttacagcaatgagctccctcagtgagggggctcattgttaatccaagtaaagtaggcattatgcgattcgtgttgaaacggctggcgttattcgtggtggcgttgttcggcctgtccgtggtggttttcgcagcattgcgcattctgcctggcgatgtggcctccgtgatggccggcgtcaactcgccgcctgagcgtgtgacccagctacgcgaacaactcggtctgaatcggccattgattgcacaatacttcgattggatgagtgcgctggcccgtggtgacttcggcacttcaatcctgactggtcgctccgtaacctccttggtaggcgcacgtgcgtccatcacctttcccctgattattcttggcctgctcatcgccttggccatcggcttgccgctgggctgtgcggcggtactggcccgcagcgcaacggtgcgtgcggtgtttcatgtactggctattgtcggcggtgccgtacctgcgttgtggggcggtctgctgctgattctgttgttcgggcgcggcgtaggattgcttgacgtgtttccctcgcaagggttcccgctggatggctggggcgcacccggttcggcgatatcagcgttggtattgccggctgtatcggtcggcatcatcgtgggagcatcgcttatgcgatacacgcgcgcggccttaggggatttagccagttccggctacatcgatatggcatgctcgtgtggcatgacgcgcactcaggcggtgttgcgtgtgggattgcggttggcaaccccgcagctggtgtctgttatcgggctgaccttcgcttcgatggtcactggcgtgatggtcatcgaaaacctgtttgcgttaccgggcatcggcaacggtcttgtgaccgacgtgggcaaccgcgacctgattgccgtgcaaagcgagctgttcctgctggccgcgttctttttgactgtcggcctcgtggtcgatttgctccaccgcgtgctcgacccgcgtctgaaaaccgctaccgccattacggaggtgaccgcatgagcaatgttcgtcgtgcgacgactggtggtcgacgggctgccttcgtcatcgtcctgcactccatgtggcgtcgtgccgagggcaaattcgcacttatcgtgctcgctctgtggttgctcattgccatcgtttccctgttctggaccccgcaatcgctgtgggccactgatggctaccatgtatgggccaagccgtccgccgagcactggctcggcactgacggcaccggcgcggacgtgttcagctggctgctggccggctcacataccaatcttgtgatcgtgctgctgaccgtagtggcatctatggcttgggggctgctgctcatcgcggccatggtggcgcgcaatgcggcgctcgccagttcttcggtagtggtagttgatgcgttgatttccgttcccaccgtgttgattgcgttgattctggctgtgccgttgggagcgtcaatcgcggtgattgtgatcgcctgcggcttcggatatgggttgaatctggctcgtgtggctcgccccgcagcgttgctggcgtcccgctcgtcatatgtggaatcggccttggccaatggtgccagcgggtggcgtgtgctcataagccatgttatgccgaatattctgccggtattggctgtgcaactgtcattgtcggcgggcacggcggtgttggctgagtcggggctcacttatctcggtatcggtgtgccgtccggtgtgccgagctgggggcattctctggccacttcggtcaaactcatcaacgtgttcccattaaccgtggtgtggcccggcctgatcgtcacggttgtggttgtggcgctgaatatttttggtgatgtgctgcgcgatgccatcgatccggtcaccaaccccgcattacgtgaaataggaggcgaacgatgagcgtcgatgttcgcgggctgaaaatcacgattggcggcaaaccaatcgtctctgatgcggatatgaccattgccgacggtgaacgagttggcttgatcggttcttcaggctccggaaaatctatgattgccaaggcgatgctggggttgctgcccctgaccgctgtgactaatgggtcgattgatatgggcggcacggaaattatcggagcttccgaacgtgcgcttgccgacctgcgcggccggtatgtgggtgcggtgttccagaatccggctgcctcactgaacccggtgatgaccgtggcgcagcagatcgccttgccattgcggttgcactatgatctgaccaaggccgaacgagccgaccgagtgaatgccttgttgagcaaggtcgggctggatctcgatatggccggcaaatacccgcacgaactgtccggcggccaacagcagcgcgtgggcatcgccacggcgctgatcacctcaccgcgattcatcatcgcggacgaacccaccaccgcactcgactccatcacgcaacgccagatcgtggacctgctgacctcgctggtggacgacgccggtgcctccatgctgttcatcacccacgatttctccgtactcgcgcgtgccaccacccgctgctacgtgctggacgccggccgcatcgtcgaatccggacccaccgccgacctgctcgccgcgccgaccacaccacaagcccagcgcctggtcgccgccgcccaaaccctcaccctccacacccccaaggaggattcgcatgagtaacagcagtgtgccgctcctctccgcccactccatcaccaaatccttcggcccgcgcaccgcacgccaccaagtcctcttcgacgtctccgccgacgtccacgccggcgaatgtctggccgtgatcggcggctccggatccggcaaatccacgctgacccgcattatgctgggcttggaatccgcggactccggcagcgtggaatacgagagccaatccattgtcggcggccgaaaatcgccgggattcgcggccctgcgccgcgaatcgggactggtgttccaggacccgttctcctcgctcgacccacgttggcgagtcgccaaatcagtggctgaaccgctgagtctgcaacggcgtgacctgaacaacaccgatatcgacgagcgagtggccgcggctctgaccatggcaggccttgaaccggcagacttcctgaaccggtacccaatcgacctgtccggcggccaggcgcagcgcgtggtcatcgcccgcgctatcatcaacgagcccaaagtgatcctcgccgatgagccgatgagcgccatcgacgtggccgcgcgcattcagatcctcgacaccttcgccgccatccgcgcggcccggccgagcaccgccatcatcatggtctcccacgatctcggcgtggtacagcacatcgccgaccgcatcctcgtgctccatgacgggcgtctcgaagagacgggttccaccgctgaagtgctcggcaacccccaatccgattacacccgtcagctcatcgaggcagcctcgttatagaccttttttggctccctctctgaggggagctgtcgaacgcagtgaggctgaggggagttacgggtgccgtcgtattcccctcagtccgcttcgcggccagctcccctcagggaggggagccgaggccgccggcgacacgcgcttgtcgcgggttgtgctatggtgtgagacatgcagattatctcatgttgttgtcgctaaccgacgcccctgggcgagcggtcagtgacgcataacttgagatagagcattcgaatcgcggcaaatctgtcgcatgaattttcatgaaatcgatggcacgagcgtaaccgtgtaacgcgcgagccgtggttaacatgaaaaactgattcacttttcggattcaccgtacagtgagcgggaatactcgattttcaaaccaaagccacagtccattcgtctgggaacgtcggttcacgaacgcaacgcagcaaaaccccacaaccccagcaacgaaggacttcacatgaccatccacaacagcctcgcagaactcatcggcaacaccccgctcgtcaagctcaaccacatcccgcaggcggccggcgtcaaagccaccatcgccgtcaaagtcgaatacttcaaccccggcggttcctccaaggaccgcatcgccgagcgcatcatcgacgccgccgaacagtccggccagctgaagcccggcggcgtgatcgtcgagcccacctcgggcaacaccggcgtcggcctggccctggtcgcccagcagcgcggctaccgcacgattttcaccctgccggacaaggtttccgaatccaagcgcgcggtgctgcgcgcctacggtgccgaagtcatcgtcacaccgaccgacgccggcccggacgacccgcgctcctactaccaggtcgccgaacgactggccaacacgattcccggcggcttccgcccgaaccagtacgacaacccgaacggcccgctgagccactactacaccaccggccccgagatctgggaggctacggaccacaaggtcacgcacttcgtggccggcattggcaccggcggcaccatctccggcaccggcaagtacctcaaggaagcctccaacggcgcggtcaaggtcatcggctccgacccggaaggctccatctactccgcttcctcacgcgacgaagtccaccagtacgacatcgagggcgcgggggaggacttctaccccaaggctttcgaccggaacatcaccgacgacatcgtgcgcgtatccgacgccgaagcctttgaaatgacccgccgtctggccggcgaggaggcgttgctggtcggcggctcgtccggcatggccgtggccagcgccatcaagtacgcgcttgccaatgatttggacgagaaccagattgtggtggtgctcgcccctgattccggccgcagttatctggagaagatcttcaatgacgactggatgcgtgccaacggctacggcgacatcgtggaacgcaccagcaagccctccctcgccgagcagtaccttaacggaactccctctgatgagggagctgcggatggactccataactagctatcaaaagaatcaataccaacatccgcgctaactaaccgcacctgttttaccttcgaatacggaacaatcccgaaaggaacccaatatcatgtccgctgaatacaacgccaagttcgccaacaccgacatcgccactcgcgccatccacgccggccaggagcccgacccgaccaccggtgcggtcgtcacgccgatcttcgccacctccactttcaagcaggatggcgtgttgggcctcaggggaggccacgactactcccgctccatcaaccccactcgcaccagcttcgacgagcagctcgccgccgtggaaggcggcaagtacgcgctgagcttctcctcgggcttggccgccatcgacgtgctgctgcgctccaccatcaagcccggcgacaacatcctgctcggcaacgatgtgtacggtggcacctaccgcctgctctccaaggtgttcgtgccgtggggtgtgggcctcgacgtggtggacatcaccgatctgaaagccgtggaaaccgcattggcctccaagcactaccagtatgtgtgggtcgagaccccgtccaacccgctgctcaacatcaccgacatcgcggccaccgccgaagttgcccacaagtacggcaccaaggtcgcggtcgacaacaccttcgcctcgcccgcccttcagcacccgctggccgatggcgccgatgtggtggtctactccaccaccaagtacatcggcggccactccgacgtggtcggcggtgccgtggtggtcaacgacgaggagacccgtgagaaggtcgccttcctgcagaacgccgccggcgcagtgccctccccgttcgactcctggctggacatccgcggcctgaagaccctggatctgcgcgtcaagcgccacagtgccaacgccctgaaggtggccgaatggctcgaatcccagccctctgatgtgattgagcgcgtctggtacccgggcctcgagtcccacccgggtcatgaaatcgccgcccgccagatgcacggcggcttcggcggcatcgtctccgtgcagctcgcggccggtgccgaggcggccaagcacttcgtggaccacacgcagatcttcacactggccgaatcgctcggcggtgtggaaagcctcatcgaggtgcccgccgccatgacccacgcctccgtggccggcaccaccctgcaggtgcccgccaacctggtgcgtatttcggtcggtatcgagaacgccgacgaccttatcgccgatctcaagcaggcgttggatcgtatctgaccgtactgacggtactggtggcaccgtattgacggtgccaccacgcttatcggcggactcgctatcgattggtacctacaaaaaatccccggcccacaatggtcggggattttccgttatcgattaaacatattgaatcagctggcgttgccgccctgccatccagtggcatccgcaccagccgggcgcaacgcctgaccggaagtcggtgtggtgccatcaacgaccacacgagtgccgatggtggcaaagtcgtacatccacttggcgtcggccacctgcatgttgatgcagccgtgcgagcctgggataccctgctgcacatagatggggtgctcgccccacatgtatgcaggaacaccgtgcagggcctcgccgccgttatagtaggaaatccacggcgtgcctggctggttgtagccttcgccaaccatggtctgcgattcgtacttgagatacacgtagaacgtgccggtatcggacagcatggaaccatcggcggtgggcttgccagaagcgatgttgaacttcttgaccaccgtggtgccctgatatgcagtggcagtctggttcgtcagatcaacatgaacccacttatcgccatctgccgtatcgaagttatgaggcacctcgacctgcttgacatcatatgggctgtctttcacagccacagtggaatcagtggactggttctgctcgatggcggtagccagacgttcgggggcgtccccggcaccagtcacttcaataccatccacaccgagtgtcttatcggcgccaatttccacgccgccttcgtctttcggcgtgatgtagacctcgcgtgtcaccttgggaacagtcagttctttggttacgctgtcactggtgacgtacttggtgatggcatcgcggtcgactaccagactcatggtgccacccgccttattcaccgtgggcttgaggaatgaggcaatggtatcggccgggatggtgacgctcttgttcacgccgttgtccacggtcagtttgaggccaagcttggcattggcgtcaaactgtgtttgctgtgcgctcgcgtcatcaatcggattctttgcggtctgtagcttgaccggcaccgtcgcattttcgcccggggtcgcgacggcctccttgactgcagcattgacaacattggtatccggacccttgccatcctgacccgcggtgtaatcgaactgcttggtgctcttgttgtagacaacggtggcaatctgcgctcggtcggcctcatcgaccaggccggcggtgacgaattgttcggcagtctctttgtccctggtggcggtcagagcgatatgcggctgatcgaaaatattgagcttggccacgtcgccggtcttcgcgttcaacagcgcatctacggttttatccgtgtcgacggtgacgccaaggtccttcagcgaggctttgacgctgttgccttcggcggtgaacgtcactgtggtgttattcagctgctgcttcacagtattcgcaagttcttcgcgggtctggcccatgacagagacattgcccaaatgaacaccgggcgcagccttgtcttggaagtaccaacgtccgacgaagaaataggctattaatgcggcaagcaacactgcaaatatggttatgatggcaatccgtgcggccttgccatgtgatttagcggtggtagatgccatgacatgttcacccacataggctgtattgtcggcatggttattggtgtcattgtcgctttgctgtggcgtggcggtacctgtggccgcggatgcgaacagcccatcggcggccacaggctgcagcaccgccgtctcctggtcgtcaggagaggagaaggaaaatgtatcgttggccataaaatgccccgtcttagttctctcaaagcggcatatcgtgtgatatgccgggaatagcgttcctcgacgcataataatacggaagggctacgtacatcgttacgaggtattccgttatacgatgaaatccatccgcggtcggcctacactggtcgtttatggcagcacatcaggcggcgctggaggcgctcacacgatacttcggctatgactcgtttaggcccggacagcaaggaattgtcgaggctttgcttgccggacacgatgtcttgggcgtgatgcccaccggcgcaggcaagtccgtgtgctaccagattcccgccgcgctcagcccgggtgtgactctggtcgtatctcccttgatttccctgatgcgcgaccaggtcgatgcgctgaacgacctcggtctgccggccgcgttcatcaacaccactcaaactcccgacgagcaggcgatggtgttcgcccaagccgccgccgggcagatcaaactgctgtacgtggccccggaacgcttggaaaccgggcgattccgcgactttgccgcccgtacgccgatctcgctgatcgccgtggacgaagcccactgcgtctcccagtggggtcaggacttccgctcgtcgtacttaggtatcggcgatttcatcgccgggctgccgcagcgtccaccggtgggtgcgttcaccgccaccgccaccgaacgggtgcgtcgggacatcgtgggactgctgggattgcggaatccggccgtcaccgtcaccggattcgaccggccgaacctgtattttgatgtggtcaaactggagaccaaatacaaggccgcatgggtggcgcggtatgtggccgaccatccggacgaatccggcatcgtctactgcgccacccgcaagaccaccgaagcgctcgccgacacgctgaaccagatggggcatccggccgttgcctaccatggcggcatgtcgccggacgcgcgtgaggcggcccagcgcgacttcatcaccgacaaggtgccggtggtcgtggccaccaacgctttcggcatgggcatcgataagtccaacgtgcgttacgtcatccaccacaatctgcccgaatccattgaggcctactatcaggaggccggccgcgcgggccgtgacggcgagcccagccgatgcacgctgctgtggaatgagtcagacatcgtcacccggcgtcggttgctggataacgattatgagaacgaacgattgactcccgaagagcaggaaatcgttcgccagtccaagcgccggctgctggacggtatggtcggctactgccgcaccaccgactgcctgcaccggtatatgacccggtatttcggtcaggaattgtcgccgaatgctggttccacggcgggtgaagacattgcggcggactcttcgcagtccggcaaatgcggtgcctgctcgaactgcgaaagcacgttcgagaccatcgacgtgacccgcgtggcgcaggcgatcagccgttgcgtgcatgacgtggggcagcgcgtcggttccggcaagatcgtcaagatcctgcgcggttcgcgggcacaggatctggcatggctgaacccggagcggatgcccaccttcggcatgctcaaggacgtgaacgaggctcgcgtgcgcgacgtgttgagccagatggccacggacgggtacctgtcaatcgccgaagggcgtatgccaatcgtcatgttcggtgcgcgggcggccgaaaccgccgctcccgacttccactatgagatcaaacgggtggaacgcaagtcggaggcggccggttccggtcggagcgggggagtggctgatactgccgattccgccaatgttcccggcgatgcgctgggctcgtatatcccggacgatgacgaggaatcgctgttccagaagctacgcgaactgcgacgcaccatcgcccaggaaatcggcaagccgccgtacatcgtgttctccgacaagaccttgcgcgacatggcccgcatcaagccggttaccaacgcgcaatttctggcggtcaacggcgtcggtcaacacaagctcgacctctacggccagcgcttcatgcaaaccatcgcctcgttcaatgccgggagtgcgtcataacaatctcctatagcgaaccgcggagtatttgcgggcgttcttgggctggcgcgactacgatgactgttcgatgcttcatgaccgaacactcggcaagtagaaaggcaacagcatggcagaagacaaggccgaaaagcccgtcgtcgaatcattccagcttgatcacaccaaggtcaaggcgccgtacgtgcgttacatcgacaccgaaacgggccctcacggcgacgtgatctccaattacgatctgcgcctgactcagccgaacgagcaggccatccccaccggcggcctgcacaccatcgaacacaccatcgccgtgctgctgcgtgaacgcattcccggctacatcgactgctcgccgttcggctgccgcaccggcttccacctgctgacctggggcacccactccaccgaggatgtggccaaggcgttgaaggaatcgttggagttcatcgcatacaaggccacatgggatgacgtgcccgccaccaccgagaagagctgcggcaactatcgcgaccacagcctgttcaccgccaaggaatgggccaagctgatccttgaggaaggcatcagctccgacccgttcgagcgcaaggtcgtctgatcgcaagccaatcggcatggaagaaccccgcccccgcataccacgcggacggggtttctttgtgcctatgtttgtgcctatggcatggtaggtttgccgtcagttaatcgttggccgctgcacatcggtagcctggcatgttggagaggtggaagtgactcagtcgaacgctgcaaacaaggcgacaggccgccgtttccgccacgccaccatgcgcgatctgccgcagatgcagaaaatctacgcacgcgcacgcgcgttgatggtcgccaacggcaaccccacccagtggggcaacgaatttccgcgtgaatcggtgattgaggacgacatcgccaaccagcgtacgatgctgctggtcgacacctgcaatggccacgaacgcattctggcccagttcgccctgtgcccgggcaaggatccgacctacgccaaaatcgacggcgcctggctggacaacgacacctatgtgaccatccaccgcatcgccgcatccggtctggtgcgccacgcggcccgcgactgcatcaggtgggccctgaagcactacggcaacgtgcgcgccgacacccaccccaataacaaggccatgcagcacgtgctcgaaagctccggcttcgcccgttgcggcctgatccagctgctcgaccggccggtcgacaccaccagaatcgcctatcagcgccacgagtggtgagtgtggctgccggctgatgtgctcgtttctgcaccgtcatcggtttctgacggtagaatcagtgtgtgagaagaacacgttgggtcgggggcgtcgtggcggtgcttgcggctgtcatgctgtcgtcgtgcggcggcgtccagtcgaatcccggggtaacacaccgttgccaatccattcaccgcgcaggtgaatggagaagacatggcgatgcctgtcggccgatggagccccatcggccgacaggcatcgaggaagtcaccgtggccggcggaacgcgcggtcgccgattggggcgaatggcttgtgtggttcgctttggtaccagtaggcgaccgtggccacgtcgtcctgtcgttcgaagttgccggcttcctcggtgccgatctgctgccattcgacgcgcaggtctcgctcgaagtagatcgggtcggggatgtgccaacggtataggccgcgggtcacgggggtggcagtgtcccagtaggcgctttcgcgtccggcgaggttctgcgagtagaacgggaagccgaggtatgggccggtgaaggtgcgctcgtgcatgcggccgtgttcgtcgaattcggcgaagctccaggcgccgccgaagtagtcctcggcgccggtgctgcaccaggtggggtatttgccgtcgccgtcgatgtagaacttgaattcgccttcgccccaccagcggctttcgagcgcggtgagcgccaagtaggtgccgacgtaggtgccgtgtccttcgacgccatcgagcaccacgtagtcgtgggcgagttcggtgacgcgttggcggcgccactgcgcgtggaagcgcatcgtgtcggccggcagccggtcgtattcggtgtagtcgatttggtagaagaacgcgggcacgtcctcgttgtggtcgttgcgcagcacgatgcgcgcgtgttcgaacggcatggcgaagtagcagttgaagccccggttcgggttgaccatgacgggaattgagttgatggtgcaggactgggcgtgtccgcagcagaagaagtcgccgatcgggcattgcaccgagggggagtcctcgccgtcccagtagaattccaggatcaggttgcgtagcacgtcggggccggtgggggaggtgcggtcggttaccgtcatccagatgtgacgaatcacgccggggccctcgacgtccatcaatgtcaccgattccccggacctcaccgtgctgatgcaggggcttcccttgcgggaggggcccaacgcgctggccgccatggccgcgcggcccttgccgccgtccgggttttcggcgttgatgcagcgggtgcggccgggggccctcatggccacggcatccaaggcgccttgtccgagccccggcgcggggttcgctgtggtgaatgcgtcgagcatgatgcttacttcctttcctgtcgcaggcccggcccgccacggcgttttgtctggggcgggctgggctgctggggggtgttatttcacggcaccggcggtgatgccctgggagagcttgcgctggggtagtgtcctatatcttgcgcactttggtcttcgtccgtccctgcggcgatgatcagttcgcttcccgtacggtctcaccgagtcttgacatgtcgaggtagcggcgcgtcgaccactcgttcgacgtgacatagcgcacgcgtgcgcagacgagcatcaacgcgctgcgtccgtcggggaagctgccgaccacgcgcgtgcgccgtctgacctcgcggttgcgggggtgaccctggcgaggacgttgcgttcgaagcggaccatgcaccgctggtagcgggcatcgcgttcaaggtctcctcgacgctttttctgaccatccggtccagggtggtctccgacatggcctcatatcgcaaaaaccgtacgctgaaagtaactcagcgtacggttttcacgaaagcagccatcggctatcggtcagccgatagacctcagtcctcagtcgcagcgaccttggtgtcagccccggccttctgctcaaggccgagcttggagcgcttgcggctgtagccgaagtacacgatcaggcccagaccgaaccagatggcgaaacgcacccaggtctcccagttgagaccggcgatgagcacgaagcagaatacgatggccagaatcggggtgaccggcacgcccggcgcgcggaagccgcggggcgcattcggctgggtcttgcgcatccatagaataccggccgacacgatgatgaacgcggacagcgtaccgatgttcaccagctcgaacagcacgttgatgttgatgaagccgccggcgaacgcggtcagcagaccgaagaaccaggtgcccttgaacggggtgcggtacttctcgtgcacgtggccgaagaacttcgggaacaggccgtcacggctcatggcgtagcagatacgggactggccgtacagctgtacgagcatcaccgtggtcatgccgatgagggcgcctaggttcacgatcaccgcgagccagttcatgccggtctccagaatcacgccggccactggggcgtcgatgtacttggcgaactccttgtagggcaccacgccggtcatgatcatggtcatgacgatgtagagcacggtggaaacggccagggacagcaggatgccgcgcggcagcgtcttgttcgggttgatggtctcctcggcggaggaggacacggcgtcgaatccgatgaagctgaagaacacgatggatgcggccggcacaatgccgtacggctgggtggagccgggctggaaggtgtagatgccgtacggggagaacggctgccagttggacggcttgacataccacacggcgcacacgatgaacagcacgatgatggcgagcttgatgagcaccatcacgtcattggtgcgcttggtctggttgatgccgatggacagcacccacgtgatgatcagcacgatgacgaaaccgggcaggttgaagtaggtggtgacgtccgggttggtgccgtaggcggcggtcagttcgaccggcaaatgcaggccgaagccttccagcagcttgttgaagtagcccgaccagccggcggacacggtggccgcctgcagggcgtactccagaatcaggtcccagccgatgacgaaggcgatgagctcgccgaacgccagataggcataggagtaggccgagccggaaaccggcgccatggcggcgaactcggcgtagcacaggccggcaaaaccgcagcagacggcggccagcaggaacgatacggacaaggccgggccggcggtcagcgcgcccttaccggtgagcacgaagataccagtgccgatgatcgcgccgatgccgagcatcgtcagatcgaaggtgcgcatcgtgcgcttcaggggagtggattcggcgacaagctgatccacgcttttcttacgaaacagatccatgttcttctctcatgaaatctaggattatggggctgaaccggacggatttccgggatcccggcacgcctcaacgccgggaatcaaaggcagtttccgagaaaccgcatatcggtcattagtgtacgactgccgggcgaaaacaaacgattgtgaccacacgtcacattcctgcgcaacaataggtgcctatgagcatgaacgcagcacccgaaatcgcattctcgtccgagcagggcaaggccaactatgcggccgcccgccgccaataccccgcacaggccatcgtgaacctcaaaaccatgcgcgacaacatggcccacctgatctccgtggtcggcggcccgaactccggcacggcggtgatgggcgtggtcaaggccgacgcatacggccacggactgctgcccgccgcactggccgcgctcgccggcggcgcgacatggctcggcaccgcgcaatcgcatgaagcactgctgctgcgcaaactcggcatcggccccgaccgttgccgcattctgacttgggtctacaacggcaccgaagtgccattcgatgagctgatcgctgccgatatcgacgtatcggtcggctccctgcccggcatcgatgccgtggccgccgccgcacgcaagctcggcaagcccgcccgcgtacacgtcaaggtcgattccggcttcggtcgcaacggtttcacgccggccggattcgacgccgcgctcgccaaactcgtgccgctcgccaaagagggcgtgttgcatattgtgggtcagtggagccatctcgccgtggccgattcgcccgatgtgcccgaattcgtgtcctccaccgaccgccagatcgaaacattcaaggacttcacgcgccgcatggaacaggccggcattccgccggagatccgtcacctggccaacacggcggccactttggaccgcccggagattcacttcgaacttacccgccccggcatcggcctgtacggctacgagcccgatcccgcgatgggcaccccgcgcgactggcatctgaccccggccatgcgcctgcaggcgcagctcggcacggtcaaggatgtggaggccggccatggcatctcttatggccgcacctacctgaccccggacaacacctcgaccgctattgtgccgctgggctacgccgatggcatccaccgctccgcttccggtttcgatatggaaggtgccaagcacgtggagaagccgggcggcccggtgcgcatcatgaccactgaaggtccgaagctctaccgcgtgtgcggccgcgtgtgcatggaccagttcatcgtggacctgcacggatccgccgccgaactcggcgttcacgagggcgacacggtcgaactgttcggcccgggccgcggcgaggattacgttgagcctaccgccgacgattgggcccgcgccgccgacaccatcagctacgagatcttcacctgcctgcgcaaccgcatcccgcgcctttacgagcatgccgccgaagtactgcccgccgccgacctcgccaagctcgaccccgccacgctgctataaggtgcattaccgccatacggtggcaccccgtaatcccttcttcccgaatatgtaccactgacatgtgctgagcgtcacatattcgggaaatcggccccaatctcccgaatatgtgccgttgagttgacgtcagtggcacatattcgggaagtcgggattactgcggccgatatgtgtgcctatgcttggaatatggaaacgactttggatggggaacaggtgctgagcgatgagggctacagcgccttcgacgaggagcggtgggcacccgagccgcccaaatccaagtcgcgcacggctttcgaacgcgatcgcgcgcgactgattcattcgtccgctttgcggcgtttgggcgcgaaaagccagattctgattgccggtaccgacgatttcgcccgcacccgactgacgcatacgctggaagtcgcccagatcggtcgccaaatcggcgcattgctcggctgtgatccggacgtggtcgactgcgcctgtctggcccatgaccttggtcacccgccgttcgggcacaacggggagcgtgcgctcgccgacatcgccggcaatatcggcggcttcgagggcaacgcacagaccatgcgtatcctgacccggctcgaacccaagatctttcacccggacgggcgttcggccggcgtgaacctgacccgtgcggccttggatgcggccgtcaaatacccgtggaccttggccgaagccgaccaacaccccaagggggagcggtcgaagaagttctgcgtctacccggatgatgagccggtgttccgctggctcaaaatcggcgcgccccaggccgccaagcccatggaatgccagatcatggacctttcggatgatgtcgcctactccgtgcatgatgtcgaggattccatcgccaccggcgcgttcgatccgattgtgctcgccgatccgaagatgctggaccacatcatcgagcagacgcgcgcatggtatggggcgaagtgggatgccgacaagctgctggccgcgttcatgcgattgcgccgagagcatttgttccctgcacatttcaatggttcgcgcgaatcgttggcacagctcaagaacattacgtccgatttgatcggtcgcttctgctggtcggtggaaaccgccacgcgcgacacgtatgggcccgggccgttgacccggtattccgcgaacatcgtgattcccgaggacacgaattacgagatcgtggcgttgaagggcatcgccgtgtacttcgtcatggcgcctcgcgagcgcgagccattccatcaggaggagctcaagatcgtatcggatttggtcgatgtgcttatggccgattcgccgctcccatccgacgctttggaaagccagttcctggccgattggaatgaatccaccaatgacaacgagcgcctgcgcgtcgccatcgatcaggtcgcaagcctgaccgacaactccgccctggccctgcactccatcttgtgctgagggcgtgttgggcgggcgcttccctcagtctcgctgcgcgagccagctcccctcgggtgaggggagctgtcgctgtaggcgactgaagggagtttcgcggaagaaatgataaccgacggtaaaaatttaccgtgtctcaggtgaggcggtactctagagacttatggtcggaatgattaagaaagaagatgtcgagaaggtgcgcgccgccgcggacctgtatgacattgtatctgcgaccgtaacgcttaagccctccggcaccggcaccttcgtgggcctgtgcccgttccacgacgagaaaaccggcagcttcaacgtgcgtccctcgctcggcgtgtggcactgcttcggctgcggcttgggtggcgacgtattcaaatacgtcgaacaatccgaaaacatcgacttccgcgaagccgtggaactgctcgccgacaagtaccatatcgagctgcactacgagaacagcggcaacggcccggcgcgcgagaacaccggctccaagcgcacgcgactgctggaagcctgcgaggaagcccagcgcttcttcgtctcccagatcttgaccaaggaagcactgcccgcccgcaagctgcttggcggccgcaacttctcccaagctgattgcgaacgtttcggctgcggctacgcgccgcaaggctgggataatctcgtgcgtcacttggccaacaaaggcttcacacaaaaggaaatcctcgacgccggtctggcccgtcaaggccagcgtggcatctacgattatttccgcggccgcgtgacgtggcccatccgcgattcgaccggccgcacgctcggcttcggcgcgcgcaaactatacgaagacgatcagatcgccgccaaatacatcaacacgccggacacgcagctctaccgcaaaacccaggtgctctacggcatcgatttggccaaatccgccatcgtcaagaagcgacaggtggtgatcgtcgaaggctatacggacgtgatggccatgcacttggccggtatcgacaccgccattgctacgtgtggtaccgcattcggcgccgagcacgccaagatcgtgcgccgcctgatcgccgacgattcgctgggcgcggtccagctggtcgggccgttgaaggtcaaggaccagccgttgagctcgcgcatcgtgttcacgttcgacggtgacgccgccggccagaaagccgcgctgcacgctttcggcctcgattcggccttcctctcccaaaccttcgtggccgtggccgacgacaatctcgacccgtgcgacctgcgcatcgagcgaggcaacgaagcagtgcgttcgctgatcgcccgcgccaaaccgttgtatgacttcgtgatcgacgccgccatcagccggttcgacctgacctacacgcccggccaggtcggtgcgatgaaagccgtggccccgctggtggcgcagattcgcgaccgctccctatgggacgcttacgcgcgcaaatccgcaggccgtatcggcgtggaccttgaggtaatgcgccgcgaggtgatgaacgcgcgccggcagatgcacgtgcgcgatgaggacgcctacgcgcccaaacgtcgattcgagcgtgacgagccgcgtgtggaacccggcaccaacccatacgccaatccggccacgcgcaaggcgttggagcgccgtgacgccgccgaacaggcgtacttcaagatcgacgacgccgtattcatcgccgaacagcagttcatggccgtgctgattcaggtgccgcgcgccatcgaccgcaccatgttcgggcagctgaccatcgaccatttcatgactccggtgttccgcactttgttccaagcgattgcggcagctggcggactgccatccgacgataccccgcaggggctgtggatgcacaacctcaccaaggccggcggaccgatgctcaatcaggtgatcaacgagctggccgtcatgccgttgccactgcctggcgacgacaccggtagcggtgcgcagccggtgcaggccaacgtgtcgggaggaggtgttggcgtgaatggcggtgccgccgcagtacagctgcgtcctgccacgccggaggagcagcgctacgccactgagcttctcacccgattgttggacatgggcttcatgcgccagatcggtttggccaaacgccgcatggcccaactgccggatggcgaggagaaaatcaccctcctcggccaaatcacccgtatggagactgctcgcaaagatctccaagcccaaatctatggcaacaccgttggctagtaatctctccctctgacgagggaggttactggccgcagtcgggcggggcgagagaagcgacgtcagatatatcgcgcagcatcgatgtcacatcaactattcgtttgatattaactttttaatgacaaacgataaattatggtataatgcaagtatgagttgcttggtttgcgcaatgaagcggaggctcaatcatggcaacgacaaagaaactatccttcggtttggataaggccggtggcgcggccttgatcctggcccgcatcggtgccgcgctcctatggatcatcgcagcgctcgcggccgtggtgtgggtggtattcctcatttccccgcgctcgttcgccgcgaacttcggcagtgtcgacctgaatgtcggcggcgcgttcaccctcagcatcaagggcgacttgttggactactcctataatctgcagaacttccacgacggtcccgtcaacatggtagctaccatctccaccggtctggcgagaatggtggtctacgctctactggccttggcgttctccgaaatggccgcactgtgcaaggatttgacggtgtggcttgcagacggcagggatgccacgcctttccaaggcatggtgtccgaccggttgaacagggctggctggtatctgattgtcgcgccgattgtgggtctggtgaacttcatcgtatgtttcctggctggcacgggcggcaactggggcttatggatgagcggcatgatggtgatgattggcattatcctgttgctgattgcgcgcatcttcgattatggcatgggtctgcaacgggaagtcgacggtctgctgtgagggggaagagcgccgtaggcccgcgtggcgccggtccgaacagggccggtccgaacaccgagggcccgaatgaggacagcctgaacatcgttgattcgagcgagaccggcctgaatacggctgactcaaactccaccggtccggccggcataggccatatcgtcctgcgcctcgaccgcatcatggtcgagcgaggccgctcactcaactggctggccgatcaggtgggcatcaccaacgtgaacctttccaaaatcaaaaacaatcgcgtttccgccatccgcttttccgccctcgccgccatctgtgcggcattggattgccagcccggcgacattcttgaatatgtggatggcatttcgggcgatgcggacgatgcgaatagcaagtaatcgcacgcatgccaactcttctcctcctggcctgtgattgattgacaatcagggattacatgccaaatgggagagataaacatgtggaggttggattggatgggtgcagaagttgcgaattggccccatccaaattggactggtttgggtggggccaatccactccgttcaataatgaagcgcgataccaagcagcgtcgaacgaagggaaactcatgacgcagaatcgtgcggaactcaaccgtaatttggcccagatgctcaagggcggcgtgatcatggacgtcaccacgcccgagcaggcgaagatcgctcaggacgctggtgcctgcgcggtgatggcgctcgagcgcatccccgccgacatccgtgccgccggcggcgtttcccgcatgagcgacccggccatgatcaagggcatccaggaagccgtgtccattccggttatggccaaggtgcgtatcggacacatcgccgaggcccgcattctgcaggccatcgaaatcgattacatcgacgaatccgaggtgctttccccggccgacgacgtgtaccacatcgacaagaaccagttcgatgtgccgtttgtgtgcggtgcgaagaacctgggcgaggcgctgcgccgcatcgccgagggtgcagccatgattcgcaccaagggcgagcccggcaccggcgacgtgattcaggccgtgcgccacatgcgcaccatgaacaagcagatccgcgaacttgtcggcctgcgcgacgacgaggtctacgaggccgccaagcagctggccgtgccctacgatctggccaagtacgtgcacgacaacggccgtctgcccgtcgtgaacttcgccgccggtggtgtggccaccccggccgacgccgccctgatgatggaactcggtgccgaaggcgtgttcgtgggctccggtatcttcaagtccggcgatccggccaagcgcgccgccgccatcgtcaaggccaccgccaactggcaggacgccgatctgctcgccaagctgtccgaaaacctaggcgaagccatggtcggtatcaacgaggacgagattcagaccatcatggccgctcgcggagagtgacgggagtcgaagccggagaggacaacatggttgtagctgttgaatacatttccaaagaagaatccgcagacgccgaaaccgccacgcacggcgtgaccggtattctggccgtgcagggcgcgttcgccgaacatgcggcggtgctcgacaaactcggcgccccgtggaagctgttgcgcgcggccgaggatttcgatgaatccatcgaccgggtcatcctgcctggcggtgaatccaccacgcaaggcaaactcctgcgttccaccggcctgttcgagccgatcgccgcccacatcaaggccggcaaaccggtgcttggcacctgcgctggcatgattctgctggccaagaagctcgacaatgatgagaacgtctacttcggcgcgctcgacgctgtagtgcgccgcaatgcttacggtcgtcagctcggcagcttccaagccatcgctgatttcggccaagccgacgacccacagcgcatcgcggactttccgctggtgttcatccgtggaccctacgtggtgtcggtcggccccgaggctacggtcgaaaccgaagtcgatggtcacgtggtgggcctgcgccaaggcaacatcctcgccaccgccttccatcccgaactcacggacgacgtccgcatccacgagctcttcctgtcgctgtagccgattcgtctgccgttagactggtattcgaccgacgaatcaaggagacgatctgccatgcagttcacgctgaaccggcgcagcacggtgccgatgtaccggcagctggctgctgagctgcgtgaacagattgtctccggcgcaatggctgagggctatcgtctgccgcctgaacgcgagttggcctcacgcctcgaggtcaatcgcaccacggtattacaggcctatcagcaactcaaagatgagggactcatcgcctccaaagtaggcaaaggcacgttcgtgctgccgttgcagcatattgagactgcccggattcctgtagtgagacatgagccgattgacgaggagccgaaaccgagcgttgtgcggccgccgtggtcggtgttgttctccgactattccaaccgattcacctaccacgacattgcctcggccgagcgggcgcaacgcggcgataccatcatcgactttgccaccggctcgcctaatccggcggatattcccgacgatttgttgcgttcagtgagcattgaagcgtttgagtcgcgcgaattcgacggtcagccagaatcgcctatcgaaggattcgatgaactccgcgcattacttgccgagcatatgagcacacgcggcgtgcagtgcgatgtacgaaacgtgatggtgctttccggttccgagcaaggcatcgatcttatcgtgcgtgcattcgtcaatcctggcgactgcgtgctggtcgaacaatccacgttcttcccggcattgcagaccttccgctcggcggatgcgcgcatcatcggcgttccagtggacgagcacggtatgcgtacagacctgttggacggctattgcgcgcgattccggcccaagctcatctacaccgtcccgacgttccaaaaccccaccggtaccacgctgccgcccgaacgacgcagcgaactcatcgacgtggcgcggcgctatcagtgtctgatcgtggaagacgatgcttacggcgatttgtggtacggcggggaatcgtccgacgcacatcgccccataccgcttaagggcatggagaatgcgggatacgtgatgtatttgtcgacgttctcgaaaaccgtcacttcgggcctgcgcacgggatgggttgtggccgacccgcatgtgattaaccggctggcggctctgcggcgcatggtcgaccagcatacgagcacgtcatcgcagcgcatctgcctggaactgcttaaagaaggccgcgtcgccgaacatttgcgcggtttgattaaggcttaccgcattcgacgagatgcagcaatcgcagcattggagcggtatgcgccggatgaagtgtattggaccgtgcctgcaggcggctactatatttgggtttccttaccggacggcgtgcgctctctggatgtattggaatcctgccgttcccaaggcgtcacgttcatgccgggcagcgtgttcgacgttgacgaaatggatgattcccacatccgtctcaactttgtgcgcccggatgctgctgacattgataccggcattcgaatcattggcgagacgatagcacagatgtagccaagtgactggctcattgcggttgtcgagtttttttgatggctgcatacccacatcgatgggtgcattcgacgaatgaataagcgaggaagccatcatcagttcgctgtggcatgcgcatagcgttgtcgggcgaacggggcagaccacgtggtcgttgcgtgacctggccgatcgagccggcatcgcattgcccctggcgtagtggcgaggtggcgcagtaacgagtcacgccatcgcgagccgatgatgcgaaatgcggaaccggtcgcggccatcaacggctatcatacatgcggaagcaacgatacgttggcgtcagcacatccatctgactccagaaagggacacgatatgaccacatcctccgtttcgccggtgaccactgaactggcgggcagcgaaaccggcatcacgcttgtcattcacgccggagcgggcagtcgtggcaagcacagcacgcctgaacgcatcgcccaggtcgaacttgatctgcagcgcgccctcgatgccggataccagttgttggaatccggagcaccggcgcatgaggctgtggtcgccgccatccacgtcatggaagacgctcccgaattcaacgccggccgtggtgccgccctgaccagcgatggcatcgcccagatggacgcctgcctgatgaccggcgatggcgaggtcggtgcggtcaccggcgtaagcaccgtgaagaacccgatcgatgcggcgcgtgccgtcaaagagcagaccaagcatgtgctgttcgcggacccggccgatgccgagatcgccgattggggcgtcgcgaccgaaagcaacgagtacttcatcaccgaacagcgtcgtcagtccttggccgaggctcagtccggtggcgatgagtgggagaagcatggcaccatcggtgccgtggcgcgcgatgccgagggcaatatcgccgctggcacgtccactggcggcatcaccaaccagatgcacggtcgtgtgggtgattcgccgctgcctggttgcggcacgttcgccaaccagtccacggtggcggtgtcctgcaccggcatcggcgaggcgttcatcaaggtggtcgccgcccatcaggtgtcggatcgtgtgcgtttctccggcgagaacgtcgaggatgccgcgacggccactttggacgaagtcgccgcgcatcatggcgatggcggcatgatcgttctgccggcggtcggccgtggcgtggtcgcctacaacagcgagatgatgaacttcggataccgtagcgcgcaaggaggtaaggtgcagggctgattgccccctgtattgcggcatatatcataatggccggtgtgctgcggattcttggtaaggaatccgcagcacaccggccattcatgtatgcggcaagtgccgccgatcagtgcggcagtgcgcgctacttggtgatcgtgttgtacgtgggcatgttcgtgtaatcgaactgcacgttcttcacgttctgtgcagacacggcggcgaaacgtttgaccgggaatactggggtaatacgcaacttcatcgctcctcttcctcgaatgaaactatgttccattggtatgagccagccacgtacggtattcgtgtctggcctgccacacaatgatgcagccgtatatacgggcacagcattgcgcggcagttcattgtatggaagacatgcaaactcaatgtttccttgtccaaataaaaaaacgagcgcggctgatgtgcggcaccggtccaaaaactcatgtccgccagcgcaacgcgactacgtaccttatgctggtctgcgcgtaaaatagaatggttgcgatattgggttattcacggaggaatggatgcgacgctggctgatcaatgtagccaaaaatgagacgattctcatcgtcgccgcaatactcgccctgatttcgtgtttcattgtgccgccggacgccgattacaaaagctacattcacgccagcaccatcagccagctcatctgcctgatgattgtggtgtgcggattccagcgtatcggcgtgttccgcatcatcggttcgcgattgctggagaaggtcagcaccatgcgcggactggtcattacgcttgtcgctttgacgttcttttccgcgatgttcatcaccaatgacgttgcgctggtcacgtttgtgccgttcgcggtggccgtgctcatcatggctgggcaagaggataagaccatcctcgtggtcacgctgatgaccattggcgcgaacgtgggcagtatgctcaccccgatcggcaacgcgcacaacctgtatctcaaagccctgaccggcatgccgaccatggaattcctcggcatcatggcaccgtattccggcacggcggccgtgttgctggtcatcgtgatttccgtggtgtttggcggcaaaccggtcggcgacctgggcgacctcgaaaccggcgtgctggctcccgagcgcaacaaacaccagcccgacgagattcgtatcaccggctacggcgccggttatggcggctggcgcaccatcgtctactcgctgctgttcatcgtctgcctactggccgtctccgacgtgattcccctgtgggtgatgtgcgtgatcgtggtcgtcgtgttcctgttcaccgatcggcgcgtattcaaatacgtggattggggactgccgctcaccttctgcatgttcttcatcttcatcggcaacatgaagcgcgtgcccgaattctacgaactggcgcgctcgctggtcggcggccatccgctggaggtggcggtcggctccagccaggtcatcagcaatgtgcccaccacgattctgctttccggcttctgcgaccaatggcgcgatctgatcattggcaccaatttgggcggcatgggtacgctcatcgcctcgatggcctcgcttatttcttacaagaacgtcgtgcgccaatacccgcacaagaaaggccggtatctggccgtctactccgccgtcaacgttctgtttttggccgtattgctgaccttgagctggatcatcgagccgagtctctgagccgccgttgtgggttgggccggtctaccgcgcgtatacggtgggggagccggtcagtcggctcatggccgactgcgggatgtcgtggatgcggccgatggtggcatccagcgtggatacgccggatacgccgtctgtgttggctgtgttggctgcagaggtgatgctggatacgccgactgcggacgatgatacggccgcaaccatcggctgacgataggcgttggagttgcgggccagccgggcgagcgcaggacgctgcctgcggaacagattgataaacataccgcacactccttcatcgttggccggcggtcttctggccgccgtggattccatcctgccctcctgcgcttgtattcgctatgggggatagcccctattattccctgaatctgcacgattccccctcatccttgagggtgattctaacggcaaaggaatcggcctaatggccgatgtcgatcagcgcgaagccaccagcgtgacgctgtacggcttgatcttcatcgccagcaatgaagacggcgacggcaatgtgtaagcccgacgttccggcacaatcgcccccgaagcctcgccgcggtatccgatagtggttttcgccgtcggactggcgcttaacgtcgtcacctccaaacgcaccggtcgcgatggcgaggcgcccagcccggccagtccgcgcgcgatttccaacgtcacatccaccggggaatcggaggtattgacgattttgatgtaacggcaggcgtcatccccgtcatgcccggtggcactgacatacagatgtttggcggggcgtgacgcggtctgctcgatggacacggcatatgtcgtgtcgcccagatgcgtggaaaacagccgctccacctcataattcaccgtggggttcacatgcgccggattgagttcgataagattctgcgcccaccccttagccgggatatgcgcgagcagcggtgcataggaggtcatgcgcaccacgtcggaattgcgctcgcaaccggtcaggaacgcggcctcgccgagtgccgacttccacgtgttcgcgccctgttcggtctgcggttggccggcaaaatagccgttggctgaatattcgccgaaatagacgccggcgccgcaacgcgggtaagcgtcgaatcgtgacgcttggtatgcaaaccattcgggggagtggtaagaatgttcgtcgacgataatcgcgtcaccggtggcggaatcatgtgccccggaatcggttgcggccaacgctcgcgcatggtcccagctgcgtttcatcgtcggctggaaggggaacagtccggcgctcatcacacacagcatatccgggtatcgttcgtgaatggcctcgctgatcatgtcaaacttggccacgtagtcagccccgaagttttcgttgcccacgccgatcatgtccaggccgaacggctcaggatggcccatatcacgccggaccgcggcccacgagctggactccggatcgccattcgcgaattcgatgaggtccaggtagtcctgaatcacattgttgcggaaggtggccgaattgatatccatgtggcgcggatctcggccgggcgactggcatgcgatgccggcgaacagagtgggcagcggcttggccttgaggtcctcgcacaggcagaaatattcgtagaagccgatctgatagctctgcgaatagctggaaccatccggcatcttgaacgaccacatcgaatactgttggcgtcgcgcggccagggagccgacggtatccttccagcgatactcattgccgggcgtcacaccttcgacgatgcagccgccggggaatcgcagaaacgctggatgcaacgcctgaatggtttccaccagatcgcggcgcagcttgccgtaacgccatttcgggtcgcccgcgccccaatagtccgcatccatgaactgcaccagatccagatcgaacgtggtgcgttcgccggcgtcaatggtgatacgcagcttgccgtaatcggtgttcagtccggttacgtcggcgttgaaccggtaccagccgtcacggccgatggcgatggcaccatccgacgaatccggactgatcgaaacgccggaatcctgcgcatcggccccatcgtcctgcctcagaccggtctcttccgtatcgtcaagcggatcggagtccacgatatacgacaatcgagtgatactggtgagcggcaggccgtacctatcgaccacgccgacggacagctcggcccgcccatgaaccggacgtaccgcgagactgacggaataggtgtggtcggcgacgatggagaacgcgggctcgcccccgttgtcgccgcctccgttatagccgaggttttccagatatgcagggccggtttcggaaggaacatcggacgtgatgcgagcgtatcggctatgtgcgtgaattggcggggcggggcagtcggtggtcacccgctggccgtgaatcccgcgtatctcactgccgaggctggcggcggaacagttgatgaaatcccagaaacgcagggaatcggcctgtgtacgccatcgttcggcgccggccatacgccacgtgtgatggtcgagatagacgccgtcaaaactgtagttgttcaccatgttggcgttcagcccgccatccgcaccatggttgatgtcctcgaagaacacgccgtacagccgcccgcttgtgtgatgggtggggcttcccacgctaatccgcaccatggttttgattgtagagggaatggagcggaaaggtaaacggaagagttcgctcaccgttcatgttgcggtcaatccaagtcgactgttcgccggtatacagccggtaccctcgaaacaggaatggaaaatacggacgactaggagcgcggctgtgcaatcctcggtgggaatacgtgagcgcatcgaccacgtgtatccgtcgctgcgtccggcggagcgcgccgtggcccagtatattcggaatcatatcgaggaggcggccgacctgaccgtcggtcagatggccgacatcgcccacgtcagccagccgacggtgattcggttcgcccgcaagctcggcttcggcggttaccgtgaactgcggtacgtgttgcgcaacccggccgccgaacacaaagtgaccttcaatccgctggccggattcgatctgaatccgtgggatggcgaagatgagattcccggtaaagcggccgatggcgcgaaggcgctgatcgacgagctgcacagtgcgttggaccccaaggcctatcgcaaggcggtcgccctactcgccgaatcggagttcatcgacattttcggcgtggagaattcgttgacaccggcgatggatctgttcaccaagctcggctacctgggactgacatgccgtctcaataccgacgcttacctgcagcagatcggtgccgggcacctgccccacggcgctgtggccgtcgccttctcccattcgggcagttcggcggatacggtcaaagcgttgcgattggcgaagtcgcatggcgcgaaaaccatcgccataaccaatgccatcggcgcgccgctggccagctgggccgacgtgacgttgctgacgggtcgtgattcgcacacgatctatggcaatgcgattttctcgcgcgtggccgataccgcgctcgtggacatgctgtacatgggcgtgattctgtccggctatggccggttctccaccgcgctcgacgaatccggtcgcatgattcgcgaccgcgtattcgagaactgagctgctgctttatcgcgccttgggctgtattgctctggtcgttgctgcttgggttgttgacgatttggtcgttgtcgccctggtcgctaccgtcctgaggcatgtgccagcgaatacgtagtggacttggcgtgcgtatgacgttcgatcttgccgctcaactccagctggtccaagagctgcgtcatctgatccttgttcaggccaagcgctttctgcatggttttacggctgagcttcacaccgcggaacgcgaggaaattgagcgtgaactgttccaacgtttgaggcgacggttccagcgttgccgtatcaagcgggcgggtactggcctgatcgtcaccgtccgggcgttcgccgaatccactgccgagaatcagcgtctgcagtggcgcgcagccgatgatgcgtgcgccggccaaagcatctgcggcgttatccgtcatgcgctgaatcgtggggaatgagtacattttggcatgctgtgcttcgtcagtggtgctgggcgcggcggaagcatcggcatcggtccgatgcgaggacgcggcctcggccgatacagggataggcagtaccattgccaccgaagtggggcccacgcgcagttgcggactgaccgcgctctgcgcgtaggcgtccataatgcgttgaatgccggtaccgcagttctcgcagaggcccaaatcggcgaacaattcagccaaacgcggggtgcgtggctggcatacgccgttgagtagatcgttgatttccaaaccatcggtcaggccgccgagcgacacgatttccaagcgggaatcgaagatattgatcagtgtggggccggagtacgtgtaatcgcgatgttccagtgcgttgaccaatgcttcgcgcagggctatggccgggtattggccggattcgttgatgccgttcagcagggcgctggcttggtcgagctggcgcagtaccgagccggtgaatgtgtgacgttcgcgaatggcgtttttgccattgccctcgaaaatggtggccttgataacgaacgggcattggttggacagcagggtggcaagcgacgattcggtggtgctggtgaaggtgttgttggtgccggtgttggtgatgctgccggcgggggcattaccggcatcggcagagacggatgcagccatgttggtcacaaccgggctttcccaatccttgccttcactggcaaaacgaccctgtgcgtatgtgaaagtgagctcaccgctatcgcctgcgacggtctggcccgatgcggcgtgatctacgttgctctccgttgtccccatatcgccgatggtaccggtgcaagccgacgttacgccgaggtgttttacacccctacggctagacttacacgagtttggccccgtagctcagctggatagagcatgtgacttctaatctcaaggtcgacggttcgagcccgtccggggtcacgatgtaataagcccttggtccctcatcgtttgtgaggggcaggggcttttgaatattatgccggtctgggtccgtctggagcctgaactgtcgaccttgagattagaagtcacatgctcatcaccaccatccgggaacacccttaaggggtgcgtctcctgcataacggctatactctgacttgagatgtgctggataataaccagctatcgcgcgtccgccaatggcgacgaacgagggaagaaggcccgtgccacgagcaatcatcgaggtaagaaacctacgcaaggaataccccgtcgaggatgagacggtggtggcgcttgaccgtgtcaatctcagtatcccgcaaggccagatctgctgcattttcggcgaatccggctccggcaaatccacgctgctcaaccagttggccggcatggagaaaccgacgcgcggcggcgtgagaatcggcggcgtacccgtcagcaaactcgacgagcgtgagctggcggccttccgccagaagcatcttggcttcgtattccagtcgtacaacctgctgcccaatctgaccgcgctcgaaaacgtggcaatgccgctgatgttccgcggcgtgcccaaggaacagcgcgaacgtgcggcgcgtggcgtactcaaacgagtcgggctcggccatcgtctcagccattacccgcgccagatgtcgggaggccaacagcagcgcgtcggcatcgcccgggcgtttgtgaccaagcccgaggtggtgttcgccgatgagccgaccggcaaccttgactctaaaaccaaaaccgaggtcatgacgatgatctgtgcattcgcccatgacttcaaccagaccatcgtgctggtcacacacgatccgcagatggcttcatacgccgaccgcatcgtcaccttgctcgatggccgcatcaccagcgatcggctcaacaccgacctttcccgcccaactgttccgtccacgccgtccgccccaaccacaccaactacaccgtccacgccgtccgcccatagaacccaaggaactgaccgatgaagcacctctcccaccacaccatcgccatcatcgtcgcgttgctctccacgctgtcactggcacttgccgtcatctcccttccgcatcaggcgtacgcggtcgacggcacagacggcacaagcggcacgaacagtacgtctcagggaagcgacggcgattccgcgccgatcgccggaccggtgcccaacatcatcatcaccaacttcgcgtatggaggtgattccgtggccgccggatccaaattcaatctcgacttcaccttccagaacaaggggcaggtggcggtgacgaacatggtcgtcaccgtggacggcggcgagagcttcgccatcgcgggaggcacgaacacgttctacgtcgacgcgctgtgggccggttacgccatgacgcaaagcgtgccgatgcaggcgctcgcctccgcgaaaagcggtgcccagtccgtgaccgtgaacttccgatacgagtatgtggacgccagcgcccgctcctcaagccagtctgacgtcaagatttccgtgccgatcagtcagcctgaccggttcgaaatcagtgatcccgtagtgcccgaccaggtgatcgccggccaggaaaacacggtcacgatggaatatgtgaacaagggcaaaggcgatatcgccaacgtcgaggccacgatggagggcgaaggtttcgatgccacgatgaaaacccagtacgtgggcaatgtggcttccggcgccaccggcacgattggttacgccttcacaccgcacgcgtcaggcgagctgaagaccacgctcaaagtcacgtacgaggattccgacggacagaccaagaccaaggaattcccgctcaccatacccgtaaccgatatgcagccgatggatgattccggcatggccgatccgaacatggaacagaacgccaatcagggattgccggtgctggtgtatgtggtcatcgtcgtgatcgccgtggtcattatcgtggtgattgtgctgctggtgcgtcgccggcgcaagcagaaggccaagaagaacgatattgatgaggactgggatgattggtccgaaggcaaggatgataagaccgataccggcgtgacggatggtgctgcggcagacaccgctcctatcacaccagtcaccccagcctcatcagtcgcaccagccggctcatcccacaaggcctgaaaggcccgaccatgcgattcggcgacatactgcggctctgcagacaaaacctatggcggcgtaaatcccgtacgattctgaccgtgctgggcgttatcgtcggctgctgctcgatcgtgctcatggtctctttgggtcagggcattaacgagcagaacgagaagatgctcaaatcgatgggcgatctgtccatcgtcaccgtgtacaccaacggttatgccggtccgatgggcggtggcggttcgtccgagatgggcgataccaagctcgacgacaaggccgtggaatccttccgcgcgatgagcggcgtatccggcgtgacgccgatgatgaacttcccttataacgtgacggccagagcaggcgcgggcggccgttacatctatgattacgtgcagatcatgggcatcgacatgacccagctcgaccagatgggctacaagctcgtcggtggcgagaaaccggtcaaaaaagaccaggtgcttgccggcgaatggttcgcctatgggttcatggacaccctgaagaacggcgaacaacgcaccagcacacgtggcgatcagtattcctcatgcacgtttaaccaggccaccggccagtgcgaggaagatcaggacgaagatccgttcttcgacccgctcaccacgcaaattagtctgaccaccggcaccaattatcagggcgaccagtacaccatgaacatgtacggcggcggtggcggcacaggcggtgcgggtggcaacaccgcgggtcagtcggaaaacgtcacctttgatgtgcgggcttccggcattgtggcgggcgactacaacaaaggctatgccacctccgacggtctggtcatggatttgcaggcgttgaaggaactggccgccaaagtcgatccagccgccgccaaaaaagccaccgcctataatcaggtgctggtcaaggccgccgacctcaagtccgtgcccgaagtcgaatcacagatcaaagcgttgggctacgagacctcctcctatgaagacatgcgtaagtcgttggaagaacagtcgcgcgcgattcagctgattctgggcggtatcggtgcggtttcgctgttggttgcggccatcggcatcgccaacacaatggttatgtccgtaaccgagcgcacgcgcgagatcggcattatgaaggcgcttggctgctacgttcgtgacattcgcgtcatgtttcttgcggaggccggcgcgatcggattcttcggcggattggtcggctgcgtgctgagcggactgatatcgctgggcatcaacgttgtcggcgcgttgtatgcgggcggcatgagcggcggcatgtctggcggtatggtcagcggtgcaggcgggggctccggcgacggtaccggtggcggaacatctatctggaccatactctggcaggcgatagttggtggcgagaatgtgacccgttattcggtgattccgtggtggctgttcctgttcgtcgtactgttttccacgctgatcggcttgctgttcggcttcggcccggccaataaagccgttaaaatcccggccctagacgccatcaaaaacaacgagtgatcgcctctgtcacctgctccaccgttagtccataacgttcgttcagttcgcccagcggcacgcggtcggtaaattccttggctgcgccgaagttcagcacatgaggattacggctgccgtccgagacatgatgattcgcataatatgcggtcactttctcgccccagccgccttcaagctgcccgtcttcaagggtgatgacctgctggtggccatcacgcaacgactccagtacgtctgaatccagcgacgtgcactggcgcgggtcgataaccgttgccgtgatgccataatcggcagacaatgcggcggccgtctgctccgccaacggatacgcattgcccagtccgataatcgcgacgtgcgagcccgtctgattgacccgccaatccagcatgtgacgcacaccggcacgctgagccgttacgctaacggtcccgcggactgttgcggcagatatgcccccgctggcggagctgacggagactggcagcgaagttgactgggggcggtcagcgatctgcccacccgtcaccggcagcagcgtcgcatcccgttccgccgtcagaatcgcctcgcccggcactcgaatcaccaccggaccagcaggggcgtccgccgaaccggccggcgcggtagcccatgccagatcagccagatagtcgcgagccgaagtcggcaccagcatcgtagcccctggaatattggagaacatcgtcacgtcatacgcgccggaatgcgtattgtccgaaccggacaggccgcccagaaaatcaagtaccgtgactcgcgaacggttcaggctcatctcctggaagaactggtcgtacgcgcgctggaagaaggacgccgtggtggccaccaccggcgtgccacccgcccgtgcgatgccggcagcgtacgccacggcatgcgattcggtgatgcccgtgtctacataatgtgcgcccgcgcgctctcggaactcatgggtgatgccgttcgagcccggcgtggcgggggagatgaccacgagtcccggctcggcggcgaaacgcggttcgagtgcggccatcgccattttgccgtaatgcttgcgcggatcgtccggcttgccgattgcggcatccggattctgccaatgcgaggcctcgcactggccctcatgcggttcatgatcggacaggttgcagtgatccgaatgccacggctcgctgtgcagcacgttgctcgtggggcgcacgccggtgtcggagactgccggatccagctcatggacgttaccggccgaggccgaggatgcgccggccacgtgaccggcgccgtcatatcccgcgcccttcagcgtatgaatatggaccaccaccggatgatcgatatcgcgcacttcctcgaaagctgcgaccagcgcggaaacatcgttgccggcctccacataccgataatccaagccaaacgcgttgaacagattcggctgggcggtgccaccggacgcgcgcaggcgggcgagcggaccgtacatgccaccgaaatcgccggcaatcgacatctcattgtcgttgaacacaatgatgagattgccgccctgctcagccgcgttgttcagtccttcaaacgccacgcccgaactcagcgaaccatcgccgatcacggcgatcacattgccgatgccgctgttcgggccttccatatcgcgggttttcgccaaaccgcaagccaatgaaatcgaggtaccggtgtgaccgagcacgaactggtcgtgtttgctttcgtccggattggtgaagccggtcacctcgctgaaacggtccgggtccagataggcggcggcgcggcccgtgagcattttatgcacgtagctttggtgggatacatcgaacacgatgcggtcacgcggcgaatcgaatacgcggtgcagggccaccgtggcctccaccatgcccagattggagccgatatgaccgccgtgttggtggccatatgccagcagcgtggtgcgaatctcacggcagagttcggcgagctcgttgggggcaagggccttgacatcggccgggctggcaatgcggctcagcagatgggagtcgtcgccatgggaaggggtaatgctcgggggtatgtcgtgaaggcgtgcggtcctctcggcagcgccggagacggcgaaggaatcgcttgaatcaaatccgtttcctgacgcgctgcgcataccctcgaatctcccttcgctagtctttccgaagttgaatgctaacgcccggcattgtccgaggtccacatgacgaagcaatgcccccaacatctccgtaaatgggtgattcgttcgctgcgcgatgtgggacaatgaatgcggtaattccttttgataccaaggagcgcgcaatgaaggccgtatacgcatccaccgtcaaccatgccgatccgcttgccgcgttggcagtgggcgagcagcccgaaccccaggcccgcccgttctggtcgaccgtttcggtgcgcgcggtgaccgtaaaccatcacgacgtctggtcgctacagggtgtgggtctcgccgccgaacagacgccgatgatcctgggcaccgatgccgttggcattctggacgaggacatccccggcaagcatgggctcaaggccggcagcgaagtggtgctgtacacgttcgtcggcaccgatggcgcgggcgtggccccgggcgagcgccgcacgatcctctccgagaaataccccggcacgatggccgagaagacttccgtgccgtccgccaacgtgttcgccaagcccgcaagcctcaccacggctgaggcggccgcactcggcaccagctggctgaccgcctactcgctgttgttcgatgccgccggcatcaagccgggcgactccgtgctcattcagggcgcgggcggcggcgtgtccactgcggccatccagctcgcccatgccgccggtctggaggtgttcgtcacctcacgcgacgcggacaagcgctccaaggcgctgaaacttggcgcgaacgccgcgctggagatcggtgcccgcctgccgcgcaaggtcgatgcggtgatcgaatccgtgggcgcggccacatggggccattcggtgcggtcggtgcgtcccggcggcaccatcgccatctgcggcgccaccaccggcgaccagcccggtgcggagctcacgcgactgttcttccaggacattcgcgtgcagggctgcaccatgggttcgcgcgaggatttcgcccggctgctgcgcttcgtggagcacgccgacctgcatccggtgatcgattccgtggtcagcgggctggacgccgcccccgaggcgttcgccagaatgatcgccggcgacatgttcggcaagatcgttattgagctgtaagcctcacagaattatgtattgagaacgattcgctgcgtggcttaactccgctatcaggagtacagtgggccttattctcaataactagggagtaaatgataatggcaaatgaatccaagcccgaagtcgcggtggtcatgggatcggccagcgactgggagaccatgaagcgcgcctgcgatattctcgaccagttcggcgtcgcctaccacaagcaggtcatctccgcgcaccgcacgcccgagctcatggccgagttcgcgcacaacgcccgcgccaatggcctgaaggtcattatcgccggtgccggcggtgccgcccacctgccgggcatgatcgccgcgcagaccacactgcccgtaatcggcgtgcccgtgcgctcccacgccctgtccggctgggattcgctgctgtccatcgtgcagatgcctggcggcatcccggtggccaccaccgccgtcggcaactccggtgccaccaacgccggcctgctcgccgtgcagatgctctccgccttcgagcccgaactggccgacaagcttgaggattaccgtaacgaactgaaggaaaaggtggccgaatccaatgcccagcttgtctgaagaaacgggcggccgcgtctccatgctgatgccgggctcgaccatcggcatcatcggcggcggccagctcggccgcatgatggctctgtccgcccgctacatgggcttccgcgtcggcgtgcttgacccaacgccgaactgcccgaccggtcaggtggccgacttccagatcaccgccgagtacgatgacaaaaccgccatccatgatctggccgtgcagtccgacgtgctcacctacgagttcgagaacgtggacgccggcgccatcgacgaggtgcgcggcatcaccgccaccccgcagggcaccgacttgctgcgcgtgacccagcaccgcgtgcgcgagaagcagttcatcaacgaccacggcaccgccaccgcaccgtggcgcgctgtcaacaacttcgatgagcttgacgccgcattgggtgatattcattatccggccgtgctgaagaccgtgtccggcggctacgacggccacggtcagctcgtgctgcgttccgacgccgacttggagaagatccgctcccgctccgaccgtggtggtggcttcccgccgagcatcctggaaggcttcgtcgacttcgcattcgaggcttcgattctggtctccggcaacggcaaggacttcgtcaccttcccgattgtgcgtaacgagcaccgcaacaacatcctgcatatgaccatcgcccccgccgaggtgtccgaacatgtggctcgcgaagcgcatgaactggcgattcgcctggccaagggcttcgaactggctggcacgctggccatcgaactgttcatcaccaaggacgatcaggtcatcgtcaacgagctcgccccgcgcccgcacaactccggccactacaccatcgaggcctgctcgatggaccagttcgacgcccacatccgcggcatcgccggctggcccctgcccaagcccaagctgctctcgccggccgtgatggtcaacgtacttggccagcatgtggaaccgacgcgcgcgctgatcgccacccacccggagtggaatgtgcacgactacggcaaggccgaagtgcgccacgaccgcaagatgggccacatcaccgtgctcaccgacgacccggccaagacggtcgctgaccttgaggccaccggctgctgggacgacctgaaaaagaaggcgtgaccttaccgatggttgaacatatcgaacgccagaccaagcagaaggacgcgattcgcgccgccttggccgactgcgaggagttcatctccgctcaggacctgcaccgcaggctggaggacgaaggctcgaaaatcggcttggccaccgtataccgccagctcaacgccttggccgatgccggtgccgccgacacgatccgcctggacggccagcagctgttccgcctatgcggcgacgacggacatcaccaccacttggtgtgcaggcggtgcggcaaaaccgtggaaatcgacccgcccagcgaggcttggctgcgcaaagtggccgacggccacggcttcaccgttgaatcccacaccttggaggtcttcggactgtgctctgattgccaaaaggagcagaaagcgcagaaggctcagaaagcagtgagcgaataacaaatgggatcggcttcaaagccgatcccatttgttattccgctgctattccactgacttcagcgcgccgagcatgctgtttctttgaggtcgtgttctgcacgatgcctttcacgccgtccagcttcatgagcttggcgctgcgcgactccacattggaggtctcgtggttcttgagccgcaccatataggcgttcgactggtgctgctcgccgaacacgtgcttatagccacccgaagtcatgaacatgaaatgcccgaagtagggaagccggcttgtcacgcagcttgcgtttggccgctacccaggccggtaccacggtgctcgcccaggccagcaggaacgccgccagggtgatggcagggtggaacgccagcatgacacgccgatgtaaatgcaaatgataataattctcaatacatgttattctgtcgtgttggtggctgggcgatgatgcagcaacagcagcatcgcccagccgttcggctaattagagaggaaaacccaatcatgtccatcatgtccaacgccaagcgcgcgctcgccatcgcggccgccgcggcgaccctgctctcgatggccgcctgcggttccagcaacgccgccagcggcaagtccgattccagcggcgccgcgtcttccggcaagatcgaggtcgtcgcctccatcaaccagtggggttccgtggccgaagacctcggcggcagcaacgtcgaagtcaccaacatcatgaccaagaccaacgtcgaggcgcacgattacgagcccaccagccaggatgtcgccaagttcggcaccgccaaggtagccgtagtcaacggcgccgattacgacccgtgggccaccaaggccgcccagccgaccaaggccacgctggtcaccgccgccgaaaccgccggcatcaaggaaggcgacaacccgcacgtctggttctccgccaaggtgcgttccaacaccgccgacgccatcaccgccgcctaccagaaggccgacccgagccacaaggacgactacgccaagctcaacaaagaatggcacgccaaggaagaccagcttgagtccaagatcaaggagacttccgccaagaccgagggcctgccgtacgccgccaccgaatccgtggcctggtacctggccgacgacctcaagatgaccgacgccactccgaagggctacgcccaggcctccgccaacgagagcgagccgaccccggccgacatcaaggacttccaggacaccctgaaggccggcttcatcaagatgttcgtcttcaacagccaggaagcaaactccactactgaccagatcaccggtgccgccaaggacgccaacgtgccgatcgtggagctcgccgagcagatgccgaagcagtacaccaacctgctcgactggatgagcgcactggtcgaccagttcgccgccgccgtgaagtaatgcggcagtagccgtcaatccgcaacagcgataaggggaataatcaagtcagatagcgaggcgttgtctaggggagaacagaacacttcgctatcagggataggctccttatatatcagggtgcttcggggatgtcccgaggcaccctttgcgttagggtgaatagttaggaaacggtaagaaaaatagtggaactatggattttccaaggttcagcggcaacaatatgcccttgaaaagtcacatacggaaacaggcgaatgagcgagaacactagtaataccaccacagtgaaaccccatttcaagctttgggccaaaaaggtcgaagccaatgaagtcacgccccaacacccccacaagcccttccccggctgggtgtacggcgtgctcttcgttatcttcgacatcattgtcgtgacggcgctcgaagtgggcgtttcgtccagctccacccgtgtgcagctgtccagtccgatcgtcggattcggcttcgtgagcaagatgtggaccgacggcaatttcgtattcgtgctcaacgtgatacttgtcgcgttgctgtacctcatgttgctgatgctgttcaaccggttctggacggcaagcatcgtgattctcgcggtcggaatcatcgtggccgccatcgaacatttcaaggtcgagatccgttacgaggccattctgcccgccgatctaggcttccttggctcgaacaccggcaacatgctcaccttcattccggccggtgcgcatgtgaccatcctcgtggcactcggcgcgttcgccgtactgctcgcgctgattctggtgctgcgtcatttcgatgggcgcaaaggtcgcatgattcgtacggataacctgagcctgaacctcacctcccgtctgattcttctgctgctgccgattctggtgttcgcgttgtactgcattcatgtgagcaccaccgattcgctggccaacaagttctcccgcgccttgggagacacgccatccatgtgggattccgtgtatgacgcgcagcgcaatggtccgctcgtggccttcacccgccagctcaacccgaagatcatggacaagccgagcaactactccgaggagaccatgaagaaggtcgccgctcgctatcagaaggaagcggagacaatcaacgcctcccgcaccaacaacctcactgattcgacagtggtgtacgtgttgtccgaatccttctctgacccgagccgcgtgccgggactgaagaccaataaggattcgatgcccaacatccgcaagatcaaggcgggcaccacctccggcctgatgctctcctccggctacggcggaggtacggccaatctcgaatacatgggactttccggcctgagcatggccaatttcgagtcctccctgtccagcccgtaccagcagctggtcccgagccagcattggactcccaccatcaaccagctgtggggcgcgcccgtcaactcgctcggctaccacccgtacgaatccagcatgtactcgcgtgccacgaactacaagaagttcggcttctcgcacttctacacgttgaccggtccggacgtgatcaagtatcaggacaagatcgacgagtcgccgtacgtctctgataagtcttcctatgattctgcgttggaaggcatcaagtccggcaagacgaacaagttcattcagatcattaccatgcagaatcacatgccctaccacgagtggtatgagaataacgactacaccgccgaatccaccacgggtacgccgctgggtgatgatgaacagcagtcgattgagacctatcaaaagggtgtggagattaccgatcaggccactcaggagttcctgaatgaactggatgcgctggataagcccgtcaccgtggtgttctatggcgaccacttgccgggcatctactcgtccgccagcgaggatgacaacaactccttggccctgcacctgaccgattacttcatctggtcgaataaggcttccagctcccaaggcaataaggcaagcgatgcagcctactcctcgccgaacttcttcgtggcgcaggccgccgatcacatgaacgccaaggtcagcccgtatctggcgttcctgaccgaaatgcattccaagatcgccgccatggaaccgcctgtggtcaacaagatccaaggctgggatcgtatccccgaaggccagaacatctatcttgatcagaacggcaacccgatgtccaccgatgacttcgacaaggaaaccaagcagttgcttgccgactacaagctcatccaatacgacatcaccgccggcaaaaactacctcaaagacacggactttatgacgctgccgtaaagcagacagcctagtaggctgtctgtaggcagcgtgcgatccgacagacgagccagcaaggcgcggggcgtagcccgtccaaaattgcagtagcgctgccgtaaagcagggggtgctttcatgacgaaccagactttcgaacaactgaagaagacttacgaatccggtcgtacccggccgctggcatggcgccgcgcgcagctgaacgcactacgccgtctggttacggagaaccgtgatgcctttgtctcctcggctatggctgacttgggcaagcccgcggctgaaaccgtgctcatggaactgaacctggtggctggtgaagcacagttcgtgcgcaatcgtctgagcctttggaccgcccggcatcccaaagcgatgcattggatgttgcagccggctgccggatggacgattgccgagcccaaaggcgtggtgctcatcatttcaccgtggaattatccggtgctgctggccttggaaccaatggctgatgcgctcgctgccggtaacgccgtctgcttgaaaccgtccgagctttcaccgaatacgtccaagctccttgctgagttggtgccgcaataccttgactccgaggccgtgcgcgtggtcgaaggcgggcccaagaaaaccggcgaactgctgaaatgcccgttcaaccacatcttctataccggtggcggccacgtcggcaaaatcgtcatgcgcgcggcggccgagcatctgacgccggtcacgctggaactcggcggcaagtcgccatgctttgtggatcgcactgcggacatcaatgtggctgcacgccgcattgcgtggggcaaattcaccaatgccgggcagacttgcgtggcacccgactatgtgctcgccacgccggatgtggccgaggctctggccgagcgcatcgccgtagccatcaccgaattctatggcgaagatccgaaggcctcgcctgattttggtcgtattatcaacgatcgtcattttgaacgactgtgcaagctattgccggtcggcaccgtgccgcctgaggagccgagctcgccgctggtgcaggtggcatcggcggtaggcgcggccatggatatggttgggcggcgcttcaatgccgtgactactgggcgcggtggcgcgggggagatggccggcagcgcgaacaatgcggcgaagccgacggccggttcgaatatggcagccgctgatgatggtgcgattgcctcggccgctgttgagccgagcgagattcacaaggtgcccggcgtgttcgacctggccggtcgaatcgtttgcggcggcaaggtcgatcgtgccgcccggtatatcgcgcctaccgtgctgtacggtacgtcgccagatgcgccagtaatgaaggaggagattttcgggccgattctgccgattctggtggtcgaggatgccgagtccgcaatccgattcatcaacaagcggtcccggccgttggctgcatatgtgttctcgcgcgatcacgaggttcggctgactttcgaacgtcagaccagctccggagccttgggatattcgctgccgttgggccatctgctgtccagccggttgccgttcggtggcgtgggcgcgtccggcatcggcacctaccacggcaaagcaggcttcctcaccttcagccacgtcaaaaccgtggttaccaagccgcagttccccgacactctgcgcctcgtgtacccgcccttcaatgaagccaaggccaaactgttcgacatcatcgccaaattcagctagcgtgatatcgctcgctgatattgggtgatggcgttgtcatagtgacgttcgctgtcccggtaattacgtcaatcgattgattcgtgtaccgggccagatttttctgtcctagtatttgatttcgggtcatttttgcttaccgggacaaaactgacgccgaaagtatcgtccgcgtattacgaaaatggcggaatagtgcggtttcgtatggaagggaatttcaaatattcctatattcgaggggttcagctgtcctggtttgcgaaaaagagccgaaatcggctaccgggacagaaaaatctggcccggtagccacgtcaatcgattgacatgtctgccaggccaaaaatatgcagcagatgcgccgcttctgttacttcagggctttgaagccgatgtcgtggcggtaaaacagtccgcgcagctcgagcttgtcgatgattgcgtagaccttgtcctgggcggacttgatgtccggagcggaggtttcgacgagcagcacgcggccagagttggccacaaggttaccgtgctcgtcagaggcgacaccggcgtagtagacgtgcgaatcctcgtcgacttcgatttcgggcacacgggcacccttgatgacgttctccgggtagccgttggaggcgatgaccacgccgagggtggcgttggactcatcccaggtgaattcgggggtttcgccgtcgagaatggcggagatgccggcaccgaggtcggaggtgagcttcgggagcacgacttcggtttccgggtcgccgaagcgggcgttgaattcgatgaccttcgggccgtcggcggtggcgatcagaccggcgtacaggatgccggtgaatggcgtaccttcctcggccatgccttcgacggtggggcgcacgattttctcgatggcctcgtcgaccacggactgcggaatctgcggcaccgggctgtaggcacccatgccaccggtgttcggaccctcgtcgccatcgtgggcgcgcttgtgatcctgggagatgggcatcggccagaaatcggtgccgttgacaaagctcatcagggagaattcctggccgtccaggaagtcttcgataacgaccttggcaccggcggagccgaagcgatggtcgatgaagatgtcttcaagcgcacgctgggcggtgtgctcgtccatggccacggtcacgcccttgcctgccgccagaccgtcggccttgatgacaatcggggcaccgtgctcgtgtacgtagtcctgcgccatctcgagatcgctgaaggtcttgtattgggcggtcgggatgttgtgtcggtccatgagctgcttggcgaagtccttggagccttcaatctgggcggcggccttggacgggccgaacgccttgatgccggcggcggcgaaatcgtccacgatgccttcgatcagcgggacttccgggcctacgaacacccagtcataaccattgttcttcacgaattcgataagtgcggcgtgattcgactggctcagctgcgtggtgtggatgccgtccttgagcatgcccgggttgccgggagccacggtgacttcgtcgatgctcggtgccttgagcagcgtgtaggcaatggtgtgctcgcgcgcgccggagccgataaccaatactttctgacccatgttgttcctttcctgcggaaagcgagttacttcagtacgatttgcgtgccggtggtgtcggcggtgatggagccgagcacgtaggcgggctcgttgttgtcggcgagcagcttcagcgcctcgtccttacgagcggggtcgatggccagcaccatgccgatgcccatgttgaagatgttgtacatctccttatgatcgatgttgccggccttctccagcacgtcgaagatcgggagcacgggccaggtgccgagctcgatttcggcggccaagccgtccggaatcatgcgcgggatgttctcgatgaagccgccgccggtgatgtgggccacgcccttgactacgcccgccttgaacaggggagagagggccttgacgtagatcttggtgggggtgagcagcacgtcgccgagcttttcgccgcccagctcgtcgagttcggtgtccacggtgtagccggcctgctcgaacagggccttgcgcaccagggagaagccattggagtgtacgccggtggagggcaggccgatgagcacgtcgccttcagcgatggtggaaccgtccacgatggcggacttttcggcaacgccgaccgagaatccggcgagatcgtattcgtcttcgtcgtacatgcccggcatttcggcggtttcgccgccgaccagcgcggaaccggcctgtacacagccgtcggccacaccggccacgacctgctcaagcagtgccgggtcgttcttgccgcaggcgatgtagtcaaggaagaacaacggctcggcgccctgggcggcgatgtcgttgacgcacatggccacgcagtcgatgccgatggtgtcgtgcttattggccagcttggcgaccatgagcttggtgcccacgccgtcggtgccggagatgagaaccggctccttgtagcccaaggaggccagatcgaacaggccgccgaagccgccgatgccgccgaccacgccggggcggttcgtgcgggccacgtgcgacttgatgcgcttgacgacttcgtacccggcttcgacgctcacgccggcgttctcatatgcttttggcatttggttggcctttctacttattttggctcccctctggaggggagctgtcggcaaagccgactgaggggaggcaagcgcctctggttcaaagaattgttattgagtggattggtggtgagctattcggcatccggctgcacggtgttgtactcgttgccgatgtacttgctcttgtacagcgcgaattcaggcagacgcacacggtcctcgggcgtgagggacttcaggaagtcggcctcgtagtcgtcgagcgcagtggggtagtcgccgttgaagtaggcgacgcacaggccaccgtatggggcgtcggcgttcagtccgatggattcgaccagaccgtcgagcgaaaggtaggccaaggaatccgcgccgatgtattcacggatttcctccacgctcatcttggctgcgatgagttccttggtggtggagatatcgatgccatagaagcaggggtacttcagcggcggggagctgatgcgcatatgcacttcagcggcgccggcttccttgagcagctgcacgatgcgcttggacgtggtgccgcgcacgatggaatcatcgatgacgataacgcgcttgcctttaaccacgctgcgcacagcagagagcttcatacgcacaccctgctcgcgcagttcttgcgtgggctgaatgaaggtgcgggccacatactggtttttgattagacccatttcgttgggcaggcctgctgcttccgcatagccggatgcggcggacaatgaggagttcggcacgccgataaccatatcggcctccaccggggattcggcggcgagacgtgcgcccatgcgcttgcgggcggagtgcacgttgacgccatagatatcggaatccgggcgggcgaagtagatgtactccatcgagcagatggccagctgcgtgttgttggtgtactgcacgatcttgtagccgtgatcgttgaccaccacgatttcacccgggcgaatgttgcgcaccagctcggcgccgacgacatccagtgcgcaggtttcggaggcgagcacgtaggcgccgttcttcatcttgccgagggagagcgggcggaagccgttcgggtcgagtgcgccgatcatggcgtcttcggtcatcagcaggtaggcgaaaccgccatgcaccgtgttgagcgcttccttgagcttgtccataaaggtgcgctgcatcgaacggcgaatcaagtgcatcagcacttcggtgtcggagttcgaatggaagatggcgccttcgtcttcaagcttgcggcgcagtgacgggcagttcgtcaggttgccgttatggcacagagccacgtcgccgtcatggaagcggaagatgaacggctggatgttgtccgtggtgcccgagccggccgttgcgtaacgcacgtggccgatggcgcaattgcccttcagtcgttcgatttcgcgctcatcgccgaacacctgggtgagcaggccgagtccgcgatgaccgatgagatgaccgttatcgttggagacgatgccggcaccttcctgaccgcgatgctgcagcgcgtgcaggccaaaataggtgagtcgtgaggcgtcggggtggccccatacgccgaagatgccacattcctcgtgaatgtcttcgagttcagccgacaagccaaagctcctttttcaaacaggggattaactatctatcaaccctaccaatcggcggctacatcgcgtgttgtggggtggtggaacttgttggggtttgcggacgcggtttaagcaccagatcagtcaagtatgaatagtggcttaggattttggcctttcgctgtttgtggtgggtggttgtggtgtggggtgatgccgacgggtaggttggaagcatggatacctcttacctgttcaccgccgcattacctggtgctccactttgtgctcaagcgtgataccgaattgtcggtgtgacgtgatcggttgactttcgtcaacgcaatttgaaaggctccgacggtattatccgtcggagcctttcgtcgtatgaatccggtgcttgtttttcggcttcgtctcagtgcctgaaatggctgaagaactcgatggtctcgggatcctgcgactcgtccatcacctcagcgggtgtgccgttctcggcgatgacgccgtgacggagcagtacgatgcggtcggccgcttcgtgggcgaagctcatttcgtgcgtggccatgaggattgtggtgccttgggcctttaactcggcaaccatgttgagcacttcgccgaccagcatcggatcaagagcggatgtgatctcgtcaagcagcagcagttccgggtcggtcatcagtgcgcgcgcaatcgccacgcgctgctgctggccgccagagagctgatcggggtaggcactggctttatcgcgcatgccgatgcgttcaagcagttccatagcgcgggtttcggcgcgatccttgctccagtggtgaaccttgattgcggcaagggtcacgttcctgagcaccgacatgtgggggaagaggttgaactgctggaacaccacgccgatacgtgcgcgaatcttgtcctggtcggcacgcgggtcggtgatatcggtattgcccagccaaatctggccgtcatcgacctgttcaagcaggttgacgcatttcatcaatgtggatttgcctgaaccggaaggccccagcaaagccaccacctcatgttggtgaatgtcaaaggaaatgccacgcagcacctgcgtgtttccaaaggatttgcgcacgtcatcaagacgcagcaccgtcttgttgctcacgggggagtcactcgcctcggtggtgatattggtcatttcgctcataccgttcctccgctgagttcgcgcttacgcagacgttccgtgtaccagtcgttcagcaggatgaacggcacgctcatcaggatgaacagcaggctggcgaccacatacggcgtgaagttgtaggtgctggccacgtcgatctgtgcggcgcgcacggcatccaccgcacccagcacggaaatcaggccgacgtccttttgcatggagatgaagtcattcatcagtgcgggcgccactttgcgcaatgcctgaggaatgacgatcagtcgggtcgtctggccggaggtcaggcccaacgagcgggccgaggctcgctgagaaggatgtacgtcgttaaaaccggcacgcagcacctcggagacataggcgctgtatcccattaccactgcaatggtgccgagtaccgagggatcgatacggccgaacaagcctaggccgggaatgccgaaaccgattagatacagcacgacgataataggcacgccgcgcatcacagtcgtgtagatcaatgccaggatacgcagcgggaacagaataggggagcggctggtgcgcaccagcgcgatcagcgtgctcagaatcgccacgccgaccactgcgacgagcagaacgcggatgttgagccataggccgtcaagcacatggggaaacgatttgacgaagtattcgccggagaagaaggtctccttgactcgtggccagccgggggagagcttcaagccgatgacgatgaccaccacgaacacaatggtgctgatcagactggtaatcgtcgattgaatttgctgatgaacacgatattggcgtcgttcgagctcgacctgacttacctcgtgtccgtcaggggcattgtgctgcctggtttcggttggtgctgcggtcatgtgatgaatgtcgctcgcttcctgaatgccgggatggccgggtgccacaggaaaattcccgcagcgcccggccaaggtgttgtgaccttatgatgtaagcctacttcacttacttcttcagttcggtcaggtcggtggtgtactcggccagccacttgtcctgaagcttcttgatggtgccgtcggcgttcaggtcatccactgccttggtcacggctgcagtcagcttggaatccttcggcagcacgatgcccatgccgctcttgtcttcggagtcaggcagacggccgagcaccttggcgtccttgacctgctcggactgcaccatgtacacgcattccacggtgctggtgaccagtgcgtcgatctgaccggcgtcaagtgcctgagccagtgcggcatcatcattgaacgtctggatgtcgtccttgatgttcgccttggcgtagtcgtaggcaagggtgccgaccatgacgcccacggtcgcatccttcagatcggataccttggtggcgttggcgaacttgctgtctttcttgaccacgacggactggctgtcgttgtagtagctggacgagaagtcaacggccttcttgcgctcgtcggtgatgccgaactgctggatgttgaaatcccagtccttggcgccgggagcgatggcggtgtcgaatgcggtgcgggtccacaccacgtcgctcttcttgaaaccgagcttgtcggccactgcgtaggcgacggccgcctcgtagccctcaccgctttccggcttgtcgttcataacccacggctcgtaggccggctgtccggtggcgatggtcagcttgcccggcttgtacgtctgctgggtgatgtcgtccgaatcggtggaattggatgcggtggactggccggaaccgcaggctgcggtgaacgacagagccaggatgctgacggtggccgcaatggtacggacgatgtgtcgcttattgaacatgggtttcctctcctcaagtgttcgtcatgcacacggttcaaaccgtgcttgatgcattcgcgccaattgtatggctattgggttacaaaacatcgatattttcggatgctggctatcgccattgcttatggccgactagagccgcgcaatctggcgcgtaagcggacggatatctcatattggcgcagagcgaaatggcgttcactgttcgagtgtgaagccgtcgaatacgaatcccggactgaccacacaggagaccagcgcatcgccctggcctggcactgtgcgctgccagacgccagccggtacgaccgcatgtcccgatacggttacgtcggcctgatcggtggtgatgccggaacccaaggtgattacggttcgcttggattcgtcggattccggagtctcgtcgctgccgccgagctccagtttgaccgatgccgggccatgccacagccagacctcatccgcatcgaccttatgccaggcgctggcatctccctcgggcagcaggaagtaaatcagtgacgatagcggtcggcttgaggcctcatccgtgtgcggggattgccagtcacgcgtgtaccagccgccttcggggtgggtttccagtccaaggcgttccactatggaccgggcgtatggactcatgtcttgcaaagcgacgctcataatgagatctcctgttcttggcgggtttgctggtttttggcttcttgatatcaggtcaggtcagcggtgtcaccaggcgttgttgtaggcttcgcgcccggatatcaccgtggctcggttcgtgcctgcgccgtgcctcaccagtgtttccagcgtttcttcgatgccggccggagatgatgtgtcgacggggatgtcgaagaacgcgaaatcagccaatgcgcccgcgttgatttgtccaatgcggttgcggcccacgtgcatgcccatggaggcggcgccgcccagcgtcatcatacgaatcaggcgatgtgtcagatcgtcgctggcatagccttgttcgcgggccaggtcgtaaagcatcgacacatcatcaagcagatcgagggtcggcgtgctggagagcgaatcggtgcccacgcttaccagattgccttcctcgaggtattcgcgcaccggtgcatctttgccggtgttggtaatgcgattcgatcgggggcacaaggccacgcccacgccgcgctgacgtagaatacgccgatcctcgccattggcccacacgccgtgtgcaatgtgcacatccggtccaagcgagccaagctgatcgacgaactggatggcggaggcgcctttgcccacttccttgagctgccggtagctttcccaatcgtggtcactccagtcggccgccgaataagtggtgagcaccggcggataagtgccggcctcgagcggggtctccgccagatggatatgcagtcgcatgttcagctgacgagcaatgtctggaagatcaacgaacggttcggactccagcgtatacggagcatgcgggctgatgccgaggtttggcagctgctcctcgttcatccggcgcaactgccggatgagctcagtgcggcccttttccatccattcggcgttgtgccagcccattacctcccaataagcgatgccgtgcatgccctgcgaagccagcgcgccggcggcgtccaaatcggtgacgatgtctgcggcggccgtcgttcccgattcgaccatctggcgagcgccgtcctcggcccactgcttccatggctgggtcttctgcgcctcggcgtacacctcgttgaatgccagttcccaggcgcggaaccgatcgtaggtgccttgcccgacctgcaccatgccgctgtactgcagatgagtgtgcgcgttgatcaatccgggggtgagcaccccatcccaatgccgttcatggatggtgccgtgagccgtcatttcctgcttcagcgccttcagcacccagcggcgtttacctacatgaaccacgcggtcgccatgtatggcaactgcgccatcgatgatgacggggcccgtcacggggatgatgagtttggcggaatacagtgtcacatcatcgataagctcggtatcgacggtcggccaggtgttgtcggtcatattctcctcgctgcgttgtgctcggtgccgtgtctatggctatcggtcggcgttctctcggtcgttttccgcgaatctggtcagtcgccaattgtagccgttgtcctccacggcatggctggctcggtatccgcgcgccttgagcgcgctggcggcgatgcgctggtcggtcgctgcgtcaagtctgataagcgtgtgatccagtgtgcctcgatgttccagaagatatgcgacggcgctggcctgtacggcgaagctcagatccatgatctcgattggattgccgcctcccaccgtgtagttcacgccatcgccgtcggcgattagcgtgagcgttggtccgtcgggaacattgagttgcacggtgtccctgttgacctgtggggtgaagtcgcttacctcgtccaaggcgatttcgttggcgatgccgccgatcactgcgagcgccgcgccctcgtgcattgcgcgcatgtgctcaagtgtgaccgtatgtctcacgccagtggcggacaccaccatatccgcgcaagggagtgcctcgtcaatgtcttgtgcggcgaagccgtcgaacaccgctttgagtgaagccactggatcgatatcgcagatggtgacttcggcgccaagcgcgcgaatgcgccgtgcgaagccttggccgaccgggccgtagccgatgacggtgacgttcttaccgtcgaatgcatgctcgccgagaatgcgctgcatggtggtcacgcatgtctccccagtgccgtgggcgttgtcgaatccggttttcagcacactgtcgttaacggctacgaccgggtaggtgagggctcccgcttcctgcatctgctggaacgcgcgtacgccgctggtcgtttcctcggccactccaatgaggttcgccgtgagttcggggcgttcgagcgaagcgagacgggcgaagttggcaccatcgtcgatgatgatgtccggctgtatttcgtccagcaggtgcagggccgcctcgtgcgcctgttccgcggtccagtctcggctggattcgaccgtgattccttcccggcgcagctgttccgccactcggggatccgtggaatccgggccgcaatatacgccgacgattgcgccggcggccttaagcttgcgcagcagaatcgcggtctttggctccagtatcagacagacggcaatacgaatgcctgagaaatcgacgcgagtggtgaggctatccatggtgtcgcgtaataccggcatgtgctgttccgcgtactccattgcctccagtccgcttgccttgcgcatatcggtgatggaatcgatgctttgtgtgccgtcgcataggaattcctcgttgtgctcgtcggtcatcgtggcatcttcgacggtcatgccccattgctgggcctgagacttgatttcggcatgcttctgtggctccggaatcgcgagtcgggctcctgccagtgatcgattcgtcttctgggatcgggctgccgcccacgctgcaaaatcgctgtctgctgtaatgcttttcttcatattccccatggtacgcatgcatgccgctgctccgccgctgcgcgtgtggcgtgggtgaagagcgtgcttgggcgcgttgcgtgcgtcgacttcggcagcttcaaacaggcatgttgcatcgaacaaatgttcgactgtgttgatatgctggtcgggccagcggtggtaaggaggtgatggcgatgggcagcggaacggtatcgacgcaacgcgagcatacctatattgccattgatctcaagtccttctatgcctcggtggagtgcgtggctcgtgggctcgacccgttgaccacgcatctggtggtggccgatgaaacccgcaccgataagacaatatgtttggcggtctcaccctcgctgaagaactatggcattcctggccgtgcgcggctgtttgaggtaaaacagcgcctgaatggagtcaacatcgagcgcgcggtccatgctcccggcggccgattaatcggggagtcctgcgatgcgtgcgacctggaacgctcgccggggctcaaagcctcgatggtcatcgccaagccgcgcatggcgcactatctggaaatcagcgggcaaatatatggcatctacctcaaatacgccgcacccgagcacatccatgtctactcgattgacgaggtgttcatcgacgccacgccatatctgcgctcgctgggtatggggccgcatgcgatggcgcgaaccatcgtgcgcgaaatcctcaccaaaaccggcatcaccgccactgccggcatcggctccaacatgtatctggccaaagtcgccatggatatcgtcgccaagcacatgcccgccgacaaggacggcgtgcgcgtggccgaactgaatgaaatgtcatatcgtcggctgctttgggatcatcgtccgctcaccgatttttggcgggttgggcgcggctatgccaagaagctcgagcatgccggactgatgaccatgggcgatatcgcccgatgctcggtgggtcgtgcttcggattactacaacgaagacctgctgtatcgcatgttcggtgtcaatgccgaactgctcatcgaccatgcgtggggctgggagccgtgcgaaatcgcggatatccgatcctatgagccaggtgcgcacagcattagcagtgggcaggtgctcaccggccccgccgactatgccacggcccggctgatcaccaaggagatggctgatgcgctggccctcgatctggtcgataaaagcgtgctgacgaaccgactgacgctcgccgtcggctatgacatcggcagtcttgattcgtcaaagctcgattcgtgcgctgattatgcgatgaaacgtgccgctgagcgggcggcgaaaagctatcaagggccggtgaccatcgaccgatttgggcgcaaggtgcccaagagcgcggtcgggtcgattggtttgggtgatttcacctcgtcgtcggcacgtattcgtgaggctatgacgatgttgtacgagcgcattgtggattcacgcttgcttgtgaggcggttgaccgtcatcgccgatgatgtggccactccggaggagctggccgccggcaaacgctatgaacagctcgacttgttcggtgatgacggggcccaatcgtatggatccgattccaccagcgaaaaagatggagagcatgatatccagcgtgcgctgctggatgtgaaacgtaaattcggccgcaacgccgtcatcaaagccatggacatggaagacggtgccaccggtcaggaccgcaaccgtcagatcggaggccatcgcgcatgaccctgcaagagacccgtgcgtacgacgacatcatcaacctgccacaccatcagtcgcgcaagcatccgcacatgtcccgccaccagcgggccgcgcagttcatgccgttcgcggccctgaccggctacaaccaagtcatcgagcaaacagcaaaaaacgccgaaaccgccatcgctcaggccgaagcccaaggcgataccgatttcggcgcttgacaatcgctctcgttggaggaagtctcagattcgtcagcctacgtgacgttcgaagcggtggaagccggtgatcttgtcgatttcggccatcgcgtcagccggaatcacaaagcccgcggccttcatgttgttctccagttggctgggcttggaggcgccggcgatcacacagctgatctccgggtgctgcaggatccatgccatggaaagcaccggcaggttcgtgccgagctcgtcggccaccttgcgcagctgctcgaccttgtcgaggttctcatcggtcagcagatcgttgatctggtggtcggactgccaggtggcgcgcgagccggccggcagcggctggcccttgcggtacttgccggtcagcagaccctgcgcgagcggggagaacgtggtgatgccgatgccgagcttgcggcaggtgcccatgatctcatgctcgatgtaacggtcgtttaggttgtactgcggctgaaccacggtgatcgggtacaggttgtagcggtcgatgatgcgctgggcctcttcaaggcgagccgaaccccactcctcggaaacgccatagtacagcaccttgccttgggcgaccaggtcgctcatcgcgcgcaaggtctcggtaaggtcggtggtctcgtcaaaacggtggcagaagtacatgtccagataatcggtctgcatgttcttcagcgtctggtcgatgctctcgaaaatgtgcttgcgggacaggccgcggtcgttcacgccttcgccggtggggaagtagaccttgctggaaatgaccagttccttacgcgggtactgcttcagcgtcttgccgaggaagcgttcggccgcgccgccagaataggcgtccgcgcagtcgaagaagttgacgccggaatcgtaggcgagcttcacggtctccttggccacgtcctcagccgccgtgcccttgagatccgtgacccagctgcccagtgcgacctcgctgatcttcagtcccgacttgccaacgctgcgatacttcatgtgtgctccttgataatcaatcgtcaccgtcgtctcttcatggccggccgtgaacgctaacaattcttattgaaacagttcaaccccacttgaacgcaagttggcggctattgcgacacgccggtggtgacttcgcgggcgcaacgaatgaaatcatcaatgacgctccaccgatacgatgtggccggaacgccgaactgaatggcatatgcggtatccgggccgcaatccagcacgcgcaaagtacgcaaccgttcgccgtcaagcagcgctggcaggaaccgctccgggcataggcaggcacccatgccgtaatggcacagttccagcagagtcagtacgttatccgaacgggctgtgactttcggctcaaaaccggcacggcggaacagcagatcggcaatgcgtccgtcaatatcttgtgggctgcctaggagaaacgggcaatgctccagtgaggaaaggtcacctgcggcaatggcgcgctcgtccggcgcggttctgacggcatcgacttggccattcgccgcgccaccggtagcggccaaatccatccacagtgattgtgcgaggaccagcaccatgcgctcgttatagaaatccataagttcgatgccggccggtttcccggcgaagtccgccaccgccagatcaagatcgccgttcgccagccattgttgaatctgatcgttgcggccctcaatgagttcaacgatgatattcgggcagtcacgttgcatcgccttcacaatcggcggcatgatcgcccggctacgcgtgtaggcaacacccacgcgcagcacgccggcctgatcgccggcgatgtcgcgcatttcttggccaagtgcatcgcgatcgcggcggaatcgctgcgcatatcgcgcgaacaccgtgccggcataggtcaattcgagcggcacatggcgtacgaaaagcgtgcatccgagctcccgctctagggcggcgatgttcgcactcagcgtctgctgcgtgatccccaaccgtttcgccgccttgctgaagctatgttccgaggccacggcggcgaagtattcgatgctgagaaagttcatggcgatactcccgtgtgtatggcgtttgcgtggtgtgtgtatgacgtgtcgtggcgcgaatcaatgccacagtattaaacctgtaatagatatcagtttagtctgtatttctcctgttatcttaggtcatggctcgtgcgaatagcgttgatgtttgcgactgcgggtcatgagatggaatctgagatgaggctgtagccggaagaggagaggatcgcatgctggaagcgggcacgatgttgctgttctgtgcggtgctgtttgccagcgtcgccctcggctggtcgattattcccgcgctgttcgttggtgtgctgctgttcatggggtatgggctggttcgccggtgctcgttgcgcgcgatggcgagccgtgcggccggcagcgtacggtccgcggggaccgtggtggtggccttcgtgctcatcggcgtactgacctcgctgtggcgggccagcgggaccatcgccttcatcgtggcccattcgaccgcggtgattcacgccgccacggtgattccgctgtcgtttctactgtgctcggcgatgtcggtgctggtcgggtcgtcgttcgccagtgcggcgactatgggcaccatctgcatgtcgttgggattgtcgatgcaggcgaacccggtgatgctcggtggcgcgattcttgcgggcgtctatgtgggcgatcgttgttcgccggtttccaccagtgccttgctggtcaaacagcttacgcatacgaacctgttcaatactattgcccgcatgctgcgcacgggtgcggtgccgtttgtgctgagttgtgtggtatacgttgcggctgcggtggtggagtggctgtgcgcgagcggtggttccggatttggtgcggctagtgcggctgctacggctggctcggctggctcggctagagcggctgtttcaaccaacgcaagcagcataaccgatatcggcggattgttctcatcggccttcgatttgcattggcttaccctagttccagcattactggtcatcgtgttggcgttgctgcgtgtggatgttcggctgcttatgctcgccagcattgccgcctcggtcgcggtatgcgtgggcgtgcagcacatggaatgggcagaactgttgcggctgcttattttcggttaccatgcgcaaaatccgcaggtggccgcactcctggacggcggcggcatcctctccatgctcactgtgatggccactgtctgtatctcctccgcctacgccggcatttttgccgagacgcggatgcttgctcggctgcagcaggtcatcgagatgctcggtcatcgcatcggcgcatgtggtgccaccatgattaccgcgacttgcgcggcggcgctcgcctgcaaccaaaccctcaccatcatgctcactcaccagttgtgcggtgggctgtacggcgacgacgaatccgaacgctccgcacaagctatcgatttggaagacagtgccgtggtgatcgctccgctgattccttggtcgatcgccggtgccgtgccgcttgccaccatcaacgcgcccacactcagcctggccgccgcgaccttcctctacctgctgccgctctcgcggatgctcgcctcggctgtacgccgccgctcgggatttcggactcggcatcgatcccaaaatcaaaacccgggactcgccatcccacaccggcccaaacccatgctccacatgttcgctcatggtttccatcctaagtcgggcgattgagcgcacgaggcaatcaggccgagaactgtttgccgaattccgagaagagctgacggcgggcgaagacgagcaggccgagcagcaccagcagggagaccagcccgctgaccatcaccagtacatcccacggagcccagccgagcggaatgaacgtcagaggcatcagaccagcgacgatgtcgaacgccagatacttggcgtactcgtcaatggccttggcccgcagcacgataagcagcaccacgtcaaagaccagcgaaaccagacacgtgatcggtatgacgaacatggtgacgacatgattcatcgtcgccacaaaccagaccagcgcaatcgccagcatgatatagaaatatcgaaacatgaggcgaagcggccgcggcacgtgcagaatcgcactattgatgaacagcacgctgatgatcagcgcggccgccgatgcactggcaatcggtatcggccacgaaaacagatagctgaagaagccatgcagcagcaaaatcgcgccggttacaaacgtgatgatttccaccgccaaacgcctcggacgcagatagatctgctgcgcggggaatgcggcgggggaggcctcgccgcgcaattcgttctggcagagcgggcaacgggccatatcgccggtgaaatcgacggtgcaggcatcgcaatgcttcatgccgacgctcctttctccacatgcacgccagcgatgttcatacggccgctgatgccctgcgcggcgagaatccgacacaggttcttgatgacgttcagatcatggtagatggtggagatgccgatgctcaggtcgtcgccgaacgagcagaccgtgaaattcaggctggccggtgtggtgaggaagctcaccgaacgtacatggcgcgcgagtcgttcgtccaaggtgactcggccaaggttcgagacggtggtcgtggtctcgcggtcggcgatgaaccgggccagctccagcacccagtccttggcaggggagggcgcaagacgcagcaccggattcttttccagcgcaatcatgcggttcatatgcgattcgacgcgctcgcgactggtggcatggccgagctgctcctgcacatggcgggcgatgtcggccaacggctcatcggtcagcaatccacccataccgttgccgtgcgcggtgcgggcggcggactgctggccgtcgccggctgcgtctgggcttgttgcggaagttttcgcggagtcctcatcggcttcgatttcggccggcgtgtacgccacgtaagtcatgccgtagaagttgcgcacggtctccgacctgaagaaggcgcgcaagtcgaccggaatatccacgcgaatcgcgcgattgcgggcgcgcgagggcatgacgtcgcgaatcgcgcacagtatcgcggcgatgaggtaggaggtgagactcactccgcactgatgcgctgcaccaagcaccttgctggcgctgacgtggtattccatgaacgtaggcgcggcccggtcgatggggccggccagccggtagatcttcgtgcctggcgcagcgccggccttgtctttctcgtagtatttgtcgaagctgttttcggctttgtcgctatccgaaccgtcgtaatccgaaggcacgcccggcacgtcgtatcgctcggcgatgtaggcgtgcagcagcgacttgaacaggttgatggcgccgcgaccgtccgaaatgatgtgcgagacctcgagattgacacgattgcggaaatagcttacgcggaacagcatgcttttgggcccgtaatgcagtcgcgagcatatcggcagatgttccggctccaccagcggccggccgtctgactgttcgaggtaatgccagaacatgccgttgagcaggtgcacgttgaagctcgggaactgggcgatggcatggtcgagcgcgtgctgcaggatgtccggatcgatgccgtccgccagctcggccgaatagcggaacacggtctgcgaggagcggccagcctgggaggagtagaacttgccgatgttgtctagtcggtaccaagtacgtcttgccacgcgtcgcctccctccggtgcgttggcggtggtgccggtgccgggagctggttccagcggtgtgccgtcgaggaaatgctcgatgattcggtaggtggtggccaccagtcccacggccgacgtattgagcaggtagccgtggatgccatcgtgaattcggtaacaggagacgttgtcgttcaccaattgcaggcgacgggcgtacgcttcgtcctcgtctctgagcgggcagtattcggcggacaacaccagcgtgcgcggctgattgctcaggtcgtgcgcggtgagcggcgcgaaatacggattggtcagatcggccacggacgaacggtacatgtcgatgtagtcggccatgtcctgtgcggtgaggatgtagtcggtgccgttggtccgcaccgattcgaacgggctggtctcgggattgtaatcgttgccgactaccgggtaaagcagcatctgcgtgcgcggcatgaactcgccgcggtcgcgggccatgagtgagacggcggccgcaagattgccgcccgcgctgtcgccaaacagcacgatgctgtcgggatccggtgctgggattgtcgcagatatatcgcccccgccggcgggggctgtcggcgcagccgactgggggtgatcaacatcaacagaaccacccaccccagaaatcggcaattccccagcaaacagctgccgggctacctcatagcaatcctcaacagcagtagggaagcggtattcaggagccagccggtactcgactgagatcacacggcgttgcagacgtacggccatatgcgcgcaagcctgcgtgtacaggttgatgccgcctgtggtccaaccgccaccgtggaaaaacaggatcgtgccacgcggcgtgactgagggaagttccgtgttggcattgccggaaataccgtcggcgttgccgctcgacgtgctttccttgatgagtattttgggtaggactttgggtaatacggcgggcagaatcgcggatattgccgaggccacgggcgtgccattggcggaagattcctccagggcttcgggcaggggcgctccataggcgaccagcggcgtgaacactcgcaatggtacggcatatccatccgccataggcgcgaaggcgtcctcgacacggcatttcggattgtcgggtgcctgcttggcgataagctcttccgccacgcgctgcaatttgtacgacttgcccgcgttgggcttgatgtagctggcggccttcatcgcggcgaacaatgcctcgttgatcggcatgacgacaggtcctttcagcggcggattcggtagtgcgaacaccccaaccttagcccatgaccggcatgaacaaaaaagggaaggaacccgagagttccttccctgtgtgccgtatcagacgcgatacgcgccgattatcaggcggtgaagtattccacgccggcctcgaagatcggctggtacttgttgccgggcacgttgacgtacaggccgttgccggaacgctccgagtgacccatcttgccaaacacgcggccgtccgggctggtgatgccctcgatggcgagcagcgagccgttcgggttcacatccaggtccatgccgggggtgccggtctcgtccacgtactgcgtggcgatctggccgttggccctgagctgggcgagcacctcgtcggaggccacgaagcggccctcgccgtgggagatggccacggtgtgaatgtcgccgaccgaagtcttggacagccacggggagaggtcggaggccacgcgcgtgcggaccagtcggctctggtggcggccgatggtgttgaaggtcagcgtcgggcaggcgtcggtcatcggcacgatgtcgccgtacggcaccagacccagcttgacgagcgcctggaagccgttgcagatgccgagcatcagaccatcgcggttcttcagcaggtcacgcacggcctcggtgacggccggcgcacggaagaacgcggtgatgaacttggcggaaccgtccggctcgtcgccgccggagaagccgcctgggatcatcacgatctggctcttgttgatctcgtcgaccaacgcctgcgtggattcggcgacggcggccggcgtcaggttgttgacgatcagtgtggtcacatcggcgccggcacgctcgaaggcggcggcggaatcgtactcgcagttgttgcccgggaacaccgggatcaccacatgcggcttggccacggaagagccgacgtacacggtcttcttcggcgcgtggaagtcgatggtctcgacggtcgcgcccttgtcctcgcccttggaacggtacgggaacacggattcgatgccggactcccaagcttcctgcacagcgtccaggtccagcgtctcgccggcggccttgaacacgtactcggaggtggtggtgccgatttcgccgatctcgaccaaattggagacggccggaagcttggcatcgtccgccagctcgacgatgaacgaaccgtatgccggggtgaacaggtcgtccacggcgatgctgttgttcagggtcacgccgatgcggttgccgagcgtcatcttgaacagggcttcggcggtggcgccatagcccggcgtagagacggccagggcatcgtggaagtcggtgagctcctcgatcacggagaacacctcaagcagcgcatccttgtccggggtcagaccgtcggccaggtagcgcggcgcgatgcgtacgatacggtgatcggcgtccttgaattcaggggaggtggcgcgcttcatgttgcccacggccacggcgaaggagatcagcgtcggcggcacgtcgagatcctcgaacgaaccggacatggagtccttgccgccgatggcgccggcgcccaggtccacctgggccatcagcgcgccgagtacggcggccgccggcttgccccagcgttccggctcgtcgcgcagcttctcgaagtactcctggaagctcaggtaggccttctcatgctcgaagccggccgcgaccagcttggccagcgactcgaccacggacaggtaggcgccggtgaactggttcttggacatgatgtacgggttgaagccccacgccatcgccgaagcggtggtggtctcgccgaacaccggcagcttggcgaccatggccatgttcggggtgagctgacgcttgccgccgaacggcatgagcacggtgcccgcgccgatggtggagtcgaagcgctccgaaaggcccttgttggaggccacgttgatgtcggtgaccagcttgttcatgcgttcggccagcgtgccctcgccccacggggtctcgtaggactgctgttcctcgacatgcacggtctggtgcttggaagcgccgttggaggccaggaactcacgggacagattcacgatcttgtcgccgttccaggtcatcaccatgcgcgggtcctcggtcacggtggcaatcaccgtggcttcgaggttctcttcgcgggcgtaggccaggaactcgtccacgtcctcggcggccacgtccacggccatgcgctcctgggattcggagatggccagctcggtgccgtccaggccctcgtatttcttgggcacggtgttgaggtccacgaacaggccgtcggccaactcgccgaccgccacggacacgccacccgcgccgaagtcgttgcagcgcttgatcagacggcaggcatcgccgcggcggaacagacgctgcagcttgcgctccaccggagcgttacccttctgcacttcggcgccgtcgagttcgagcgattccacgttatgcgccttggacgaaccggtggcaccgccgatgccgtcacggccggtgcggccgcccagcaggatgattttgtcgccaggggccggggtttcgcggcgcacatggtcggccggggtggcggccacgaccgcacccacctccatgcgcttggccacgtagccggggtggtagatctcgtcgacctgaccggtggccagaccgatctggttgccgtaggagctgtagccggcggcggcggtggtcacgagcttgcgctgggggagcttgccttccagcgtctcggagaccggcacggtcgggtccgcggcgccggtgacgcgcatcgcctgatacacgtaggagcggccggacagaggatcgcggatgcagccgccgatgcaggtggccgcgccaccgaacggttcgatttcggtggggtggttgtgggtctcgttcttgaacaggaacagccagtcctcgtcgtggccgttcacgtcaaccttgaccttgacggtgcaggcgttgatttcctcggactcgtcaaggccggtcaggacaccgttcttcttgagccacttggcgccgatggtgcccatgtccatgaggcagacgggcttggcgtcacggccgagctcgtggcgcatcgccaggtaacgctcgaaggcggccttgacggtggcgtcatcgatggtcacttcgtccagctcggtgccgaacgtggtgtgacggcagtggtcggaccagtaggtgtcgatcaccttgatttcggtgatggtgggctcgcggctctcctcgctgaagtacttctggcagaattcgaggtcggccagatccatggccagaccgcgctcgtcgatgaacttctggccggcttcggcgtccatctcgttgaaaccggcgatggtctcgaccttgccgggcaccggcacctgggtcttcagggtttccttggtctccaggctggcctcgcgggcctcgaccgggttgatcacgtaatgcttgatggtgtccacgtcggcgtcggtcaggtcgccttccagcgcgtacagcttggcggagcggacggtcgggcgctcgccctgggagatgagctggatgcattcggcggcggagtcggcgcgctggtcgaactggccgggcaggaactcggtggcgaagaccttggcgccggcgaagtcgggcaggtcgtaggccacattgtccacctgaggctcgctgaacacggtgggcacggtctggtcgaacagctcctgggagatgccttcgacgtcatagcggttcacgatgcgcagggccttgaggccggtcagtccgaggatcgtgcgcagttcgcccgcaagctgctgggcttcgacatcaaagccgggcttcttttccacgtacacgcgaaaaaccatggaaatcctttcttgaaattaaagacaattggctcccctcgagaggggagccagataatgcattactcggcgacttcgatgccttcggacttggcgagttcggcgaggcgctcctcgatctcttcgtaggccgggatgatgctgccgagaccacggcggaacaggtccttgtcaaggtgctcgaccttgccggagtggtccttctggtcccacagacggcaggaatccggggtgatctcgtcggccaacagcagcgtgccgtcggtggcgcggcccatttcgatcttgaagtcgaccagcttgacgtcgatcttggcgaagatctcgatcagggcctcgttaatcttgcgggccagcggggcgatctcggcgagatcctcgcgagtgcatacgccgagggccaccaggtcatcgtcgttgacgaacggatcgtgcagatcatcgttcttcaggaagtactcaagtaccggctccttgagcggcaggccttcctccacgcccagacgggagcagaagtggccggcggccacgttgcgcagcacgatctccaacgggaacatgttcaccttgcgcaccagctggccggtgtcgtccactcgcttgataaggtggctgtcgatgccgcgcttcttgagcaggtcgaagatgatggtggtgatgaggttgttcagacggcccttgccggtgaagtcttccttcttttcaccatcgccagcggtggcggtgttcttgtattcgacccacagaacctcgggatcgtcggttgcgtacagttgcttggccttgccctcgtagagcttttccagcttctccatgactcacctttcaggagtggaatttctgggtgaactaacggtaaaagggtaccaatcgagggctacaacaacactcagcatgacgctacgatgcggccggcgcatcatacgtcgctgcatcgaacggccatacgctgttgggatggcggaggcggccgtcattggccagtacgatcagctcgtctccggtcgtgtagccttccggcatgaaggtatctgcagaagcgcgtgtgaatactcagatgttcgtcaatagacgaaacatgactcttcggccatatacacacgataatgggagtgacgaaatggtacaaggaggttcgtcatgatcgttcatccacgacccggacggcaataatattgaggccatgctgagctgatcaggccgtggactactccacggtaatcgtcaacgcatcggccacgaggccggccttggcacgggcgtcggcttcggactcgccgacggccagtgccacggccatgcggcggtggccatgcacttcgggcttggcaaaaatgcgcaggtccgtgccgggttcggccagagcagcggccacatcggtgaactcgacctcaccgtcgccggccaccacaatcgcatggcttgccgccaccgagccggccggaatcgtgagcgacacatgctcgggggtgatcggcaggccgagaatcgcgcgggcgtgcagcgcgaactcgctcagacgctgggaggccattgtcaccataccggtatcgtgcggacggggggagacctcgttgaacagaatcgagccgtcggtgagcacgaacagttccacgccgaatacgccccaaccggtttcgccggccgcctgagccttggccaccaagccttcaacggcggtacgtgcgatgtcgcgcgcccgctcggcctcaccatcgggttcggtagccggctgccaggactcgcggtaatcgccggactcctgacgttggccgatcggcgcgcacgtcacaatgccggcggacgaagaaacagtcagtaccgtcagctcacgctccagcggagcaagcgcctcaacgatcacgcgcgacacatcgccctcatcggcggcgcggcggccctcctgcgcttcggtccaagcggcatcgatggcgtcggcggaacgcaccaccgactggccgtgaccagacgagctcatcaccggcttgaccacgcacggatagccgacttccgaagctccggcgcgcagctcttccagcgagccggcaaaacgatacggtgtagtcggcaagcccaattcttcgtgggccagtacgcgcaggcgctcgcggtccatgcaaatcgcggcgatttcggcgctcggcaccacctgggcgcccgcggccgcagtaccggccagcacatcggtggcgatggcctctacctcgggcacgatgatgtccggcttgatttcatcgaacaatgcctgcaattcggcggcattcgccatatccaacgcgcgatattcatgcgccacctgctgggccggagcgccggcatacgagtcagcggcgcacacccacgcgcccagtcgcatgagctcgatggccacttccttgcccagctcaccagcgcccaaaaacagcacgcgggtggggtgcttgcccagcggtgtgcccagcgggcggttggctgcgcgagttgcgggggagacggcggaagtctcggcgggaattgcgggagaggaggtggaagtcacggcagtatttacggcgttctcagtcatacccacattctgccatgccgcgatgatttcgcctatgcggggctcgaattcggcgacgtgcgctgcggagcgcgtgattcaatattgggcaaaatgcggcagcccataccatttcatacgcgttcaggcagcgcggccgacgccattgcagcgcggtggtttaggatgaggcaatgcgcgaaaacgggattgaagagagcattgatcgtccgctgactatcgctcttgtggtcgatacggtgggcaatcagggcaacggcacctccaattcggccttgcaatgggctgcagaattggagcggcaaggccatcatgtgaggcttgtcggtataggggcgcccgaatatccggcgcgcgtgaatagggtgccgctcgtctcgtgggtggccgccaagcagctcatgcaattcgccgaacccagcgacacgttgttccgcaccgcctttcaaggcgtggatgtggtgcatatctatatgccgttcaaattcggccgtcgtgccgctaaagtcgcccaccaaatgggcattcccgtgactgccggattccacctgcagccggagaacgtgctgtattcggccggccctctacgtcgcattcccggtatttccagcttcctgtactggctgttcaagcactggctgtacaagcacattgaccacatccatgtgcccaccgaaatgaccgcgagcctgttgcgcgcgcacgggtataaagccaagttgcacgtgatttccaatggttattcaccggtgtattcgccgaagaagccggccgatccggatgcctcggctcccgtgccgttccgcgtcatcgcttccggccgactggctagcgagaaagatcagattacgctgatcaaggcggtgtcgatgtcccggcacgccggcgatattcagctggtgatcgccggtactgggccgctcaagcagtatctcaagttccgcgccgggcgtttgctggcgcgcaaggccgatatcggattccacaagcacgccgatatgcccgatttgttgcgttcgggcgatttgttcgtgcattgttcgattgccgacatcgaatcggtgagcgtgatcgaggcgatggcgtgcggattggtgccggtgatcgccgcgtccgaactgtcggcggccagccagttcgcgctgatcgacgagtcgttgttccccgtgcgggacgcggccctgctggcccgacgcatcgattggtggattgcacatcaggccgagcgcgccgaatggggcgaaaaatacgccgaatacaccaaggcgcattattccgtggaagcctcggtccacaagttcgtggatatggaacgcaaggcgataggggagtaggagccttctcgtttgcggagaggtctttccctcagtccgcctgcggcggccagctccctcatcagagggagctacgaaaaaacctccctctgatgagggaggtggcatcgcgaagcgatgacggagggagagattagcgaagggttttacaacaactcaataagctgatcgacctcttcatgcgtggtggcccagctggtgcagatgcgcatcacggtatgcgtgtcgtcggccttctcggtaaagccgagcttgacctcgcgctccagacggtcgatagtcggctgatccatcgtcacgaaaatctggttggtgggcgcttcgaaagtgagcgtgtagcccttggcgcgcagggcctcgcgaatacgatcggccgcctcattggcgttgcgggcgatcttgaaatacaggttgtcagtgaacaaagcgtcaaactgcgcgcccagcacaaagcccttggccagcaaggcaccgtgctgcttgatgagggtcaagaagtgcttcggcgtgttgtgcttggtaaacaccacggcctcgccgaacagggcacccaccttggtaccgccgatgtagaacacgtcggcgatggtcgccagatccgcgagcgtcatgtctgaaccggtggcggtcagcgcgtagccgagtcgcgcgccatccacgaacagcggcatgtcgtacttgtgcgccacatcggcgatggcctgcaactcggccttggagtagatggtgccatattcggtgctttgcgagacgtacacggagcccgggaacaccatgtgctcgtagttgccgtccgcatagaaggtcttgcagaactcgtccagttcggtcgggtccattttgccgttgtgctggggaatcgtgagcaccttgtgcccggagaactcgatggcgccggcctcgtgcacgttcggatggccggaggcgaccgcgaccacgcctgcatacgccggggtgatggtgtcgatgacgacctggttggtctgcgtgccgccgacgaggaaccacacatccgcgtccggctggccgcaggcctcgcggatcttggccttggcctgatcgctcagttcgtcggacccgtagcccgaatacagatggttgttggcttcagccacggcttcaagcaccgcgggatgggcggcgcgggagtaatcgttctcaaaagacagcatgacggaccttttgtccttatgttcggtgaattggatatgccctgagtgtacaacgcggtggttcccggcatgcctatttggcctataacccaggagcggggaattcagggagaaaaaacaaaacccttccgcgaacggaagggttttagtggggtggccaacgcggctcgaacgcgcgaccttctgaaccacaatcagatgctctaccaactgagctatggccaccatagtgccgtattcagcaagctgaattcgcgcaacaggtgaatactatacacaactttgcggatgtgtgctcatcggtgtgtcgcgatggaatcaagtggtcggtttcattcttggggccaggctgcgggctgtctcagatggcgggatgtggatgagtgggtcttgtgcggcgattgatgaaaagtcaaggcacacgacggtgtgatggtacgaccggggattgcagaaatgattacgtgagtgttcgcaatgtgagcattatgtttcatatcaaccgcgacccgcctagtttcatgcgatgttacctacaccaaacaagggaagagaaacaccatggaaaaggttaaagcctttgcagattggctgaccaagtggtttacggtcatcgtcatcgtctgggccgtcttcaactacttcgtgccggccgccagcttgtggggcaaggcgtacaccggctacatgctgggcatcgtgctgttcggcatgggcctgaccctgacgctggacgacttcaagcgcatcctgacccagccgctgatggtcatcgtcggcaccgtagctcacttcatcatcatgccgctcatcgccgtggccctgtgcgcgatcttccacctgtccggcccgctggccgtgggcgtgattctcgtcggctgctgcccgtctggcacctcctccaacgtgatgagctacctgtcccgtggtgacgtggccctcgatgtctccatcggcatcctctccaccctgtgcgccccgttcatgattccgctgctgatgcagctgctcgcttctcagtacgtgtccgtgccgactcagtccctgttcctcaacgccgtcaaggtggtgctcttcccgatcgccctcggtgtgatctgccacatgatcttcggcaagaagatcgagaaggttacggtcgccctgcctatcgtttctcaggtggctattctgcttatcatcggcgtggtcgttgccgccaacggtccgaagctgttcgtggccagctccctggtggccatcccggtggtcatcctgcacaacctgtgcggctactcgctgggcttcggcttctccaagctgatgtacaagatctacccgaagggcttccgctacgcacagcagaaggccatcaccttcgaagtcggcatgcaggactccgctctgggcgcaaccctggccctgacctccttcgcaaccaacccactcgctgccgtgccgtccaccttcttctccgtgtggcacaacatctccggctctatcctgtccagctggtggcgcaaccacgatgacaagcacgagatccactgggattccgacaatggcgagaagggctctgccaagagcaccgtttcagcggcccacccgttcgacgccgataaggccgccaaggtcgctgcctgaaatcctgaaatggtgagaaaggtcgggtaaggcacgactccagtcagtcggtcatccacctttcctacctcgcataacatagccgctcccgcttactcccgattgaggtatcgggcgtttcgcgagggcggttttgctataattggtaatgcagaaagcggcaaggtaatacggcaaagaggccgggtcgctagaggttcccatcggatatggaagagcacgaggatgtgctggaaacagataacacagaagcggatgtggtgaaaagaaacataatgtaacctccttggcggtgcccccgtgtgacatagtctccgcgggggcacctgctgtgtggcgttccctttttgcgacgcattcccgggaatattgcgttgggagaatagttgggtgtgtgttttgcgacgcattggaatattgcgttgggaggagaggaaaagtacgggggcgcaggaggtccccaaaccagtgagttgtggctcggcgcgtcgttgtccggaggaatcgtaatatagatattcgtgtgtgccaacagcacgccttatgtaacaggcgagcatgctgggatatccttcaaaccgctgatcgcacgcagtaatgcgccgacgggaggggcgaaggccatcgggccggtggactgggctatcttttccgattcgtcgggtgccgccaacaggcggataccaagcgagtgtgctgaaaagtgtgggtgcagtgcggcggtcacacaaaagcaagagaaaccactgaatcggagaattcaagttgcctactattgaacagctcgtccgtaagggacgtcaggcaaagccgaagaagtccaagactttggccctgaagggcagcccgctgcgtcgcggcgtgtgcacccgtgtttacaccaccaccccgaagaagccgaactcggctctgcgtaaggttgctcgtgtgcgcctgtcctcgggcatcgaagtcaccgcctacattccgggcgaaggccacaatctgcaggagcactccatcgtgctcgtgcgcggcggccgtgtgaaggatctcccgggtgtgcgttaccacatcgtgcgtggcgcgctcgatacccagggtgtcaaggaccgtaagcagggtcgttccctgtatggagcaaagaaggcgaagtaagagatatgtcacgtaagggaccttccaagaagcacgtcgtgctgcccgatccgatctacggttccaccgtggtggcgcagctcatcaacaagattctgcttgacggcaagaagtcgatcgccgaagacatcgtctactccgcgctcgatatggtcaaggagaagtccgaccaggagccggtggctgtgctcaagcgcgccctggacaacatccgtccgtccctcgaggttcgctcccgccgtgtcggtggcgccacctaccaggtgccggtcgaggtcaagccgaaccgcgccaacaccctgtcgctgcgctggctgaccgatttctcccgcgcccgtcgtgagaagaccatggctgagcgtctcgccaacgagatcctggatgcctccaacggcctcggtgcttctgtcaagcgccgcgaggatactcataagatggcagaggctaacaaggccttcgctcattaccgctggtaatcactcgccctgagtaaaactaaggaaaaagatggctgaagagatttcggacctccacgacgtccgcaatatcggcatcatggcccacattgatgccggcaagaccaccactaccgagcgtattctgttctacaccggtaagaactacaagatcggcgagacccacgacggcgcctccaccatggacttcatggcgcaggagcaggaacgtggtatcaccatccagtccgctgctaccacctgcttctggagccgtcagtcccacgacaccaaggacaagttccagatcaacattatcgatacccctggccacgtggacttcacggccgaggtggagcgctccctgcgtgtgctcgatggtgccgttgccgtgttcgacggcaaggaaggcgtggagccgcagtccgaaaccgtgtggcgtcaggctgacaagtacggcgttccgcgtatctgcttcatcaacaagatggacaagctgggcgcgaacttctactactccgtcgacaccatcaaggagaagctgggtgctactccgatcgtgatgcagctgccgattggttccgagaacgacttcactggcgttgtcgacctggttgagatgcaggcttacgtgtggaacggcaccgaggagctcggcgccaagtacgacaccactgaaatcccggacgacctcaaggacaaggctcaggagtaccacgagaagctcgtggaagccgctgccgaagccgacgacgacctcatgaacaagttcttcgaggacggcgacctgtccaaggaagacatccgcgctggcgtgcgtaagctcaccatcgccaaggaagccttcccgatcttctgtggttccgccttcaaggacaagggcgttcagccgatgctggacggcgttgtcgattacctgccgtctcctgaagacgtgccggccatcaagggctacaagcctggcgatgagtccgtcgagatcgaccgtcacccggtcaagtccgatccgttcgcggctctggtcttcaagatctccacccacccgttctacggcaagctcgtgttcgtgcgcgtctactccggctccgttgtgccgggcgactccgtgctcgactccacccgcgagaagaaggaacgtatcggcaagatcttccagatgcacgccgataaggaaaacccgatggaccgcgctgacgccggtaacatctacaccttcgtgggcctgaagaacgtgaccaccggtgacaccctgtgcgccatcgacgatccgatcaccctcgactccatgaccttcccggatcctgtgatccaggtggccgtcgaaccgaagaccaaggccgaccaggagaagatgggcatcgccctgtccaagctggccgaagaggatccgaccttccaggtcacgaccgacgaagagtccggccagaccctgatcgccggcatgggcgagctccagctcgacatcatcgtcgaccgtatgcgccgcgagttcaaggttgagtgcaaccagggcaagccgcaggtcgcctaccgcgagaccatccgcaaggccgtcatggaccagggctacacccacaagaagcagaccggtggttccggccagttcgcaaaggtcctgatgaacttcgagccgctcgacaccaccgagggcaagaccttcgagttcgagaataaggtcaccggcggccacatctccgccgaattcatcggccccatcgaggccggtgtcaaggaggccatggagtccggtgttctcgccggcttcccggtcgtgggcgtcaaggccaccgtcactgacggccagatgcacccggtcgattcctccgaaatggccttcaagctcgcaggttccatgtgcttcaaggaagctgccccgaaggccaagccggtcattctcgaaccgatcatgaaggtcgaagtccgtacgccggaagagtacatgggcgaagtcatcggcgatctgaaccagcgccgtggcaacatccagtccatgaccgacggtgtcggcgtcaaggtcatcgacgccaaggtcccgctgtccgagatgttcggctacatcggcgacctgcgttccaagacccagggtcgtgccatgttcaccatggagatggactcctacgacgaggtgccgaagagcgtctccgaggagatcatcaaggcccagcgcggcgagtgacacgcgccactgcatgaagtagccagtgtcttcagtcagcggtaatatcgtataccgctgactgggttctggctcttcaaagtggcacataacccagaaacccagtagaataagcgagttcctgtgcgaaagggtgcaggaaactcacgagacgtccaggaggacaaaagtaatggcaaaggaaaagtacgagcgtactaagccgcacgttaacatcggtaccatcggccacgtcgaccacggtaagactaccctgactgccgccatctccaaggtgctgcacgaggagttcccggatgtcaacccggagtacgacttcaaccagatcgattccgctccggaagaggccgcccgcggtatcaccatcaacatcgcccacatcgagtaccagaccgagaagcgtcactacgctcacgtcgactgcccgggccacgccgacttcgtgaagaacatgattaccggtgctgcccagatggatggcgctatcctcgttgtggccgccaccgacggcccgatggcccagactcgcgagcacgtgctgctcgcccgtcaggttggcgttccgaagatcctcgtcgccctgaacaagtgcgacatggtcgacgatgaagagctcatcgagctcgtcgaagaagaggtccgcgacctcctcgacgagaacggcttcgaccgtgactgcccggtcatccacacctccgcttacggtgctctgcacgacgacgctccggaccacgagaagtgggtccagtccgttaaggacctcatggacgctgtcgacgactacatcccgaccccggttcacgacctggacaagccgttcctgatgccgatcgaggacgtcttcaccatctccggccgtggtaccgttgtcaccggtcgtgtcgagcgtggccagctggccgtcaacaccccggtcgagatcgttggtatccgtccgacccagcagaccaccgtcacctccatcgagaccttccacaagaccatggacgcctgcgaggctggcgacaacaccggtctgcttctgcgtggtctcggccgtgacgatgtcgagcgtggccaggttgtggccaagccgggctccgtcaccccgcacaccaagttcgagggcgaagtctacgtgctgaccaaggacgaaggcggccgtcactcgccgttcttctccaactaccgtccgcagttctacttccgcaccaccgacgtcaccggcgtcatcgagctgccggaaggcgtcgagatggttcagccgggcgaccacgctaccttcaccgttgagctgattcagcccatcgctatggaggaaggcctgaccttcgctgtgcgtgaaggtggccacaccgtcggctccggtcgtgtgaccaagatcctcgcctgattttcatcagacaagaatcttcgcttgaactagcgttataggaaatccccttcgaggaaactcggaggggattttctataaccgcagcaggatatggatatgtaccacgacttccggcctggatgcgctagtgttgcttttcaatagataaacggactgctgcactgcgaggatatgacactgatggcaggccgggaaagaaggtcgatgatgactggtgcacaggccgctcactgtggttctgtatccgcaatttcgctgggactgcccgtttccacggcgattcccgaagccaaaggcacactgccgaaagccttgttcgtaggcaaagcgccgatttccggcaaactcaagcagcgattggtgaacgagatcgaatccatcaccatgctggcgttggcccggtcggccaacacggggcttgcggacggcaaactgatcccggaagtgctggtcatcggactgaagcttacggccaaagccaccggcataccgaacgaagtcatcgacctgatcgccggacagcgcaaatcgggcatcgtgttcgtgtgcgtacgcgacgtgccgttcgagggcagcacgcgtgaggaatgcgcgttcgccgtgcgccgcgccataccggggcgtgccgggcacacgccgatctatcaggtatatgccggcgactggcagccggcgggggaggcccagctggagctggccggctctactattgatgagctgtgggcatcgctgtgctcacagaccattttgggtacgccggaggtcgagaatctggatgcgcgcatcattcgccatactgaaattgctcggctcgaatccgaagtggacaagctcactcgtgaccatcagcgcgtcaagaacccggcccagcgcaacgagatctatgccaaactccacaaggccaaggcgcagctcgcaaaactgcgcgaggcatagtgatgtgaaagccattgggcttccgctggcgggagctggctcgcgaagcgagactgagggtggtccaggtccgtggcctagggctacgcccaagctaattgaaatattcgtgcatcatacagcgtacagttaaaccatgttccctctgctcgaaaccctggtcgccgtatacgaggtgggtcagttcacgctggccgccgatgagctgaaggtatcgcagtcgacggtgtcgtcgcgtatcgcccaattggagcagatggtcggcgcgccgctgttcgtgcgcaatgcgaaaagtgacgtgacgcccacacaggccgggcggatgctgtaccagactgccatcggcatcgacggattatggcgggatacgcgtgagcagatcgcccgcgtgcaggaggcgcgtgagccgctggccgtgtcgttctcgcacacgaccgcggcgattctgctgccgaaggcgttgccggtgatggctcgggacatggacggtttcgacttcgctgtacacgtgatgaactcggatgcgattctcgaacaggccagcatgaaggctgtgcagctcggcgtggtggaaaagccgatcgtgaacgattcggtggaccgcgtcaccctgtgcgaggaccggctggtgttggcgggggaacctgacggcgtgtggatggtgcgcgaacacggttccggcgtgcggtattacacggatctgtatttcaagaccgctcaggttgtgcctgcacgcacgatggaagtgtccagtaatgcggcgattgtggcggcgctgtccgccgggttcgggcagtcgttgatttcggaagccgccgtgccggcgggcgtgccggtgcagcgggagcttggcgatgagtttgtgcggcggttctatgcgctggtgccgagatccggtctgacgcacgatcagcgggagttggcggagacgattattgctgcgctgcgcgggtagtcagatagtcgactgaggggaggttgcgaacgttgtttctctccctccgtccgcctgcggcggccacctctctcatcagagggagatcaattaggtatcgacaaaatcgatgatatgtattggttgcaatgatttgaccgatgtaaacgcttgagcttcaatagacatcatgagagagttctgtacaaaatggtggaagcgcattgccaccgttgacatgctgttcattggtgttctgactctgctggcctcgctgttcgcctcctggctcaagcagttccccggattcagcctgttcggcgcgctcatcatcgcgctgctcatcggtatgatcatccagttcccgatccgcagtgcctacgtcggttccaatgatggccgcaaggcaggcgtcaaggacgccgctggcctgatttccaacaagctgctgcgcctcggcatcatcctgctcggtttcaagctcaacctcgccgtgctgttcacgcagggcatcaagtgtctgccgatcgccgctgtggtcgttacgctgaccatcatcgtgtgctatgccatcgcccgcaaactcggtgtcgacccgatgctcgccatcctgaccgccggtggcaccggcatctgcggtgcggccgccgtcatgggcctggccggttccatcaaggtgcctgaggacaagcaggacgagaaggacaacgacgtgaccatggccgtggccatcgtagccattatgggtactgtgttcgcgttgctggagatcgcgctcggcccgctgaccggcatgaccaaggaccagctgggcatcaccgccggtgcttccctgcacgaaatcgcccacgcggtcgcgggcggcgacgcgttcggcgcggtggacatcgccaccatcatgaagctttcccgcgtgctcatgcttgtgttcgcggccatcatcatcgccatctggtgggagaagaagcattccgaggttcagagcaccggcaagaagaccgtggccttcccgtggttcatgctcggcttcatcggcgcttcgattatcggcaccttcgtaccgttcgtcacctccatcaccccgcagctcgtggactttgcgtacatcgtgctcggcatggccatggccgcgctcggcatcaacgtgaacttcaaggccatcgcttccaagggcaagaagccgatgctcgccagcttcctgacatcgattctgctcatgtgcttcgctgcaggtgttgcgatgctgttcttctgataagcgctccaaatacaaataggcgaaggcgaacgacagtgagcaattggaatgtgtcacctaaaaatcacgtacttgcacaacggataaccccagccgaactggcaggccatcgcaatgaacttcaccacatatggactcagcccggtcgcacccggcatccagccgatcagcagcgtgctgaacgtgaagttccagatccacagcagcacgaacagcgccacggaacgggtgaagttgctggacgatttgaatgtcacgttgcggttcatcacgaagttgtaggtcgccgaacacaccacggcgatgccgttggcgatctgtgagggtacgccgatcaagtgcagaatggcgaacgtcgcatactccacaatggtctgcgtggcggaaacacccacatacttgcccagcacggcgagtccattttgcttcggggttgccgtgcccacggtattttccgcagtattcgttgtggtcgaggtatttgtggcgcccacaccttgattcggcttcacatccgctccattgtttgccatgcccatatacctcccggatgtacctgtgacgttcgacctcgcaatgataccgctgaccgcgtcgggaatcggcgtggcggtcagacgagaaaaccgcaggccgcagcaacgaccggcacacccagcgacagcaccagataggccgctgcggtggggtagcggtgtttgcggaagagcgtcaccatttcgttgattgcggtcgagaacgtggagaagccgccgaggaaaccggtggccagcactagccgccatggttcatcaagtgtcccgccgagtgccagcgccgcgaccaaaccggctaggaatccggcgatgagattgatggtgaacgtggaaagtgggaatgcgcgctgccagtacgttttgatggtcacgtcaagcagatagcggcaggaggcgcctacgccgccgcacaggcagaccaagattggtaggaatacggtcatcacgccttacctcccttgctggtcgtagcggcattcgtatcagcggacgcttcggcggatacgttcgaggagccggccagatgcgttcctgcccacacgccggcagacgcacaaaccagacccagcgcgaacgtcaccagtagataggcaatgccggccgccacctgaccgtcgcggattgcggtaaaaccttccagcgcgagtgtcgacatcgtagacaaaccaccgcatacgcccatgccgagtccgcgactggcaagttctttggaacgtgcgccgaaccgggaagcgccggccaagtaagcggtcaaccctgcatagcagaagcaagccagcatgttggccacaaacgtgccggtatggaagctgccagccgcgggaatctgtgcgaacgcatagcggatagcggtgccgatcgcaccgccgcagaagacgaccaacacaatatcaagatgaatatcggggagcttgcgcgccgggggagtggtcgtgtgcgtaatcggccgggcacctgcggatggggattgcgaatccataatagcctttcctgaaaccgctgaatcctgctgaagacacaacgattccatgcaatatcaaatcgtgtgtaggaactatcagcagtgtgcggttcgaaacgagttcaggcgggttccatcgccggttccttagcctactcgtggcggcgacaacaaacggcagcagtatctcggatattggcctatcgcggtggatttcggcaagagacttctgcaatgccgatgaacttggttgccgtgaggcgataaagcacgtagatgaattgcttggttgcttccatacctcgtgggtatggctcaacatggtttatggctattggctaatacagatcgattgtcgtttaatggaacatgaggataacgggccctaatcgctcggtgccggaaacaaggagttgtgaatatgtctgaaaccatgaaagccgcgattttcgtggagcctggcaagatggccgtggaagaggtgccaaaggcggcacttcagcaggatgatgacatcgtgattcgcatggtgcgcacctgtgtatgcggctctgatttgtggttcttccgtgggctgagcggacaggccgcacacagtcaggtgggccacgaagccattggcgtggtcgaggagactggcgcggcggtcgaatccgttaagccaggtgatttcgtggtcgtgccattcccgtacagctgcggcaagtgcccggtatgcaaggccggcttcgaatccgtgtgcccgcacgggggctacttctccgcttgtcaggccgaatacctgcgtgtgcccgaggcggacggcaccgtggtcaaggtgcccggttcaccggaagattattccgatgaacagctcgcatcgctgctgaccatttccgatgtgatgtccaccggttatcacgcggcggtttctgccgaggtcaagcccggtgacacagccgtggtcatgggcgatggtgcagtcggcctgtgcggtgtgattgccgccaagatgcgtggtgccacgcgcattattgccatgagccgtcacgaggatcgcgcggcgctcgcccgcgaattcggtgcgactgatatcgtgcccgagcgtggccaagaggctattgacaaggtgctggagatgaccggtggctatggtgcggacgcggtgctcgaatgcgtgggctccaagcagtccttcgacacggcgattggcctgattcgccgcggtggcgtgattggtcgtgtgggtctgccgcacgacgtggagatcagcgccgaaggcacgttctacggcaacatcggcatcaagggcggcccggctcccgtgcgccactacgatattgacggtggtctgctggatgcggtgcttaaaggcgagattaaccctggccgcgtgttcaccgccgaatatgacctcgaccatattcaggacgcttatgaggccatggaccagcgcaaagttattaaggcgttgatccggttctaatcgcgtggtgtgacggggtttaccgcagtggtatttaacgtccgtatgtatgcgtcccctttgtagggccgcatacatacggacgttgtgatgtgtctgacgcggtttacgctgaacgattgtggtgacgcaaaccggtcacctgttactcggcgagcagtgccttgtactgtgcagcggactgggcgagggcctcgtcggtgatgccgaaagcgccgcacgtggcgaacggcttgagtcaggtcgcgccgatgtataagccgtgccctcgatcggaataagcagctgctcgatggggtagtggccggggtgccggtctggtaggccgattccggcgaaccggtggacactgcgcatcgcgtcgggaaccgtggccaaggcgtacaccgaactcgccgactgcggcatcatcgacaccggtgccggccgcgcggcgcgtgtaaaacgggtcaagccgattcccgaaccgctggtgcgcgcggccaagacctatgccgacgaggcccgccggcttggcgcgagcctcgatgacgccttcaacgccctgtgcgcgcagtggtaaagcgcgcaccgatgcgaagcctacacggggtgcaccgtcagcgaaaagtcgccgatggtgctgacggtcgagggtgaggccagattgcagacatctcgcaagcagtacgtggcatacagcggaagataggttgttccgccgtcctgcgcaatattggagcgggacagcaccacgccctgcgagatgcgatattcggcattggccaatacggcgtcgatggcggcgtgcgtgcggtagctgcgccccgacttgacctcgaacggcatcacagaatcggcgttcgtgtcagcgatgaaatcgacttcaccatgtttctttgccatgtagtaatacagcggaatgccttgcgccgtcagctcctgagcaatcacgttctcgtagatggcacccagattcggtgaggaatcatcaaggtatgcggcttgcgcggtcggttgcgggtatcgtgccatgagcataccggtatcagactggtacagtttgaacttcggtgattgcgccgtgcgtttcaatggtgttttcggctcggtgacgcagttggttttcaatgccacacccgcatcgacaagccaaagaaaatccttctgattgcggtcgtaccgagcaccggggctgatggaggagacggcgaatctgccgttaccgtcaatcagctgagtggggagctggtcgaagatctcctgcacctgcaatgcgcgattgcctgcgtactgcgaaatatcgtggcgatattgccggttcaactcgttctgcaccgcgcgcacagccgccaaatcacccttggtgtccagaaaacgttgcacgacttccggcatgccgccgactaccagataggtgcggaagttcgtcatcattgcatcgtgaatgtaccggtcgattggcgtgaccgaccggcaggattctcggatgttttcaagtgtcgacttctgtacgccgatggcccaacagaattcctcaaaatccatgggacgcatggttttttcgatgaccgagccaacggggtaggagcgtacgcccttgaactcagtgccgagcatggaaccggagaacacataatcgaaacggccatcggccaccagaaacttgaccatggtcatcacatccggtgcctcttgcacctcgtcgatgaaaatcaacgtatcaccgggaatgagcgttgaaggtgagaacaaggtaaggcggctgatgaactcctgcacgtcgttcgccgatgcgagcgctcgggccgcctgcttgttctcgtacaggttgatttcaaggtaatgggcgtattcgtgcttggcgaactcgcgtaccgcgtagctcttgccgatctggcgagcgccggtcagcagcagtgctttgccggtaccgctccgcttccattccagcagatcgtccgagattttgcgctcaagcatggcagctcctttccgaatcccttatgagggtagcattttctgccttgtatgtgcaaaatgccgcatttcaaaatggggctttggtgcaaaatgccgcatttcaaaatggggctttggtgcaaaatgccgcattttaaagtagggttttggtgcaaaatgccgtgtaaatggtgaattggacgtgcttgtaaggggagctggatgatcgtgcggctggatgaccttgtaactaaatgattgaacgattgcgcggccgtcgtttgcgtggccgcaaagttgtgtgggctgttcgcgaattatgcgcggtcggccgtcatgtgcctgcgcttggggtgctcgataagtagcgctcgcttcttggcgtcctcggcggtcgaagccggtacgccgtcggaggaggcgtcgatgatgcgctgcaggtagccgtatagggtgtgcagctcgtcgtcattcagacagtccagcatagaggggcctgatcaaaaccagttcacgaggtcctttttgctttaatccccgctgagagcgcgtagcgccggaggatgatcggatgccgcgacgccgaatcaagattcagccgctcgccgaccagcccgaccagcaaggaaccggattcgcgcatcggcggcatgcgcgctgctattcgcgctgaaacagcatggcatgggtgcgctgacaccgcgccggcgcaaaggccatcagtgaaactggggaatcggattgcaggtggcggacggtgcccaagacgaaagattctcgtccggcgttcagccgccgtcgttggccgtgatgatactggagaccatgaaactcaggcggcggcagccaagggcgaagtcgagaaagaggtgacggcgtgacacttgaacagaggtcagatagcgcggcggcaggccacgaggcatgtgaccagccgatcaggagcctggaaatcctcaaccaatgcgttccgctgttcgagacgctgaaggatccgaaccggcagcagttgctggtgcaattggtgtgccatgggccgcagacggtgggggagctggccgaatcgtcggcactgtcccgcacggccgtgtcccatcacatcaaactgctggaacaagccggattcatcgaaatcagcaaagacgccacccgccgcatttgctcggtgcgtgcggatcgatggctgccgctgctcgatgaactgtcttccgccctgaaagccgaccttgcggcggcggagcagtgccgagcatgagcgacgatcaacggccgcaggcgattgaggtgcgcggtgcgcgcgtgcataacctcaagaacatcgacatcgacattccgctgggcgaactggtgggcgtggccggcgtctccggttcgggcaaaagctctctggcgctcggcgtgctgtatgcggaaggttcgcggcgctacttggaagcgctgtccacgtacacgcgccgtcgactgactcaagccagccgcgcccaggtggacgaagtgctgcatgtgccggccgcgctggccctgcaccagcggcccactgtgcccggcatccgttcgacgttcggcacgatgaccgaattgctcaacagcctgcgactcctgttttcccgcgtcgcctcgcacgtgtgcccgcattgcggggcgcgcaatgaaccgacgctgaacgtggcggccggcctgcccatcacctgtgctggctgcggcaaggaattccacgcgcccggcgccgaattgctcgccttcaactcggccggcgcctgcccgacctgctccggcaccggcatcgtgcgcgaagtaaaccgcgcggccctggtcccggacgagtcgaaaagcatcgacgacggcgcggtgctgccatggggttcgctcatgtgggacctcatgaaacaggtgtgcggcgcgatgggcgtgcgcaccaacgtgccgttcaacgaactcacacccgaagaacgcgacatcgtattcaacgggccggccgtcaaaaagcatattctttacaagccgaagaaaggcgacgatttcgccgaactcgacttcacctacttcaacgccgtgtacacggtggagaacgcgctcgccaaagccaaggacgagaagggcctgaagcgtgtggtccggttcctcaaggaaggcccatgcgccgactgcggcggcacacgactgagcgtcgccgcccgggccccgcatgtgcgcgggctgaacttggccgaagccggcgcgatgaccttggacgcggcggcggattgggtgcgcggagtgccggaatccctgcccgccgacatgcggccgatggccgccaacatttgcgaatcgttcttggatgtggcccgacggctgctcgatctgggcctcggctatctggcgcttgaccgcgccggcgccacgctttcgaccggcgaacgccagcgtgtgcagctcgcccgggccgtgcgcaaccgcaccatcggcgtgctgtatgtgctcgacgagccatccatcggtcttcatccctcgaacgtggacgggctgctcggcgtgatgcacgacttggtggcggacggcaattccgtggtggtcgtggaccatgatgtgcgtgtactcaaagcgtgtgaccatcttatcgaaatggggccggttgccggtgccgaaggcgggcatgtgatcgcgcaaggcacggtcggcgaggtggcggcgaaccccagtagtcgcattgcgccgttcctatccgaccaggtgagtgcgcgtatacgtgaacgtgtggccgaatcgcaagtgttcagccttggccacatccgcatgacaaccagtcagctgcatacggtcaaaccgttggacgttgatatcccgcgcggccggctcgtggcggtgaccggcgtctccggctccggcaaaaccacgatggtactcgaatcgctgattcccgcactcaaagcgcaggcggcgggggagctgttgccggaacacgtgcgcgagcttgagaccgagggcatccgtcgtgcgaatctcatcgatgccacgccgatcggcgcgaacgtgcgttctaccgtggccacttatgccgatattcacgacgaattgcggcgcgcctttgcccgatgtgaggcggctaagacgggcggctggaaggccggcgatttctcatacaataccggccgactgcgttgccctacgtgcgacggcaccggttcgatctcgctcgacgtgcagttcctgccggatgtgaccatcgaatgcccggattgctgcggctcccggtacgcgcccgaagctgatgcgattcggcgtgcggttaagggagaatctcgcctttcgttgagtttgccccaactcatggcaatgagtgtggaccaggctctggccgtgaccagcgacctcaagaaggttcacgcacgtctgaccatcctgcacgatctgggtctcggctacctgacgctcggcgaaccgaccccggcgctttcgggcggcgaagcccagcggctgaaactcgccagcgaaatgggcaaggcccagttgaacgcggtattcgtgttcgacgagccgaccatcggcctccatccgctcgacgttcgcgtgctgctgggcgtgttcgaccggctcgtggtgagcggcgcgaccgtcgtggtcatcgaacatgacctcgacgtgatcgccaatgcggattggattatcgatatgggtccgggcggcggcgaaagcggcggacgcatcgtcgccaccggaacgccggaacaggtcgcggccaatccgaacagcatcaccgggcggtatctgcgctgacttgtatggcggtcacgcgcctttgcataggaccctgcgcgagtaggatagccgtccatggtgcagattcatggcattagacgcgcaagcgcggacgcgaaatatcggcagatgaccgggcagccggtcaaaccgctgatcctcaaactatgcctgccggccgtcatttccaatctggtgactactgcatacaacctgactgatacctttttcatcggccagctcggcaccgcgcagtccggtgctatcggcatcgcgttctccatcatgaccgtgatgcaggcgctcggcttcttcttcggcaacggcgcgggcaactcgatgagccgcgaactcggcaagcagaacaatgatcgcgcctcccgactactggccgtgggctttgcgggcgcggtgatctccggtctggtgattgccacaatcggactgctgaccctgcggccacttgtcgtcatgctgggctcgacctcgacgattgccccatacgccgtgcaatacctgacgccgttgttggtcgccgcaccctgtgtatgcggttcgttcgcactcaacggactgctgcgataccaagggcaatcgacgttcggcatgatcgggctggtttcgggcgcattgctgaatttcctgctcgcgccgttgtttatcttcgtgctgcacctcggaatttttggtgccggcctggccaccgccatctgccagacggtgagcttcacgattctgaccacgatgagccgcaaattcggcgtgatgaaactgtccctgcgcaattgcaaaccggatatgctgctcatgcgcgaagtggccggcggcggcctgccttcgctgatccgccaaggcgccggctcgatctccgtgacctgcgtgaacatcgccgccaatccattcggcgacgcggccatcgccggcatggccatcgtgatgcgcatcatgttgggcgccaattcggtgatcgtgggtctcggccaaggctttcagccggtgtgcggctacaactacggggccggcctgttcgcgcgagtcaaagaagggtactggttctgcgtgcggctcgccacctgcgtgctcgtggcgttggcggcactgctgtggattttcgcgccgcaactggtcgagattttccgctccgacccggccgtggtcgcggtgggcgtggccgcgctgcatattcaatgctgcacggtgattctcaacggcttcaacatgatgggcaatatgatgacccagaccatgggccgcaccggtatcgcctcattcctggccttgtgccggcaaggcctgttcctggcaccgatcgtactgattctgccgatgatgttcggcgtgcttggtgtggaaatggcgcaatcggtgtccgacgtgctgacattcctggtcaccatcccgttcatgcggcgaatcctgcacgaattgcggtagatgtcatcaagattttcgacttccagaccaggtggaccgagcatatctcgctgaatctctgtagtttttccttaccgttgcgttcattaggtcgattatgcgttcattaggtcggtgccctgcttagcatgagataatgagcattggaatgaagccattcttgaaggcagtgttcatcacaagtgacctaatgaacgcataatcgacctaataaatgaatggcggatggctaatacggagcctgaatgcagaatatgaaacgtatgaaagccaaccaggcacacaagtggcctgtgccggagcgcatcgaattgctgtaccgcaccatggctgacgcactcggcccgaccggatggtggccggcggagaccacgttcgagattatggtgggcgcggtgctgacgcagaatacggcgtggagcaatgtggatcgttcgcttgcggcgttgaaagcggaggatgtgctcgaaccccatgcgctggtggccatggagccggagcgtttgcaggaactgattcgaccgtcaggcttttatgtcaacaaatccaagaccgtacagtcgctgagttggtggtatgtggagcgttgcggagcctcacctgagggcgcggcagatattcccgatgccgaattacgggccgagttgcttggattatttggtattggcggcgagacggccgacgatctgatgctgtacgtgttctcgcgccgcacattcgtggccgatacctacgcgcggcggctgttcgccttcctcggatttgatgtgccagccggctatctggcattccacaaggcctattcgcccgtggtgctggatgcgagcctcagcgtcaaggatttgcaggaattccatgggctcattgacgagttcggcaaggcctaccgcgacgacgcggccaaaagcgagtcctttttgggtggatggagggcttgactgcacggcgaatcgttctcaataagaaaagtgtgaggcccgcacggtgccaatcgcacatctgaatccttgactggctgcgctcgatgctgggtgtcgaaaacgagtctgtgacagaatagttcgaccgacacaatcgccaaaacgccgaacaggagccaatgatgaccgaagacaagccgatcgccaagccgattatcgatgatgcgacgcgcgagaaaatggcgcttatgttctccggcgaggtctacctgccggatgatgtggacggctttttgatctgcaggccgcccagcgtgatctccagctcgaactcaacgccacaccgctgaccaacccgaagcgccgtaccgaactcatgcaggcgttcttcggcgcggcgggggagggtctgtacctcgaatgcccggtgtatgcgaactggggctgcaatacctattggggcgagcgctgttacgccaacttcaacctgacgctggtggacgatggtgagatcttcatcggatcccacaccatgatcggccccaacgtcacgcttgtagccaccggccatcccgtgcgtccggacctgcgctatcagggtgcccagtattcgttgccagtccacatcggcgagaacgtctggatcggcgcgaatgtcaccgtgctgcccggggtcaccatcggggacaacgcggtcattggcgccaactcgctggtcaccaaggacatccccgccaacacggtcgcctatggcagcccgtgcaaggtaattcgcgaaatcaacgaacgcgacgacgtctactactggcgcgaccgccaattcagtgagcgttttaagctcaaagagcagtagcgcgaaagctcactcccacacgtcgagcttgcgatttttgtagaaatactcgcggtccttgtcgccgatttcacgcacgacctcgcagggcgcgccgtaggtgacggagttggcggggatggaatgtgtcacgaccgaaccggcgccaatcacgcaattgtcgccgatggtcactcccggcagaatcgacacgttcgcgccgacccacacgttgcgcccgctgatcaccggaatgcaatacgtgtaatggtgctcgcgcagcaccggcaacacggggtggccggcggcgcattagcacggggaacggttgaacgagaagtggattggcatgtggtggtatcgaacatactgatgcgtgtgccgccgagcctgtccagatggctgcctatatgaaccagtgacagaaaagcacgggaacgcgagcgagaggagtgtgcatggggcagttcggcgtcatgattggccagttagtcggatttctgatcatgctgatggtcgggtatggatgtgtgaggcttcgattctacggtcagacggcgttggacggcatgtgctcgttgctgctcaacgtgctcatccccgtgcttgtgttttcgaacgccgtcgatggtgcggaccgcgcgcagcttgcctctaactggggcgtgatgctgctgaccgccgtgatgtacgcgctgctcatcctggtgttctggctggtcgccgaactgttgcggctcaaaggttcgcgtagccatgtatttcaggcgtcgcttattttcggcaacgccggattcatcggcattccgttgattatggcactttggccgcagaacggcgcgatttacgtggcgctgatgtcgatcatcgaccaaacgctgctctggacgtacggcgtatggctgtgcgagccggtcgacgaaacgactggcggcaacgcgattggcgcgcgaggtgcggtcgtgaacggttcggtgaacggcgccggttcggtgggcaatgctggttcggcgagcaatgccgcaaacggtggttctccggccatcgtccgcccctcgccaggcacccgcgtcctcggcctgcttaaacgattcgtcaatcccgccttcgtcggcgtgatgctcgccctgattctgattctgctcggcgtcaaggtgccggacatcatcctgaagccgctgcacaccatcggcaatatggccacgccgatgtcgctaatctacttgggcggcctgttcgcgctgaccaagtggtggggcgtcctcaaacgctacgaactctatgctggcctagtcgccaagatgatcgcattcccgctcgccttctacgcgctactgaccgcgctgaccggcgcattgccgcaactgccgatcacccatgacatggtgctgatgatcacggtcatcgccggactgccgaccatgaccaccatcgccatgttcaccggtcgcaagaacaacatgcccgagtatgcggtcggcttcgtgctcgtaagcacgctgttctcgctggcctccctgacgattgtgtcggcagttgtgttctgaattgtccccttcgacgaaaagaatgccggggcctccggcgcttggaatttcatcgacgccgccaacgactccaatccgaggcggccgtgccgtatttcaaggagatattcgattacgcgcgcacgctcgattcgcagcatcgcccgctgacctacaccaatctgctgatggccgccggaggcaaagacaagtgccatcagttcgcggatgtcatctgcctgaaccggtattacggctggtatgtgcaagatgggtatcagctcatcggagccaagaaggccttcatcaacgagatgaaccaatggatgaacaccgaacccaacaagccgtttctgttcaccgaatacggtgcggacaccgatgccggtgtgcacaagctgccgagcatgcaatggagtgaagagtaccaatgcgagtacctcaccatgcagcacgaagtgttcgacatgttcgaggcagtggtgggcgagcaggtatggaacctctgcgacttccaaaccggtgaaggtatcatgcgcgtcgacggcaacaagaaggacgtcttcactcgcgaccgtcagcccaaagccgccgcctatgtactcaaggagcgttgggagactaagtagcggcccgcccctggaatattccaggagcaacacacatcgcataacacacaacgcaacatacaaaaaagaacctcgtgaaacgaatttcacgaggttctttctagttacgctgaatgactcccattagactcccacgagggaagagcaatgggaattccaacgtggctaagctctcaaactcagatgtggaagtagagctcgtactcgagcggggtcggggccaggcgagcctggtcgatctcgtcgcgcttgaggccaatccaggtctcgatcaggtcgtcggtgaacacgtcgccggcggtgaggaagtcgtggtcctcttccagggcgtccatagcctcggccagggagcttggcacctgcttgatgccagcgtgctcttccggcggcagctcgtagagatccttgtcgaccggctccggaggctcgatgtggttcaggatgccgtccaggccagccatcagctgagcggagaaggccaggaacgggttgcaggacggatccggagcgcggaactcgatgcgcttggcggccggggaggtgccggccagcggaatacggatggcggcagaacggttacgagcggagtacaccaggttgaccggagcctcgaagcccgggaccagacggtggtaggagttcagggacgggttggtgaaggccagcacggaggaggagtgcttgatcagaccgccgatgtaccagcgagccagatcggacagaccagcgtagcccttctcgtcgtagaacagcggcttgccgtccttccacagggactggtggcagtgcataccagtgccgttgtcgtcggcgatcggcttcggcatgaaggtcgcagccttgccggccagagcggcggtctcgtggacgacgtacttgtacttcatcaggtcatcgcctgcgtgctgcagggtgttgaagcggtagttgatctcctgctggccagcgccggcgacctcgtggtgggaacgctcgaggatcaggccgaccttctgcaggttggcgaccatatcgtcgcgcagatcctgggtgtggtcaatcggcggaaccgggaagtagcccttcttgacgcgattcttgaaaccgatgttcggggtgccgtcttcctcaacgtcaacgccggagttccacggagcttcgatggagtcgacctcgtagaaggagcgctgcatggagttctcgaaacgcaccttgtcgaagatgaagaactcggcctcaggagcgaaggaggcggtgtcggcaatgccggtggacttcaggtaggcctcggccttgccggcgacctgacgcgggtcgcgggagtacggctcgtcggtcagcgggtcgacgatggagaaggccacgtcaagggtcttgtgcttgcggaacgggtcaacgaaagaggtctcaacgtccgggaccagcttcatgtcggactcgttgatggcctggaagccctgaacggaggaaccatcgaacggcatgccgtcggtgaaagcgtccttcaggaattcgctagccggcacggtgaagtgctgctgaacgccgataagatcggtgaaacggacggagacatactcgatgccttccttgttgataagggcctcgacgtcttccttggacttgagttcggtcacgggaccgctcctttcgtatgaaatataacggtatccatcgtaaaatcgcgcgtttcgccggctcgaaacttgggttacgagaatgtttcgtgactgtggccgacaatcgcgcaggcgcgttatttcaacgaaacatcattacagaatggaaacggaggctatcgggggagtgggtagaggtgtccgcaacgtggacagtgggtattgacaggtgatgtaggtggatgtatgtggacgcgattatgagacatatgacgaagccccggaaccgattgaacggattccggggcttctgtgcgatttggttgtgtgctgccgatcagcgaccgcgcatcgcgcggcgggagatcttctgcgggcggttcggatccatgcccttggggatggcatagcccttcttggcctgcagcgtgcgaagacgatcgttcagcgtttccatctcggccttggtcagcaggaagcgacggcgcggatgaatcttggcgatcagtgcgttcttgtggtgcgtgggctcatagctcttggacttgatcaccgtgctacgcagcttggtcagcggcacctgcttggggccgtggcccacggcgatgcggtacaccggaatggaggagccggcggtgacgcccttgatatcgcgttcctgacgatccatcgccttcatgacgcgaccgtattcgccttcgccgatcaggtagatgccgttcatcgaagtgccgcgccagatggcatccttggtcttcgggtcgatccacaccggttcctgcgggaagtcaaagccggctttctgcatgttgctcagcacgccgatggcggcaccaggcttgccgtcaatctgcttgtagccgactgcatccgcgcggcgggtgagcatcatggtggccagtagcatgccgagcatgatggcggtgatcatggtgaagatccaggtcagccaggtccacttggcaatcagaccgatgatgatcatcacgactacaggcagcaggaaagcaccggcctcaagccacggcagggccttgtcttccttagccgtgtacttgtagatctggatgatctgcttgattgtgctctgcttcttcggcttcgcgtccttttccgccatcacttcttcctttgttgggacgaaacacactagacaacatcttatcaggtgcgctggtccgaacttgtttgtgctggttggtctcagcgtgtgtgtaacggccgtccgtcggccttgagcagcgcctcgccgagcgtttcactgaacgtgggatgcgggtgaacgaggcgggctgcgtcggcgagcggcacatggttgccgaccagctgttcggcttcggcgatgatgtcggaggccatctgggagaccatgtgcacgccgagcacgcgcggggtgtccgggttggccgcgtcgcagccggagacgatggtcagtgaaccggccgtgccgctcatcagcatgcgcgcgttcgccagcatcggatagttggtctccttgatttcaatgagatcctctctcgcctgcgcctgttcgacggtgagcccgaccgacgccgcttcggggaaggagaacacgatttgcggcacggtggcttcgtccaccggcttgggattgagtccggcgatggtctccgcgatgacgatgccttgctcaaaagcacgatgcgccagcgcgtgaccggccgtcacatcgcccaccgcccatacgcccggtttgtcggtgcggccgtacgcatccgtggcgacatgtccgtggtcgtcaatcgtcacgccccatgctgggtcggtgatcgggtcacgcccgatggcgacaagggcgatttcgccccagacgctttgttcgccgtcctggccttcgcacgtgtagtgcacggtggcaccaaggttcgcgccggtgtccacatgggtgacgctggcgcgggtgatgatgttcacgccatgacgtttgagctcacgggtcagcgtggtgccggctctccggtcccaggctgagagcacacggtccttgcgaatcagcaaggtcaccttcgaaccggcggcgttccacatcgaggcgaattcaagggcgatggccccggcgccgataatcaccgccgacgagggaaattcgttgacttccagcgcctgtgtggagtcgatgagggcgccggcgaacgggttaccgggcaatgggcgtggcttggcaccggtggcgatgacgatgttcgtggccgtgaggtccatcgtggggccgctgggctcggggacatcggccttgtgataggtgaggatgtcgctttggtcgggggaagggacgaggtggacgatgtggttggaagttgctggagcggtctcatccgcatggaacgcggcattggctcggaacacggtgatgccgcgatgggcaagcagtccggccagtcctcccaccatcgtcttgaccacgcgcaggcgatagtcgcgcagcgtgccgaagtcgatgccattcaccgaggcgttgacgccgagctcggccgcacggtgcacggtgtcgatggtgtgggtggcggtgatgagcgccttggaggggatgcagccacggttgagacatgtgccgcctacggtggcgtcacgctcgacgagtgccactttcatgccgagttcggcggcgcgcaaggccgtggaatagccgccggggccggccccgatgatgaccagatcaaactgttcgctcatgattgcctccttggtgcatataagtatggctcccacgctagggagccatatgcggctatcgccgccacttcgcctaaaaacagtccactggactgttttctttacggctcagcccctcaacgaggggagccagagtatatatggacaatcagtccgccggccagtgaccgcgcttcgggtaacgcggcttgggaagcctccaacgacgcatctgaatcgaacggctccaagcgtaggagaaggagcgggagcccttggacacggactgttcgccgtacttggcgatgagcttggccttgagcttgcgccacatcagccatacgtcgatgatcacggcaatcaggtaaccgtacataagcgccatcatgatgatggaagcccactggttctgcatcaaagaagtgacgaacatggagacgatcagaatcgcgaaggccaccgggatgaaccattcgccaaggttgaaacgggcatccacataatcacggatgtagatacgccaaggcaggcgttccgccttgggcatgtggttgatatcgcccttctgcatcgcctcgtactcggcgttctccttctcacgcagacgggctttggcggccttggcgctggccttgcggtccaccggaaccagcggacggataccggcggcctgagcctgcttcatcttcggggtaggacggccttttttctcagaaggatcggcggtcttcttcggggcctgctcaacgggaacttgggcctcttcttttttcctaaacggattccatgtcatgctttgaggttacggtgacgttcagacacttgtatactggcgcagccattgcaatgacgccgcttacacacatataaaggaggaccatcatggcaacgctcaccgctgacgagattcgttcgcgcgtcgaaaccgattggaaccgcatcgtcaaggtgctggccgaaaaggttgcgctgcagtcgatttccgccaagggcatcaccgccgaacatatgaagcgctccgctgaattcgtggcagacgaactgcgcctcgtgggtgtggatgccaaggtggtccaggcttccaatgccgacggcactccgggcgcatgggaggtcatcggctcgcatatcgtttctccggacgcccccaccgtgctgctctacgcccatcacgacgtgcagcctgttccggacccggccgagtggaacaccgacccgttcgtggccaccgaaatcgacggccgtctttacggccgtggctccgccgatgacggcggcggcatcgccatccactccggtgcgctgaaggctttgggcgacgacctcaacgtcaatatcaaagtgttcatcgaaggcgaagaggagatgggctcgccaagcttcattcccttcatcgaggctcaccgcgacgaattcgccgccgacgtgattatcgtggccgattccggcaactggtcggcggacattccttctttgaccacctcgctgcgcggcaacacctgcgtggacgtgaccgtgcagggccttgagcacccggtgcactccggtcagtacggcggcccgattcttgactccaacacgttggccgccatgctcatcgcttccatgtacgacgagaacggcgatctggccgtgcccggcgtggccgcggaagagccaatcggcggtttgcaacgcgaccttgacgaaaccaccgtgcgcgaggattccggcgtggtggccggttacgagttcgccggcaccggttcgctggcctcacgcctgtggaccaagccgtccgtgaccgtgatcggcttcgacgcccacccggtcgagggatccttcaacgtgatcgccccggagacccgcttccgtctgtcgctgcgcaccgcgcccacccagcgccctgaagaagcgcaggaagcactggctgcattcctcgaatcccacgcgccgttcggcgccaaggtcactgtcgaacgcggcgaaaacggcatgggctgggccatggacccgaccgccgtggccaccaaggacgcgctggaagccatgaccgaggccttcggcgttgagcccatcaacaagggcgaaggcggctccattccgttcatccccgaactgcagcgcattttccccaacgctcaggtgctggtcaccggtcccgaagacccgaaggccaacgcccacagccccaatgagtccatctccctgcccggcctcaagaacaacgtgatcaccgaggctttgctgctggacaagctcggcaagtagccgaaccgcatcggtaatggtagtgagccgccgtcaggtaggtcacagatgtggctattgcctttgacggcggcttgctttatagtcgggagttgacacgggagctgccgttgggcggctgagaggagactcatagtctcgaccgatggaacgtgaccggataatgccggcgcacggaaatatcgctcttacctacccgtgcctgaaccaacccgcgcgtggccacgaacatatgcatcatgtgcgtacatatatccacgtatgttcggcctgcgtgcgagcagaagaaaggcacattcatgactgaagctgtggccaaagccaattacaagtggcgcgtcgtcgatatcgtcgtcgccgcaatcatcgccgtcgcatccggcgttattttctggggctgggacattgtctgctccgccccgctggccctgtttgaaggcgtgacccccggtttcgagggtctgctcaacggattctggctgttcgccggcccgctcgctgcaatcattgtgcgcaagcccggtgccgcactgtttgccgaaaccctcgccgccttccttgagcttacgctgggcaaccagtggggcgtcggcggctcgctgatcgtcggcatcatccagggtctgggtgccgaaattgccttcgccgtcttcgcttggaagaagtggaacatcggcaccaccatcctgtccggtgcgctcgccggcgtgggctgctgggcctactactgggccaccaacccgggctggaacggcctgcgcgtcacttggtatctggtgggctccatcatctccggcgtcgtgatcgccggcgtggtggtctggtacttgtctcgtgcgctcgccgccaccggcgctctggaacgctttgaatccggccgcagcaaggcgcgcgtctgatgcaggttaatccggctgcggtagaggccagcggctggggatggcggcacgccacgcgtaaggacttcgcgttgcgtgccgtcgatttcaccatccggccaggtgaacgtgtgttgctgctcggtgcttcgggggcgggcaaaagcacgatgatggccggtctcgcaggcgtacttggcggcgatgaggaaggcgagcaggagggctcgctcaccatcgatggcgtcgatgcgcgcgaggcgcgaggccgcgtgggactggtgcttcaggacccggactcgcagatcattcttgaacgactgggcgatgacgcggccttcggctgcgaaaacctcaacgtgccgcgcgaggagattcggcagcgagtgcgcgaatcattggatatggtgggactcggcggactcgaactggatcggtccacccgccatctgtccggcggtcagcgccaacgtctcgcgttggccggcgtgctggctatgaagcccggtctgctgttgttggacgaaccgaccgccaacctcgaccccgaaggcgtggtcgaagtgcatgacgcggtcaaaaaggtcatcgaggccaccgggcagaccatggttgtggtcgaacatcatatcgatgtatggctcgatctggtcgatcgcgtgatcgtgctcggccgacccgatgcaagttcgcccacgggcgcggtcattgccgacggcaagccggacgaggtgttcgccgagatgggcgacgtattggccgccggtggcgcgtgggtgccgggccgtgcgattcccgattactcgccgaagcaggagtctgcgcacgatgcgccggtgctcagcaccgagaacttaagctttggccgtggggccgctcttggcgttggtatcaatctggatttttatcccggcgaagtaacggctctgatgggtccgaacggcgcgggcaaatcgaccttggccttgaccttggccgggctactcaagcctatcgccggcaaggtgctcatcgccgacaacctcaagcccgcgcatgccgggcgtgagccgatcgactggaaaagcaaggaactgctgggccgtatcggcatggtgttccaggagcccgaacaccagttcgctgccaactttgtgcgtgacgaggtatccatcggccccaagtcgatggggcagagccaagacgaggcttatcagaccgccgaccgcatgcttgagcagatgaatctcacgcgcttcgccaaagccaacccgtacaccttgtctggcggggagaagcggcgactgtccgtggcctccatgctggccgccgcacccaaagtgttggtgatggacgagccgacattcggacaggatttcagtacgtggaatgaaatggtcaagctgatcgccgccatccgcgaccaaggctcgtgcgtgatcatggtgacgcacgatgaggcgctggtggatgcgctgggcgcacgacgtgtgatgttcgaggaggcgaaggcatgagtgacgtggtaaccgtcagcccgcaggaaacgcgcgtggagccggtcaaagcctcatcgccctcatggttcatcgcgcgcatcaacgcggtcagtcgcatcatcggtgcgctgttgctgtgcgttccgatgttcatcagtctggatgtggtatccgcgtccacggcgctcggcatcgaattcgtgctgctgtggattggtggcgtggctccgtggaccgtatgccgtaagacctggccggtatggatcgccgtcgccggcagttttatctccgtgtttctctacggccgcacctcgggagagatcctgtggcagggcggctggattgtgatcagcgagggatccgttaatctggccatcgccacggctatcagggtggcggccattgccgtacccggcgtgattctggccctgggcctcgatcccactgatttggcggacggtttggttgagattctgcacttctcaccgcgattcgtatacggcgggttggctggattgcgcatgtttacgctgctgcaggaagattggcgcgcactcggcttgtcccagcgttcgcgcggccttggcgacggtaacgccatcgcccgtgccctctcccaggcgttcggactgctggtgctctccatccggcgcgccaccaaacttgccaccgccatggaagcgcgcggcttcggctccagcgccccacgctcccaagcccgtatctcgcgtctgaagcctatcgactggatcttctacgtcatctgtctggctgtcccgctggcctccataggcgtagccatcggcaccgggaattggcacttcgcctttcaaggtgtctgaaaggcgacagactggcacagtgcctttcaaggtgtctgaaaggcttacgatgcctccgccagcgggagcgagccacgactgacgtaatgacccggcagtagggtagtggctatgcccatcaacgcccagattcttgataatccgaaatccgaccgcgttcgccgcatcgccgatctgacccgcaccaaaggccgcgaacgttcgggccgttttcttatcgaaggcccgcaatccgtgcgcgaggccgtcacttggcggccggacgtggtgcaggacctctatgtggaggtttcgcaggcgttggaacatccgcgtatcatctcctccacgttggagaagatcgtcgaaacctcgcaggatgccacgatttatgtgcactactgcaccggcgacgtgatgcgccgcatcagtccggacgcccagggcatcgtggccgtcggcaatgccgagtccatgcacgccggtgccgatgacgtcgaacttggcaagaacggccggggcccgcagatcgccgccttctggcaggtgcgcgacccgggcaacgccggcaccgtgatccgtgcggccgatgcggccggctgcgacgccgtaatcttcgtggacgactgcgtggacgtgctgaaccccaaggtcatccgctccaccgcaggctccctgttccatctgccggtactcgccatgagcaccgacgaattcttcacctggacaggcgacgaccataatatgggcgtctgggccgccgacgtatacggcaccgaagaatgcaagccggaaagcctgcccgcagtactggcggacaaggcggcggtcgaggctccgaaagccgtgctgttcggcaatgaggcgcgtggcttggaaccggacatcctcacacgctgcggccgcatcgtctccatcccgctgtacggcaaggccgaatcgctgaaccttggcacctcggccgcggtgatgttgatgtcgctgtctatgtcgggtcatgttgaaagaatgtgaaaccggtaaaaacgctgtgaaacgctgagaaaacatcagacgaaagggttctcgtggcagaacaaatggtgttcgacgccgaccaggtgaccgctgaggttgccgagggcatcgagaaaatccagaacgcctccaacctggaggagctcaaggccatcaagacaacgtacgcaggtgccgattcggcgatgaccaaggccagcaaggccattggctccctgcccgtcgaccagaagaaggaagccggcaagctcatgggcaagctgcgcgccgacttcggccgtgcctatggccccaaggaggtcgagctcaaggaagccgccgagaaggccgcactcgccgctgaaaccgtggacatgacgctgccggtgaaccgcaagcctctgggcgcccgtcacccgctgcccaagctgatggaagacgtcgaggacttcttcatctccatgggctggcagatctcctccggtccggaaatcgaagccgaatggtacaacttcgactccctgaacttcggcccggaccatccggcccgccagatgcaggacaccttctacgtcaagggcaatcaagccaaggacgccgccggtttcgtcggctccaacatggtggtgcgtacgcagacctcctccgatcaggtccgtgccctcctgacccgtggcgtgccgctgtacatcgcgtcccccggccgtgtgttccgcaccgatgagctggacgccacccatactccggtgttccaccagtgcgaagccctcgccgtcgacaagcacctgaccatggccgacctgaagggcgtgctggacaagctcgccgtcgccatgttcggccctgaagccaagacgcgcctgcgcccgagctacttcccgttcaccgagccgagcgccgagctcgacctgtggttccccgacaagaagggcggccccggctggctcgagtggggcggctgcggcatggtgaacccgaacgtgctgaagtccgccggcatcgacccggatgtctacaccggtttcgccttcggcgtcggcatggagcgcacgctcctgctgcgcagcgacatcaacgacatgcacgacctggtcgaaggtgacgtgcgtttcgccgaacagtttgtgatgggggagtgattcagccatgcctatgatcgatatcgattggctcaaggaccatgtcgaggttcccgaaggcctgacctacgaacagctcgccaaggaccttgtcaaggtgggtcttgaggaagaggagattcactcctcccaggtgaccggcccgattgtggtcggctacgtggtcgacgccacccccgaaccgcagaagaacggcaagaccatcaactggtgccacgtggactgcggcgacgaatggaacgagaccgacgaagacggcaacaaggtgccgcgcggcatcatctgcggcgcgcccaacatgaaggccggcgaaaaggtcgtcgtcaccctgcccggtgccgtgctgcccggcgacttcaagatcgagccgcgcaagacctacggccacatctccaacggcatgtgcgcctccgaacgtgagctgggtctgggcgacaaccacaatggcatcattctgctgcgtcagtacggcttctccgaggctgaatatgaggctctgaagcctggtcaggacgccatgcacctgctgcacctcgaccagcctctgcttgagatcaacatcaccccggaccgtggctacacgctgtcctaccgtggcgtggcccgcgaataccaccactccaccggtgccgcctacaccgatccggccgtggcactgaacgagaaggccccggaacctgctgactaccagcccggcaccccggtggacatcgatgttgaaatcgacgataacaatccgattcacggcgtgcccggttgcgaccgctactacgcgcgtatcgtcaaggacttcaatcccaacgcccacacgcccaactggatgcgccgccgcctgattcgcgccggcatgcgctccatctccttggccgtggacgtgaccaactacgtgatgcttgacctcggccagccgatgcacgcctacgacctcgacaagctcgaaggcccgattgtcgtgcgccgcgccaacgagggtgagaaactcaccaccctggacggcaaggaacatgacctgagcgtcgaagatctgcttatcaccgattcgccgaacggcgaacgcggctcgcgcatcctcggtcttgccggtgtgatgggcggcctgtatggcgaagtgaccgctgacaccaagaacattcttctggaggcagcgcacttcgatcaggtgaccatcgcccgttcggcccgtcgccacaagattccatccgaggcctcccgccgcttcgaacgtggcgtcgacaccgcgctgcagcccgccgccacccagatggccgccgagctcatggccaagtacggcaatggcgagcccagcgaacacccgaacgacgtgaacaacacgccgcgcgccaaggtcatccacttcaaggcctccgaagtggcccgcgtggccggcctcgacgtggacatcaaccgcatctccgacatcctgaccgacattggctgcacggtggccggcggcggcaacggcgagttcgccgtaaccgcgccgagctggcgtccggacttgaacgagccgtgcgacctggtcgaggaaatcgcccgactggtcggctacgaccagattccgatcaccgtgccgccggcaccggtcgagggtctggtgggcctgaccccggaccagcagcgtcgccgtcgcgtggcggacgagctcgccgagttcggcatggtcgaatcgctgagctacccgttcgtgggcgacgacgattacaaggccttcggcttcgacccggaagccaccaagaaggtcagcgtcgagatcgccaacccgctctacggcgaccgtccgtacctgcgtcgcgagattctgccgaccctggccaccaccgtgcagcgcaacatccgccgcggcatcgaaaacgtgtccctgtatgagctcggccacgtctacctgtgggatccgaacgcgcccgccatcccggcactgcccggcggcgtgcgccccaccgacgaacagctcgccgcgcttgacgccggtctgcccgaacagcccgaccatgtggccggcatcctgaccggtctggccgaggacgatggctggatgggcggcaagcgcccggtcgactggtccgacgccgtcgaggccgtgcgccgcatcgccggccgtatcggtgccgcaatcgaactcgaccagcccgccgccgccgatgtgcccgtccaatggcaccccggccgcgtcgcccgcgtcatggtgggcgacgtcttcaccggctgggttggtgaactgcacccgcgcgtcaacgaggcgctcggcttcccggcccattccgcggccttcgagctgaacctcaccgcgctgttcgccacgctgaccggcaagcccgtccaggccaagccgatctccacgttcccgccggtcaagcaggatttggccttcaccgtggacgagaccgtgaccgcaggccagcttgagaacgtgattcgcaaggccgccggcgcgaacctcgaatccatcgaactgttcgacgtgttcaccggcgaacaggtgggcgagggcaagaagtccctggcctatgcggtggtgttccgttcgccgagcaagacgctgtccgccgaagacagcgacgccatccgcaaggccatcgtggctgaggccgccgaaatcggcgcccagctgcgcgcctgacccaaccgatcatccgaatcgaggagcgccatgagccaaccggagcaggacaagccgaaatacgggcagtaccagcagcctgaatatggtgctatgtctggccaatacgggccgaattacaacccgtatatttatggcgctcccgagccggataccaagaaggattccgccgcagccgctggcatcaacggtggcgcggcgcaatcccagcaggccggccagccgtacggccagcagacgccgtggcccggcaatcagcaggcgggcggctggccgtatgctcaaggcggccaacagtccggtccgggcgcatatccgggcgggtacccgggcatgcaggggcagtcgtatggtcaacagccgaacggtcagcctcaccagccgcattattaccacggcatcgacctgaacgatccaaaccagaacccactctacgggcactgggattcgtatgcgatcatctcctttatcctcgccctgttcttcccggtgccagtgctctcggcactgatgggcgcggtggcaatgtggcgcacgcgcaccttccatatgaaaggcttcggtttggctgtggccgccgtggtgatcaacgtgctgtacaccatcgccgtcatttggatggccttcaatggctatgacgccatgagcctctaccaggaagccctccagcaactcaccggcggcaccggctcctcctccgactccatctccgcataagtagcgttcacataccaacacacccactgcataaatatgcaatagtctgcataatcgcgtatactcatccgaagaaacatcagtgaaaagagatgagtatggcgaaatatacagtggccgtggccggtgccacgggctatgccggcggtgaagcgctgcgcattctggccgcgcaccccgacttcgacatcacctgcgtggcaggccattcctcagtgggggagtcgatggccaagcacatgccgcatattccccaactggccaatctggtcgtcgaagataccacgcccgaagtgctgaacgggcatgacgttatcatcctcgcactgccgcacggtgcttcgggcaagctcgcctcgcagctcgatccgaatgccgtggttgtggatttgggcgccgaccatcgtctcgaagagcaggccgcttgggatgagttctacggcggcgatttctatgagcattggacctacggcatgcccgagctcatcaccggcaaagccgcggacggctcatacacccgccagcgcgcggcgcttcctggtgccaagcgcatcgcaggccctggctgcaacgtcaccgccaccacgctggccctccagcccggcatcgccgaaggactggttgaatcgcaggatatcgtggccgatctggtcgtcggatactcgggtgccggcaagaatctcaagcgcaccaacctgcttgccgccgaggccctgcaatccgccctgccgtattcggtgggcggcaagcaccgccacattcccgagatcctgcagaacttcgcccacgcggccggcaagagcgcggccgaagccagcgaattcacgctcggcttcacgccgattctcgcccccatgtcccgaggcatcctcgccaccgtgtccgcccgcatgacggacaaggccaaggcactgagcgatgaggagattcgcgccgtatggtccaaggcctatgaaggtcaggacttcatggtgctgctgcccgagggcacactgcccgccaccggcaacatcatcggatccaacgcagcccacctgcaggtcgtcgccgaccgcaaggccggccgcatctacgcttttgccgccatagacaacctcaaccgtggcaccgccggacaagcggtccaatcactgaacatcgcactcggcctgccggaagacgcgggcctgaccaagatcggagtagcaccgtgagcgttacatttgcacaaggtttctccgccgccggcgtggcggctggtatttcatccgtcgaaggcaagaaggacttggccctcgtggtcaacaacggcccgctcgacgcggctgcaggcgtgttcacctcgaaccgtttctgtgccgccccggtgcagtggagccgtaaggtcgtcgccgacggtcacgtcaaggccgtgattctgaactccggcggtgccaacgcctgcaccggcgaggccggttacgcccagtccgtcaccaccgcggaaacggtcgccggtctcatcggcgccgaaccgaatgatgtggctgtctgctccaccggtctcatcggtgaactgctgccgttggacaacgtgctggctggtgccaagagtgcccatgaggctcttgccgccaccgccgaagccggtgccgacgcctcccacgccatcatgaccaccgacaccaagccgaagacggtcgaactgaccggctccaacggctggaagatcggcggcatggtcaagggctcgggcatgattgccccgcagctggccaccatgctgtgcgtcatcaccaccgatgcggtcgtctccgccggccagatgcaggccgcactcgccgtggccgccgaacattcgttcaaccgcatcgacgtggacggctgcatgtccaccaacgacacggtcctgctgctcgcctccggtgcctccggcgtcgaaccggacaaggacgaattcaacaagctggtgcgtgaggcctgcgtctccctgtcccgccagatcatcggcgacggcgaaggtgcctcccacgacattcgcatcactgtcaccggtgccaccagcgaagacgcggcacttgcctgtggtcgtgccgtcgccgcctcgaacctgctcaagtgcgccatctccggcaacgatccgaactggggccgcatcgtcagctccctgggcactgtgccgcctgaagtcgcgccttacgattcgaacaaggtgaccgtggacgtcaacggcgtgcgcatctgcgagaacggcggcgccggccgcgaccgcagcgaggtcgacatgaccccgcgcgaagtccacatcgacatcgacctgaacaccggctcggacgccgaggccaccgtctggaccgacgacctcacccacgaatacgtccacatcaacgccgactacgaaagctgacaaacagcccagtgggctgtttgtagcagccggcagcgatagcgtcgccggcgtcgcatataacgcaaacagcccagtgggctgtttgtagcagccggcagcgatagcgtcgccggcgtcgcagaaaagagaaaaattggctacagaattgaagggacctgggttccatttcgacgtgcacaccgatttgcgcgccgatcagaaggcagaagtgcttattgaagcgctgccttggctggaggagttcgccggccagcgtatcgtcgtcaaatacggcggcaatgccatggtcgatgaccatctgaagcagtgcttcgccgaagacatggtcttcctgcgtcaggtgggcctgcatccgatcgtcgtgcacggcggcggcccgcagatctcccacatgctcaaggccctcggcatcaaatccgaattcaagggcggcctgagggtcaccacccccgaggccatggacgtggtgcgcatggtcctgaccggcaaggtgtcacgcgaactggtcggcctgatcaacgcgcacggcccgctggccgtaggcctgtccggtgaagacggcggcctgttctcggccatgcagcgcaggcccatcatcaatggcaagcccaccgatatcggcttggtcggcgatgtggtttccgtcgatgcctcggcagtcgaggatctggtggccgccggtcgtatcccggtcgtctcttccgtggctccgaacgaagaagatgccactgaagtgctcaacgtgaacgccgattccgccgccgccgctttggctgccgctgtgggcgcacgcaagcttgttatcttgaccgatgtggatggtctgtacgccgattggccggacaagaattctctgattggccggatcggtgtggaaaacctgcgcgatatgctgccggacctggaatccggtatgcgacccaagatggaggcctgtgtcagggccatcgacggtggcgtgccccaagcccatatcatcgacgggcgcaagccgcattcgattttgaatgagatattcacctccgcaggcatcggtaccatggttatgcccgatgaaggactggaaatgaggagctcttatggctactgagcatgaggaaaaactaggtacggaagacagcaagtggctgggagagtactctcaggtccacatgaatgtgttcggtacgccgttgcgcgtcatggatcacggccaaggtgcccacatctgggatgttgacggtaacgaatacctcgatttcctggcaggcatcgccgtcaattccctcggatacgcccaccccaagtgggtcaaagcggttgccgatcaggctgccaaggtggctcatatcagcaactatttcgcgtccgagccgcaaattgagctggcatccaaactggtcaagctggctggtgcacctgaaggctccaaagtctacttcggcaactccggtgctgaaggcaatgaagctgccctcaagcttgccaagctgtatggccgcaccttgcctggtgccctgccttccatcggcggcaagcccgcacgcattctcgcaatgactcacggcttccatggccgtacgatgggtgcgctgtccgccacatggaaacccggtatccgcaagccgtatgatccgctggtgccgaacatcgaattcgtgcgcgccggcgacaaggtcgccctgcacgacgcttttgcacagaccggtctcggccgctatggcaagggtccggtggctgctgtgattctggaacttatccagggcgaagccggcgtgcagccgttgggcgccgattacgtcaagttcgtgcgcgaactgtgcgatatcaaccacgcgctgctcatcatcgatgaagtacagaccggtatcggacgtaccggcaagtggttcgcattccagcgtgacgatctgtccggcggcgtgacgccggatatggtgactttcgccaagggcgtggcaggcggattcccgatgggcggcatgatcgctttcggcgagaaacttgcggctctgttcactcctggttcccacggctccacctttgccggcaatccgctgggtgcggctgcgggactcgccactcttgacgtgattgaagacgagaatctggtgaccaacgccgaagctcgcggcaaacagctgcgcgatggcattatggccaccggtaatccgctgttcgtttccgtacgcggccgtggtttgctggacgccgtcgagctcaagcatccctgctcccacgcggtgatgaactactgcctcgaacacgggctcatcgtcaacgcggtggctcccaatgcgctgcgtttcgcaccgccgctgattgtaaccgctcaagacgtggatcaggcacttgccatcctcaaggatgtgcctacggacctgcccgacgactgatttctcgccgtcactgccgacccaccgatccaaggagatcatcatgaccccagaacttcgccacatgctgcgtgacgacgacctcaaccatgaggagcagaagcaggtgctcgaacttgccatcaagttccaccatgaccgcttctacaagcagccgttcgccggcccgcaggccgtcgccgtactgttcgacaagccatccacccgcacccgttccagcttctccatcggcgttgccgagcttggcggctacccactggtcatcgacaagtccggctcccagctgggccgtggcgagcccgtggccgataccgctcgtgtgctcgaccgcatggcttacggcgtggtgtggcgcaccttcggccaggaccgcgtcgaagaaatggccaagtactccacccatccggtggtcaacgccctgaccgatgacttccatccctgccagattctcgccgacttccagaccatcgccgagcaccgaggcggcgtcgacaacctgaagaaccagaccatcgcctacctcggtgacgcggccaacaacatggccaactcctacctgctcggcggtgccgtggccggcatggacgtgcgcgtggccggcccccacggctacctgccccgcccggacatcgtggccgacgccaagcgcgtcgcggccgagaccggcggctccatcctggtcaccaccgatgccaaggaagcggtgaaggacgccgactgcgtgttcaccgacacctgggtctccatgggcgaggaagccgaatacgccatccgctccaaaccgttctgggattaccaggtcaacaccgaacttatggcattggccaagccggatgcgctcttccagcactgcctgcccgcctaccgcggcaaggaagtcaccgctgaagtgatcgacggcccgcagtccgtggtgtgggatgaggccgagaaccgtctgcacgcacagaaagcgttgctgacttggttgaccggcaaggcccgtggagacgaaagcctgctcgcatgagtgaaaccggtccgtccctgcagcgccctgccaccagggcggcgcggctgagtgccatagaacaggcgctcgccacgcatatcatcacctcgcaatcacagctgtccaaaatccttatcgacgagggcattgcggtgactcaggcgaccctgagccgcgatcttgacgagatgcatgcggtgaagacccggctgaaggacggcacggtggcctacacggtgggccgcagcgtcgttgcttcggaaggtgaggatgtaggggagcgcggtgaggcacagatgtcccgcgtgctgaacggactggtcacctcggtggccgccgccggaaatctggttgtggtgcacacgccttccggtgccgcacaatacgtggcctcggtgattgacaagcagccgatcgaaggcgtgctgggcaccatcgccggagacgacaccgtcatggtgatttgcaccaatgacgacaccgccgtctcccgctccgactggctactaagcctcgcttccaaataaccaacacgccgtgcataaatatacagtcctctgtatatacttgcatcagtttgtttttcagaccttgaatgaaagggaaccaatggcagataacaagcgcattgttctggcctactccggcggtcttgacacctccgtcgccatctcgtatctgaaggagcgcaccggcaaggacgtcgtggccgtgtccctcgacgtcggccagggcggcgaaagcctcgagaccatcaagcagcgcgcccttgcctgcggtgccgttgaatcctacgtggtcgacgcccgtgacgagttcgccaacgaatattgcatgaaggccctcaaggccaacgccatgtacgaaggcgtctacccgctggtctccgccatctcccgtccgctgatctccaagcacctcgtgcgcgccgcccaccagttcggcgccgacaccatctcccacggttgcaccggcaagggcaacgaccaggttcgtttcgaggtctccatcgcctccatcgacccgacgctgaaggccatcagcccgattcgcgacctgtccctgacccgcgacgtcgagatcgcgttcgccaaggagcacaagctgccgatcacccagaccgagaagtccccgtactccatcgaccagaatgtgtggggccgcgccattgagaccggcttcctcgaggatccgtggaacggcccgaccaaggactgctactcctacaccgacgacccggccttcccgccggtcgaagatgaagtcgtcatcgagttcaaggaaggtgtgccggtcaagatcgacggacgtgacgtcaccccgttgcaggccatcgaagagatgaaccgccgcgccggagcccagggcatcggccgcatcgacctcatcgaggaccgcctggtcggcatcaagtcccgcgagctgtacgaggctccgggtgccgtggctctgatcaccgctcaccaggaactcgaaaactgctgcctcgaacgcgaacagcaccgcatcaagcgcgacatcgacaagcgctggggcgagctggtttacgatgcgcagtggttctccccggcaacccagtcgctcaacgccttcatcgaagacacccagaagtacgtgtccggtgagattcgcatggtcctgcacggtggccgcgccgtggtgaccggccgtcgttccgactcctcgctgtacgactacaagctcgccacctacgattccggcgataccttcgaccagaggtcctccaacggcttcatcgacatctatggcctgccgtcccgcgtggccgcagcccgcgacgtcaagttcggcaacggcatcgaggtcccgaagaacaccgtcgagtaattcttactcagtcgcccccgctgcgaggctgtcggcatagctgactgggagtggtctttgaaaggactgtcctcagtcacactccatgtgacagccctcgccagcgggggcaactgtatgtttgaacacattgctacgcttaaacacagctattttcacttttcaaggagccttcatgactgagaacaacgaacatctggccctgtggggtggtcgctttacgtccggtccgtcgccggaactggcccgactgtccaagtccacgcagttcgactggcgcttggccgacgacgatatcgccggttcccgcgcccacgcccgtgctctcggccgtgcgggacttttgaccgccgacgagctgcagcgcatggaggatgcgctcgacacgctccagcgtcatgtggatgacggctccttcgcccccatcgaagacgatgaggacgaggccaccgccctcgaacgcggactgatcgacattgccggcgacgaactcggcggcaagctcagggccggccgttcccgcaacgaccagatcgcctgcctgattcgtatgtggctgcgccgccactcccgtgcgattgccggactcctgcttgacctcgtcaacgccctggtcgagcagagcgaaaaggccggccgcaccgtgatgccgggccgcacccacatgcagcacgcccagcccgtgctgctcgcgcaccagctcatggcccacgcttggccgctgattcgcgacgtgcagcgactgatcgactgggacaagcgcatcaacgcctctccgtacggctccggcgcactggccggcaacacgctcggcctcgacccggaggccgtggcgcgtgagctcggcttctcccgcgtgaccgacaactccatcgacggcaccgccgcacgtgatctcgtggccgaattcgcgttcgtggccgccatgaccggcgtggacatctcccgcctgtccgaggagatcatcatctggaacacccaggagttcgccttcgtcaagctcgacgacggctattccaccggctcctccatcatgccgcagaagaagaacccggatatcgccgagctcgcccgcggcaagtccggccgactcatcggcgatctgaccggtctgctggccaccctgaagggcctgcccaccgcctacgctcgcgacctgcaggaggacaaggaggccgtgttcgaccaggtcgatacgctcgaagtgctgctgcccgccttcaccggcatggtcaagaccatgcacttcgacagcgagcggcttgaagaggaagccccgaccggcttcgcgctggccaccgacatcgccgaatggcttgtcaagaacggtgtgccgttccgccatgcgcacgagctctctggtgcctgcgtcaagctcgccgaaggccgcggccaggaactgtgggatctgaccgacaatgacttcatcgagaccttcgccgcgttcctgccggccgacaaggctccgggagtacgcgaagtgctctccagccacggttcggtcgactcccgcaacggcaagggcggcaccgcttacggtcgcgtgcgcgagcagatcgccgacgccaaggccgaggtcgaagaactcaagctcttccccgcatccacgtcggatggctccgcctacaaagcccccggcacgttctagtcccaatagagctccctcgtcagagggagctctattttgctgttgtcactgcaacggcatacactgagaaatcgtaacgaacgggagccgtgaggctgagaggaagtcgccagacttcgaccggggaacttgacgcgggtcatgccgccgtaaggaatcgttgttgcagatttgccgggttctccgatacagctttcattccgtttgcataattcagccgtgagacggtcgtgatggagccaatacatcacagcggtcgaacggtcgcatgattgggttcatgaatgggcgcaccacttaaggtacggttcgtttcgtgcacccttttttactatctgaaaggatattatgcaggtcaacggagagcaggtcacgctcgagacgccggtcagcgtcgccgattatctcgaagcgcacggattccgcgccgagcgtgtggccatcgaactcaatggtgagattatcccgcgcgataagcgtgccgacgccatgctcgacgaccagtgcgtcatggaaattgtgcagtttgtacagggtggatgaaaggaaaagctatgagcaatattaatccggttactgaagcatctgttgaggcgactccgctgccgccgcagcccgccgtcaccaatccggtcggcaccgccgcgccgattctgccagtggaagacaagccgctgaccctgggcggtcacgagttccagtcgcgattcattctgggctccggccgctacgacctgaacctcatcaaggccacggtcgaacatgcaggcacgcaaatcgtcaccatggcactgcgccgcgcgcagaccaccgagaacagcgtgctcgactacattcccgaaggcatcacgttgctgcccaacacctccggtgcgcgcaacgccgaggaagccgtgcgtatcgcccgactggcacgcgaagtgtgccacaccgacttcgtcaaggtcgaaatcgaacacgagaccaagtacctcctgccggacaacgccgaaaccatccgagccaccgaaatgctggccaaggaaggcttcgtggtcatgccctacatgttcccggacccgattgccgcacgccagctggaggaggccggtgccgccgccgttatgccgctcggttcgctgatcggctccaacatgggcctgcgcatgcgtgacttcatcgagatcatcatcgccaatgcgcatgtgccggtcatcatcgatgccggcatcggacgcccgagtcaggcatgcgacgccatggagatgggtgcggatgcggtgatggcgtacacggccgttgcctctgctggcaatatcccgctgatggctgaggcgttcaagcacgccatcgatgctggtcgtgcggcgtatctgtccggtctgggcaaggtgaccgagggacaggccgtgccgtccagtccgactacgggatatttgcactgacacttttattagctcccctctctgaggggagctggccgcgtagcggactgaggggagctggaaacatggagaaaacatggcattgactgatgaacaggtggagaggtacgcgcgccatctgattttgaaggggctgggcgtcaaagggcagaagcggttgttggcctccagcgtgctcatcattggagcgggcgggcttggctctccggccgccctgtatctggcggcggccggcgtcggccatatcggactggtggacggcgatgtggtggatatgagcaatctgcaacgtcagatcatccataccactgcacgtgtcggagcgcccaaagtggaatccgcggccacggccatccgcgcgctcaacccggatgtgacggttgatacctactacgagctcgtcgacgcgagcaacatcgccggcctcatcgaaccgtacgatctggtgatcgatgccaccgacaacttcgccgcaaaattcctcatcaatgacgcctgcgtgctggccggcaagccgtacatccatgccggcgtggtcggattcgccggtcaggtgatgaccgtcattcccggcgaaggcccctgctaccgctgcatcttccgcgacatgcccgccgccggtgagattccgacctgcaaggaagccggcgtgctgggcgcggtggtcggtgtgatcggcagtctggaggcgactgaggccgtcaagctgattgccggcgtgggggagccgctcgtggctcgtatgctcactgtggatgccctgaccatgaacatccgccgtgtgccgttgccgaaccatgtgcccgactgcccggtgtgcggtgagcagccgaccattactgctattgatccggccaactatattcagccggcttgcgcgatttagagctatgtggcacccctccttgaggggagccaagatcggaacgagaggggaagaacatgcctattgctttgcgtaatgcggtcgatgacgatgagagcagtgaagcatcgtaccgccgcatcacgccggcggaatttgccaagctcgacccgaatacggtcacgctgctcgacttgagggaaccagccgacttcgccgcccacccggtcgaaggtgccatcaatgcaccactcgaccctctggcccatgtgctcaaaaccgtgcccacagatcgaactgtcgtagtctattgtgctcaaggatggtggagcgaggaagtagctgaaatccttgccgatcgcggttacgatgtagcaagcctcgatggcggttttcagggttatctcgactatcttgaaacccaccacgattaacggttcccgttgtcgttcttttggatgagtgtgcacggacatacgtgtgccctacaatcggtcacggtattactcgatggattcttgaatatcgtcgggtaatcgtaattcacaacaggggattgcactgaaccaacccaaaacgggaaggaccgaaaatcgtgggacatctgctcacccgaacgcagattcaacgcctggtcgccaagcacggccgtgaggtcatcgagcatcgccacatgcagatcgaacgctgctgctaccagcacggcaatgtcaccacgttcgaacattccgtgcgtgtcgcctgcctggctgtgtggatggccgaccgcgcacacctgtggtaccgcgtcgacctcaaatccctgattcgcgcggccctcctgcacgattacttcctgtacgactggcacgactgggataacggcgaacaccagtggcatggcttcacccatggccacgccgccctggtcaatgccctgaaggacttcaagctcaacgatatcgaacgcaacagcatcgagaaccacatgttcccgatgaccccggtgccgccgcgctatatcgaaggctatctggtcaccttggcggacaaatgctccgccaccgccgagaccttctcgttcgaccggttcaacaagcgcgcgttgcccgccgcgaagccttacgccgagatcgaagcccgtcgatgatcatcacactcgaacattatttcctctggtttctgttctacagtttcgtcggctggatgtacgagtccattctcgtctcctgccaacagcaccgcttggtcaaccgagggttcctcaacggcccgctgtgcccgatctacggcaccggcgcgatactcggcgtcgccattctcggcaacgtacataacccgatcatcatcttcctgatttcgatggtgggcgccacgatactcgaatacacaacctcgtgggtcatggagcagctgttccacgcccgctggtgggattactcgaacttccgcttcaacctccaaggccgcgtctgcctgctgggcgcgttgattttcggcctcggcggcgtgggcgtggtacttggttcgcagccatatgtcgagcgggtcacggatatgattccgctgccgatgctgcatacgctggtcacggtactggccctgatcaccatcatcgacttggcggtcacggttgcgggcatgctcgaattcgagcgggtgctcgattccgtctctcaggtggtgcaggatgtggcggcacgcgccggtggcacgtggcagtggggctccagtgcggtatccgacaggatgcgtgagctttcgcaggatacggttgagcgtctgcgctgggccgtcaatggcgtcatcaacgcacagcagaagcgtatgctcaagtccttcccgaagttccaggtgccggatcgtcaggacatcatcgactctttgcgcgaacttatgggcccgcgccgctagaataaggcgttttactgaatcgcgcggctcggctggtgttcggcactgtcgccatgttctgcgaaacttgactgtgcccaattgggcagtcttattcacaattcgatagggagaagcgacaagctatggctcacgtcaccgacttcaaggaagcgggtttcaacaccctgcttgaggaactggaatggcgcgggttgatttcccagtccacggaccgggatcgactcgcagaagcactgaacggcgagcccatcacctattattgtggcttcgatcccaccgctgcatcgttgcatatcggcaacctcgtgcagctcatcaacatgcgtcacctgcagcttgcgggccatcatccgatcgctttggtcggtggcgccaccggactcatcggcgacccgcgccagtccggcgaacgtacgcttaacccgaaggacgtggtggccggctgggccgatcgcctgaagaatcagatcggcggcattctggacaccgaaggcgcgaacgccgtacgtttcgtgtccaattacgattggaccgcctcgatgaccgtcatcgacttcctgcgtgacgtcggcaagaacttccgtctgggcaccatgctcgccaaggacacggtcgcccgccgcctgaactctgaggaaggcatctccttcaccgagttcagctaccaggtgctgcagggcaacgacttcctccacctgtttgacgaataccactgcacgctggaactcggcggctccgaccagtggggcaacctcacctccggcctggacctgatccacaaggtgcgcggtgtggacgtcaacgtgttcaccagcccgattatcaccgatgcttccggcaagaagttcggcaagtccgagggcaacgccgtctggctcgacgccacgatgctcagcccgtacaagttctaccagttctggatcaaccgcccggacgtggagatggaaagcctgctgaaggcgttcaccttcctgcccaaggccgaaatcgaacgactggtcgaggaatccaagaccaaccccggcaagcgcgaggcccagaagacccttgcctgggaggtcaccagcttcgtgcatggcgaggccgctacccaggctgccatcgacgcttccggtgcgctgttcggccgcggtggcaacctcgaagacatcgacgaggaaacgctggaatccgtgctcgacggtttcaaggtggtcgacgagaacggcgagcacgtcttccccgtctccaagcccggcgatcgcgtaatcgacgccgcccaggctgccggactgttcaagtccgcttccgaggcacgccgcgccatcaagtccggtggcgtgtatctcaacaacaaccgtatcgaggatgaggagcaggtgctggccgaagccgacttcctggcaggccgcttcgcgcttatccgtcgtggcaagaaggcgctcggcgccgtggaaaaccgttaatcaacaacgaattaaggaaaacaagtaatggcagaaggtaacgagcgttccggcaagtcttacggcggcggccataaggggtatggcgatcgccgaccgggcaaccgcggcggcaagggtttcaagccgcgcggcaagggcggtttcaagccgcgtcatgatggtgagggtttcaagccgcgtcgccgtgaggatggcgagggctacgcgccgcgccgtgacggtgatggcgagggcctcggcggctaccgcaagtcgtacggcaagtccggcggcttccacaagggcggccgctccggcttcggcggcaagggcggttaccgcggcaatggtccgcgccgtgacggcgaaggcttcaagccgcgccgcgaaggcggctaccgttcccacgaaggcggctaccgttcccacgaaggcggctaccgttcccacgaaggcgagaacggcgagaatccgcgctaccagcaccgtgataacgatcgtcgtgatttccgccgcgatggtgagcgtcgcagcttccgccgcaacgacgaccgccgagatttccgtagggacgaccgtcgcgatggggaccgtcgtgacttccgtcgtgacaatgaccgtcgtgacttccgtcgcgatgaccgcagggataacgatcgtcgtgatttccgccgcgatggtgagcgtcgcaacttccgtcgcgacgacgatcgccgtgatggcgaccgccgcaacttccgcagggacgaccgccgcgatgatcgtcgtgacttccgccgtgacgatcgccgcgacaacaaccgtcgtgacggcgaattccgcgagttttcgcaggaagagaagcgccagtaccgtgaggagaagcgctctgaatacatgaggcgcccgcgccgtaactccgacggcacgatgagcttcccctcgcagaacccgtacaccgaccgtcgtcccgacgagcccaagatgcccaagggcatggaatggtcgatgctgtccaaggatgagcgcgaacgtctgcgcggcctgtccaaggagcacgcggagaacattggtctgcacatcctcgccgctttcgcgctggaggagagcgaccccgaacttgccttggagcacgccaagtgggtggcccgtcaggcctcccgcatcgacttcgcccgcgagacgcttgcgttcgtggcctaccgtcagggcgactacaagctggccctgcgtgagttccgcaccgcctaccgtatgaacggcttcctcgactacctgccgttcatcgctgactgcgagcgtggcgtcggagagccgaagaaggccgtggaactggcgctgtccgatgagggcaagcagctgcatggcgctcccaaggtcgagatgttcctggtgtacgccggtgcccttggcgatttggagatgtgggacaaggccattgaagtggttcacaccgtcggccgttcccaggggctgccgggtgagtaccgcatgcgtgccgtgcaggccgagcagtacttccttgaagaggccggccgcagcaaggaagccgagcagctcaacgacctgctggaccgtcttgaggaccagtatgccgacgaggagattgacgaaaacagcgacgacgtggtgatcgatcacgatctcgaagacatcaccgacgactccgacgtgctcgaaaagctcggcatcgatccggatgaggcgcagtacgccccggatccggagcaggaatacggcgatgaggatgacgaggctgaagacggtgatgccgagtctgatgaggccgacgagaccgagaccgattccgccaatgacgccgaggctgacgattccgccgaatccgccgactccgactccaccgaacccgaaaccgaaaccgaggagtgaacggcgtaatgacccgtttcctcaaaggcaccgatcgcccgctcgccgaggcctatcagcttgcgctgctggacctcgacggcgtggtgtatcgcggcaagaatccggtcgaatacgcggccgattccattcgtgcggccgaagccgccggcatgaccatcgaatacaccacgaacaactcctcgcgcttccagcacgtggtggccgaccagctcaagggcttcggcttggacgtggagccgtggcaggtcatcacctcttcggtggtggccgcccgtatggtggccaaggcgttgcccgccggcgcgcgcgtacaggtattgggcgccgagcatttgcgcgatgaggtcacccgcaacggcctgaccatcgtggacggtcctcaggaccgcccgcaggccgtcattcagggctggtatccggatatgacttggcagatgatggccgatgccgcgttcgcggtcgaggccggagccacgtatttcgtgaccaaccgcgacctaacgattcctcgtgaactgggcatcgcccccggttgcggatcgatgattcgcgccgtgatcacggccaccggcgtcgaaccggtcgcctccgctggcaagccggaagcgtacatgtacgatgaggcccgcgaactgaacgccgccgaaggccacgatttggtgcccaaggaggcgtccatcgccattggcgaccgcctcgacaccgatatcgaggccggtaaccgcggcgactacgattcgctggcggtgctgaccggtgtcaccaacccgaccgaactgatgctggctccgtcacacctgaggcccacattcatcgcccctgatctgcgtgaactcggcgaagcccaaccggagccggtccgcgatgagagcggtacttgggaatgccgcaaggctagcgcttggtttgaaaacggccaggtacacgtcagcgaccccaccagtatggacggcctgcgcgccgccgtatgcgccgcatgggaagccgccgaccaaggcgcacagcttagcgaggccacggtaccggtgttcgccatcgaggcatagtcctatgcctacggatagcgaacatgcgccggtcaccgagcgataccccgaacttgcggatatcgatgaacaagacaacgaccgcaagcttgagacctatcgcaacgtgctggaatccttacaacacgagcttgataacagccgcagctagcagaggtgattcattctcccgccagcggaagatgacgtgaagtgctggatggtggctccatgccgagccaccccgttggtggatggtgggccgaaaggaagatatatgaccgagcagcatatcgatcccgcgactccacttgaccgacttgacatgatgctcgtggcttcgggactggtcgaatcgcgggccaaagcgcagcgactcatcaaggccgggcatgtgcgcgtggacggcgagaccatcaccaagccatcgttcatggtcaaagccgggcacagcgaactcgccgtggataagggcgacgactacgtctcccgaggcgcttacaaactcttgggcgcgttcgaaacctttgccggcaatggccttaccgggccggaaggcttggaatgtctggatatcggtgcctccaccggtggcttcaccgacgtactgttgcgcgggggagcggccaaagtcgtagcgctcgacgttgggcacggccagctcgacccgcgcatcgccaatgacgagcacgtcatcgaaatgagcggcgtcaacattcgcgaagtagaggccgacgacctgccttaccggccggtgatgatcgtttccgacgtctcctttatttccctgacctatgtgatcccggtaatcgcgcgcatcgcggctcccggtgcgcagattgtgttactggtcaaaccgcagttcgaggtcggccgggcaggactcggcaaaaacggcatcgttgaagatccggcattgcgggagcgggcattacacgacgtggtcgcctgtgctgaacagcacggacttgacgtggtggccactgccgatagtcccatcatcggcacccacggtaatgaggaatacctgctttacgctgtcttgagatgaatgcgttggcagtctccgttcaccagcagcacgctggaggtacggtcgatgcctagtgcggtggcacacgtggcgctttccaccgcactgccgttgcgtagcatggcggagtccgccgtcaaagtccggcattgcagatggttggcttcaaccgtgacggctgtgatatggcgaaccgtgctgccatcctcatacccatccatatcaaaacgggaaaacatcgtactgcggagtggatgaacttccagagccctgctgttgacgtcatgacccttcaacacgccgttcaagcggactgtctgaccgctaatatgacgggtgcctagggagccattgacggacagatttccggaacaaacgatatcgccgttgcatcgtagtttgccggtaaaggttatttcatcgcaaataatgtcgccgccgacttcgatgtcgccgctgccgctgatgctggatacgcgaatatcaccatcacaccgcacaatgccacttttgatgaccagtttgtccccttctataactgaggcctcgagggtgctggtcacaatcatggtgtgaaaatgcgcgccatcggcaagacgggaacgttggtccactcctatggtgccgtagactcctttgcctatcagcgtgcaattctgcgtatgcttgcccatgatgataaaactccccttattaatatggacgtacagctttatggcttattgccacaataatgagcgcatccatgttgagggggttatatcggtcacgatgtgagcagatagggggtatagcgagcgcagttagggggttagccttggatgaagtggtcgatctgatcctgcttgcccatgaggatgagttcgtcgttgcgatgcatgaccagttccttggagccgtactggaactccttgcctggggccttgaggcccaccacggtcacgccgtacttgtcatgtacttgtacgtcctcgatgctgcggcctaccgcgtacaggggcgtgtggaccttgacgacggtgtacggcccgtcgatttcgatgtaatccagataattgccggccaccagatggcccacgcgcttgccggcatcggtctccgcgttgatgatgtggcgggcgccgatgcgctgcagaatgcgcgcatgctcctgggacacggacttggcccacaggtcggaaacgccggcgtccagcaggttgccggtgatgatcaccgaagcctcgatgctgtcgccgatggccacgacggccgtgtcgaactgggaggcgtcgatctgctcgatggccagcacatcggtcatatcggcctgaatggtgggcagatgcgcggaccaacgggccacaagctccgggttcttgtccactgcgagcacatcctgacccatctggtcgagggtggcggccacggacccgccgaaacggcccagtccgatgaccagcacgcttttgttgccgctcggttttgctgccatgatgatggtcctctctatgtcagattgctgggcgccgattgaatggccgatcagccaacgataatgttttcctgcggataacgaataggttcgggagccatcggtcggctgatggagtaggcgatggtcaacgggccaagtcgtccgacaatcatctcggcggacagaataaacaggctggccggattgccggcgcttgccacgcccaccgaataaccacccaacgagaaggccgagcaggcttcgaacacggcgtccacgaacgcgcagccggtggtgaacatcagcatcatcgcaccgaccataaccaacgcaaagcaggccgtggtcacggacacggcggtcatctgaatacggcgggggatacggcggcggaacacggtgacatcgcgatggccggtgaatgcggcgcggcaaatcaagagaatcaccgcgaacgtggtgacacggatgccgccagcggtggatgaggaacctgcgccgatgaacatgagtatgctcatgaacaccttggtctcattcgtgacttcgggcacccaggaaatatcgaaaccggcggagcggggcatgacggcggcgctcatcgcacggcgcatcttcatgccggggtcatctgcggggaacaggccggtattgctccactcgaccagcaggaaccaagccagtgaggtggccaccagcacagcggtggtcaccaaagtgagtttggtgtgcaatgtccaacgtttcgggctgagccgccggcgtgcgcactgcaccagattcagcaccacggggaagccgagcgttccgatgaatgcactgatgagaatcggcagccccacgccccaacggttcacatgcagaccagtggcatccggcgtgaaaccggtgttgttataggccgacaccgcgtagaacagcgcctgccacaaggtacgccccatattgccatggttcacgcggaacaggtcgggcagcagcagcacgaaggtcagcacctcggcgatgatggaggtgcccagcaccacggtgagcgcgcctttgacctcggaaagcttcgtggtgcccagctcgttcgcggtgagcatacgctgggagaccttgagtctgcgggaagcgccaagagccaccatcgaggcgaaggtcatgacgcccagaccgccgaactggatggagaacaggacgacgacctggccgaacatcgaccagtattcgccggtgttcaccaccggaatgccgcaggtggacagggccgagacggcggtgaagaacgcgatcgggaaattggtgaagatgatgtccgatgtggagatcggcagcagcagcaaaccggtgacgatgatgatcagtgcgccgaaatacaccatggacagacggcccgggtgcctgagcagacggtcggtgatgctgatacgtcgaatgcgcttggcggttttatcgcttttgtctcggctcagtacatcggctgaataccaccatgacagtcccttcgaggcctcctcattggcggaggattcgtcgaagtcattggccatgggtcctcaagctcctcaactgatactgctgtacggtcatacggcatgccatcgcgctgcgcacggcacgcgtacggtgattgcgcggctgtacgccattgtatgccgaagccttacgataatcgactctgtggaacgttgccggcgacgcgccacgaagcagcatttttcgaacacctgtacgactgatgacggtgtctgcggttagaataatgagcagtgcgaccgaatcgacaggaggatgccatggccaagcgcaacgcggtggtggtgacgcataccaggctcaggcagaccggaaccgtagtgggcgaggcggtgagccagctgcgagtggccggtttcgaagtcaccatcatcgacaacaccgaggcccccgatttcggcgtgcagccgccgtgcgtatcggacgacaccgaaatcgtcgtggtcctgggcggcgacggcacgatactgcgcgccgccgaactcgtccactgcacccaggtgccgattctcggcgtgaacatggggcatgtcggcttcctggccgaattcgaaagcttccagatcgacgaggcgatccgccgggtctccacccacgactattcgatcgacgaacgcatgatcgcccatgtggacgtctggctgcccggcgccaccaagcccattgaggattgggcgctgaacgacatcacactggaacgcgccgaccggggcaagatggtcgaactgtccatccgcgtggacgatgtggagatgaactcgttcggcgcggacggcgtcatcgtctccactcccaccggttccaccgcctacgccttctccgcgggcggtccggtcatgtggccgaacgtcaaggccctgcagttgattccgttggccgcgcacgccctgttcgccaggccgctgatcatcggctccggctcgaccttcaccatcgatattctggacgattccatgtccgaaggctggatttgctgcgatggacgccgtcagcgcgccctgccgcagggtacgcgcgtcatggtgcgcgaatcgcgcgataccttgcgcctcgcccgactctccggcgtgccgttcaccaaccgtctggtctccaagttcgatctgcccgtggtcggttggcgcgagcacgcgcgcaacgaggcctcgagccagtcgctgcatcacgggcacacgttcccggcggccgcgtatgcggctggcgttgccgttgccggtgacgccggcgtcgctggtaccgagcccgacaagccgggcgaacgtgacggcaaggcaggggcctgatgctcgaagaactcgatatccgcaatctggggccgattcgagaagccaccattgcgccggccgcaggcatgaccgccatcaccggtgagaccggcgccggcaaatccatgctgctctccgcgatccgactggtttccggtggggccgccgaatcctcgcgcgtctcgtccggggcggacgaggcttgggcccaggcgattttcgcgctctcggatgatgccgtcgcatctgaacattccggcgacaccaacgatgccggtgacgatgccggttctggcgatgccgacagtgggttcaccggtgctgccgcggccgtggccaaggcccatgacgcgggcgtcgaccccgaagacggcgaactgttcctttcccgcaccgtacgcgcttccggacgttcgcgggccgtgctcggcggcaagtccgtaccgcgttcggtgctgggggccatcgccggcgaactggttaccattcatggccagaccgatcagctgaaaatcgcggcctcctcacggcaacgcgagtttctggaccgggtggccggagacgaagccgaactggccgcctaccgcaaggcgtgggatgcgctggccgccatggatgagcggctggaacgcctgcgctcgcaggaatcctctgcccgccaacaggccgactacctgcgcgaatccatcgaccgcatcaaccgaaccgacccgcagccgggggaggatgaggagctgaaggcgcgccgcgaacgcatcgaaaacgcggccgacatcgcccaaggcgtgggttcggcgctgggcgcgctggatgcctcgcaggtggatgtggacgccgccgacggcgcttcggccgtggaactcatcaatcatgcggtgacctcgttgcgcgcgattcgcgtcggcggcacgttcgctgagcaggccgatcggcttgaatccatcaatgccgatttgggcgacgtggtgttcgccctgagccaggagctgggcgacgaaggcagcgtggaggatctggaccagatcaacggccgtatccacgagcttggcgacctcacccgtcggtggggccccaccttggccgacgtgctcgcttggcgggacaaggcggcgttcgatctggaggatctggatgcctcgccggaaaaggtcgccgaactcgaatccgaacggcagacgctgtacgatgcggccctcgccgccgccgacgtgctgagcgccgcgcgcgtggctgccgctgccgacttgggtgcgcgcgtcactgaagaactcggctcgctcgccatgctgggcgcctccttggaagtgcgcgtcacgccgcgagacaaggccgatgatccgctcggcccgtatggtcgcgacgatatcgcgttcctgtttacgccgttcgaggggtcgccgcagttgccgatgggcaaaagcgcttcgggcggtgaactgagccgactgatgctggccttggagctggtggccgccgacacgcgcggcggtgccgaccagaccttcatcttcgacgaggttgacgccggcgtgggtggcaaggccgcggtcgaactgggcaaacgtctggcacggctggcccgcagcgcgcaggtcatcgtcgtcacccacttggcgcaggtcgcctcgtgggcggacgcgcagttcgtggtcaccaaggagccgccggatgccgatgacgacgatttgggcgtggtcaccaccatcgccgaagtcagcggcgaaacccgcgtccatgaaatcgcccgcatgctctccggcagcgaatccgaagcctccctggaccacgcccgagaactcctatccaattctcggcttacgctcccgctggcgggagctggcgccgcaggcgactgagggtggttgaagaagatggagattagcaaatgaccaaggccgccatattcgacctcgatggcaccctcctagactccatgggagtctgggaccaagtcgacatcgacttcctgaacaagcgcggaatcgaagtgccgcccgactacatgaccaaagtttccgccatgcaattccgccagatcgccgaatacaccatcgcacgcttcggccttacagacacgcccgaagagctcatgcaggaatgggacgacatggccagcgtcgcctattccaccacggtcgaagccaaacccggcgcgcttgactatctgcgcgatctgaaagactccggtgtcaaactgggtgtcgccacctcgctgcccccgcgtctgcgtgagccggcgctacgccacgtcggcatgttcgatttgttcaacgatatcgtctccgtcgatgacgcgaacgacgtcggcaaggaccagcccgacgtctacctgctcgccgccaagcgcctgggtgctgcaccggccgactgcacagtgttcgaagacctgctggtcggcatgaagtcggccaaatcagtcggcatgaaggtctgggccatgcacgacgactcctccgcctccgactggcccgaaatctgccacctagccgacggtgtcctcttcgacttccacgacgccccgcgcgtgctgtgataaaaaagttacgcccccgctggcggggctgtcggcggaacggcgttgttcggcataggtacccctttccgaggccattgtaggcacggcccatgtttcgacactgtatgttggcgaggtgtttgttcaccgtttaactgttatgtaacacaccttgacagttaagcagaacagttatactgtgttgtataacagctaaacagctggggtgctagtcaaccgcaaccgaaaggggcatagatgaaactgatcatctcatccgtgtccggtgagcccatctacgagcaaatcaaaacccaaatccgttcggcggtgctcggcggcgagctgaaggcgggcgaggccctgccttccctgagaaaactcgccaaggagttgcgcatctccgtactcaccgtcaccagggcgtacaacgaactggccgatgagggcgtggtgcagaacatccaaggcaaaggcactttcgtgatggacaagggcaacgaactgatgcaacgtcagctcgaaacccagattcgcgaaagcctggccgaggcaagccggggcgccaaagccgccggcattccgctggacgcattgggccacatgctcgaagaggaataccgcaaggaataacctcaagaaaggaccatggccatgaccgccatatccgaatccgacgcgatggcgttgcaggtcaccgacgtcaccaaacactatgattccggcttcacgctggacgacgtgaccttcgacctgcccaagggctacatcatgggactgatcggcccgaacggcgccggcaaatccaccctcatcaaactcatcctcaacatgatccaccgcgacgccggttcgattcacgtgctcggcctcgacaacgtcgccgacgaggagcccgtcaaggaacaactcggcgtggtattcgattccagctacctgtatgaacagtggcaagtcaagaacgttgaacgtatcgtcgcgccactgtattcatcatgggacggtggatgctatcgcaagtatctgggtactttcggtcttggtgacgcacagaacggcaagaaacatatcaaggatctttcccgcggtatgcagatgaagttgatgctcgccatcgcattgagccatgatgccaagctgctgattctcgacgagccgaccagcggactcgatgtgcttgcccgcgacgaactcatggatatcctgcatgcctacattgaggatggcgaacattcggtactgttcagcacccatatcactgccgacctcgaacgtgctgctgacttcattacctacatcaccgatggccgtctctactacaccggtccgaaagacgagtttgaggaatcgttccgcctgattaagggcggtccagacgaactggcacaactgcctgcggacgtggtgctgggctcacatatgtatgccaccggattcgatgcgctggtccggtcagacaggctttatgctgttgcgtcggtggtttcggggcttgccgttgaatcggcttccattgatgacatcattcgcttgaccaatgcccatgattccaatcgtgacttgagcgggaggtgagcggtcatgggggcaatactgagggtgccgcggtctcggcaacatgcattgaccactgcattgcgcgtcgatatggcctacctgtgcgtcggcgtacagactgtgttctcgttgttgttggtaccgttgttctccgccatctttcaaggtgaagtttatggtgatggtttcggctatcgcatgggtgtcatcatgacggtattcacctgcgccatgtgggtgctcaccatggctgttgctgacctgcagaacggatatcggcttcgtggcattattccgtcttcaaggaagaaccaggtggccgcgcgatatgtggttggattggtgatttccgtattgtcggtagcgatgattgtgttgattgacgggttgcaagtgctggtcaatccggattggtcattcgcgggcaatctgtgggcggcgccgttgggaggtttctgcaccgcgctgatgatcgcgcttatcgtgcccacgggttatctgtggaccaaactaggcggtcttcaagtcacgatgatggtgatttatgtcgttgtattggctggatccatactgctatctattttgcctgcttcggtgaccagaggattggcccatgccgcgaatgccatcatcgcgcaacgattgtggctggttattgcggtattgacaacgacggttgtggcatatggaatctcgtatgtaattgcctctcgcatatttgcttcaagggagtggtgacgatgagctggaaatccgtagtaaagcaatgtcgattcgattgtgtcgggacgggtctgttcagcgtggcgaatatggtgtttctgctggttttcccggtgctgtctatcgtggtatcgctggtgatgatatcgacccatgtcgatgaacacgttgccagtggtctgatgggcggactcggaggtctggcatcggtgatggcatatatgagtgcattggggcctgccgcatccgaggaatctgcaggacacagtgccatgcgagggctgattcctgtttcacgcaccgcgcaagttgtaggtcggtacctctttctgttggtggttggcctgctctgggctctggatgtggtgatatgcggtggcatcttcattgtctttggcgatatagcagatatggggtggattggtgccttggcatcaggtgcctccatcttcgctttggctatcattcttgggtcggtgctgctggcctgtgcataccggttcaccttccgcaagatgatgatggcctttggcgcggtcatggttggcttgtatgccgtcattgcgctgctggctcgattgcctgttgactggcaatggctattgctgaatattgccgatttcctgacgatctggtggcatacggcgcttgttctcgccgtgttgtgtctgctcgcattttttggctccatgctgatagccatccgcatctaccgagccaaagaactctagccgcgcatttgtctgaccacgaatgaaaagagaccgacaggaatctgtcggtctctttccgttatcggtgtgttatcagtccaccagatccagagcgattggctggtgcggttgctgggaatcgctttcattggccgtgcggcgcgcgcggatggcggcggctgcgcgcttgacggtcttgataacttcctgcagcaccaccacgccgaaaccgaccgcgatgattttcagccacatgtcgatcggcagcggcacggtgcggaacatcgcgccgccgaattgcaccactagcacctgaagtgcgaacatcagcgcgaacacgccgatcatcaccttattgcgcagcagattggcgaacaggctggcgttgcccagctcgcggctgttgaaggcgttgaacagctggaataccacgaacagcgtgaacagaatggtcgactgctgttcggcggtgccgcccatgaagttcgtccagctttgcgccatgaacaccacggcgatgaacgcgccggagacgatgatgcgctccagcatgccgcgcgagacgatgctggcgtcgcggcgggtgggcctgcggtccataagattgtctcgaatcggctccataccgagcgtcagcgcgggtgggccatccatgatgatgttgacccacagcagctgcaatgcggtgaacggcgcggccagaccactgaacagcgaggcgagtaccacgaccaccgaagacaggttcacggtgagctggaactggatgaatcgctggaaattctcgtaaatgccacggccccagtgcacggccttgacaatggtggcaaaggaatcgtccagcatcacgatatcgctggcttccttggacacctcggtgccggcgatgcccatggcgatgcccacgtccgcgttcttgatggcgggcgcgtcgttgatgccgtcgccggtcaccgccaccacattgccctgggctttcagagcgttcaccacgcgcatcttgataaccggcgtgctgcgggcgatcacgcggatgcggccgatttcgcgggacagttcctcgtcgctcatttcctcgatctggcgcgcctcgacggcgatatgccgctcgtccagaatgccgagttcgttggcgatggccgtggcggtcacgatgttgtcgccggtgagcatcttgagctcgatgcccgccttgcggcagcgctccacggcaccgggcacatcctcgcgcaggggatccacgatggccacgaagccatcgaacatcatgccggattccagattggcacggtcggcagcgtaatcgagagccgcagtgtcggcgtccttatcggaaatatggcggtgggcgaagccgagcactcggcaggactgcgcctggaacttcgcgatctcccgttcgatttcgccgcgcgtcttggcgtcgacggcgcacaggtcgagcatcttctccgggctgcccttggcaaacacggtaatgccgtcgccatcgcgcaccacagtggtcatgctcttggtctccgacgagaacggatacgtgtggagcaccgtcgcgcgctcgcggcgaatccggtagtcgagtccggccttgtgcgcggcggccaacagtgcgcattcggtggggttgccgatgaattccggcatcgcgccggcctcggcttcggtggcgcccgggaaggtcacgtcggcggtgccgttgacgcagaagttctccagcagcatgcggttcctgatctgctcgggcttctccaaggcgcggcccggcgcgttgtacgcctcgatcacggtcatgcggttctgggtcaatgtgccggttttgtccgagcagatcacgttgatgcagccgatggtctcgcacgccaccatcttcttgaccagcgcgttctgcttggacattttgatgatgttcaccgcgaggcacgcggccacgatggtcggcaggccttcgggcacggcggccacgatcagcgttatggaggtgatgaacgcctcggaaatcgtgtcgaacgaggcggtgccggaagccacgaaccgggccacctgaagcacgaacaccagtgcggccacaatcgagcccaccacggcgatcaccttgccgagcttcgcgagcttctcctgcagcggcgtcataccggtgttggcggcgcgcagttcgcgggcgatcttgccgaactcggtgtcgtcgcccacggcggtgaccacggcacggccattgccggcggtcacgaagcagccggaatacagcatgttcgtgcggtcggccaccggggtcttcggatcggtgaacacggcgtcggcggctttggcactcggcacgctttcgccggtgagcgcggattcgtcggcggtcagatcgttcgattcgatgaggcgcgcatcggccggcagcttgtcgccggtgctgatctgcagcacatcgccgatggtgatgtctcgctgcgacaccagcgtgacctcgccgtcgcgcaccatggtgacggtcgtgtcgtcattgatgtcgttcagcgcttcgaatgccttggcactgcggccctccatcaccacggtgatggtcacggacagggcgatggcgaagaagatgcccacgcattcgagaatgtcggcgtggccgccggccatggcgcgggtgatgttgacgcccagggtgatggccgccgcgatcataagcatgatgagcatcgggtcggcggccgtcttggcaatgcgggaaagcatcgattccggcttcggcttggtgaaggcgttggggccgtactggttcaggttgtgcgcggcctgttcgctggtcaggccttgatgtgcatcggtgcccagcgtgctgatgactgctggcgcattctgcatgaatggtgcgggcgtctgcccgttggccgtggtcatatgttcctctcgtttggttgacacaccgcactgaaacccgcgtaatatcactcgcgtaccgcgcaacatggcggcacgcagccaaacgaatcgttgacgaccatgtatcgcatactccgcggtacatgagtctcgtcatttaaggcaaagccagaccgtaacggaactgccgacggccacgatgttgacttgccacattgcggtttgggccgagcccttcgccgcaatgctgtctactccctcatgggactattcagttgcagaaacagaacctaacaaaccacatggattttcccgttcgccggcagcatggcgattcccgccttcctagaaaaaacaagcaacacgccattggctcgttgcaggtgaaaagccgcaagaaagccgcgcgtgacaaggctcggacatgcttgaacatgcctggaccttcgacttgtgacatcagaaaacaaaaaaccgatacatgctggtaaagcatgtatcggttgggaattgtcagttagtgccgtcagcggactatcacagcgcctgggcggccttctccacgtagtcctccatgccgtcgatggccacgacgtccttgaaccgcacgtcggcggtctcaagaccacgcagggcggccggggcggtggtgccggtctcgtgggccagcacatccatgcactcgaagtcggtgccggtggcgtcgaagcccaatgcctcgttcaccacgcgcgggaacttgtaggggctggcggtggagagcagcacgcgcggggtcagcgggtcgcgcggcatctgctcaagcaggtagtagccgcaggcggtgtgcgggtcgatcacgtagtggttctcgtcccaacagtgcttgatggactcgcgtacctgatcctcatcggcccaaccggtgccgaagatctgacgaatcttggccagcagttcttccgggatctcgtacgtgccccacttgttgaggtcgttcatcagcatggagatcagacgggtgtcgccctcggacaagtagtacagcatgcgctccaggttggaggagatgaggatgtccatcgagggggagatggtctggaagaacgggcgctggcggttgtaggtaccggtggtcaggaagtcgaacagcacgttgttcttgtcggaagccaccacgaggtgcttgaccggcagaccgagcagcttggcatagtagccggcgaggatatcgccgaagttgccggtcgggaccacaaactcgacctcatcgccgacgttgatcacctggtcggcgagcagttgggcgtaagcggagaagtagtagacgacctgcggcaccagacggcccacgttgatggagttggcggaggaaagcaccacgtgcgaattgccggcgagacgctcggccagggcgcggtcgccgaagatgcgcttgaccgcggactgggcgtcgtcgaagttgccttccacggcggccacctgcacgttggagccggcttgcgtggtcatctgcagctcctggacctgggagaccttgccttccgggtagaagacggtgatcgcggtgcccggggcgtccgcgaagccggccagcgcggccttgccggtgtcgccggaggtggcggtgaggatcatgatcttctcgtccgcgtcgccatcggccggcgtggtgtgcgccatgaagcgcggcaggatctgcagcgccacgtccttgaacgcggaagtcgggccgttgaacagttcgagcacgtaatcgtcgcccaggggcttgagcggggtgatgcgctcgtcggaccactgttcgccgtaggcgtcggcgatgcactggcccagctcctcggccgtgaagtccggcagcagcgcgcccagcacctcggcggcgatttgctggtacgacttgcccggcagggaggccacgtccaccttggtcttgcccaacgcgtccgaaacgaacaggccgccgtcatcggcgatgcccttacgaatcgcctgcttggcggtcagcgaatcggtggtgctacgggtggaatggaaggtggttgtcacgatgaatccttctgcctgaaagggatgatgaatccacatcagtctagcgtgggccgtgggcagaagggccgtccgtctcgcataaccgaccggtcgcaccggcgaaaatcaccattgccatcgaacggggaccggccatatcatgaaacaggccggctgcaaacgggccatacggtaaggcgacaacggcgaatcaattgtcgcttataccaaagagcacccatgaccgcttcaccccttgcgcagaaggcaaccgatgctttcaacgcgccgatctgcgaaaccgatcctgagatcgccgaactgctggactccgaactgggccgccagcgcagtggccttgagatgatcgcctctgagaacttcgtgccgcgagcggtactgcaatgccagggctccgtgctgaccaacaaatacgccgaaggctaccccggccgtttctaccacgccgaggcgtacggcgtgaaccccgagaccttccgcatcgacccggagatcatccgccagcgcacgttcgacggtgccaagatccttgccgaacgactactggccgacgacgtcaaggccaacggcatcttcgtgctgaccggcggcaccgatgtgcatctggtgatggtcgacctacgcaacagcgagatggacggccagcagggcgaggatctgctcgccgcctgcggcatcaccatcaaccgcaacaccgtgcccttcgacccgcgcccggcctcggtggcctcgggcctgagaatcggcacgtccgccctggccacctgcggcttcggaccgaaggaatacgaggaggtggccgacatcatcggcaccgcgctcgccgccggcccgtccgccgacgtgaccgcgctgaaggcccgcgtcgacaagctcgccgaagacttcccgctctaccccgacctggaccagattcactgattttttgcggatgtacgcagctccctcatcagagggagccgcgcttatatccccggctatcttcggtgcaatatgggtcgaaacgggcaatgcggcccattgtgggttactcttgttttttatgagcgatgaattgagtcctgaggtgttcgacgcggtgtgccgccaggccgatcaggccgcacgcgcacaggagcgtcttgcacaggcaaataccgaagccaaaaacgaactgttgcttgccattgcggacgcgttggacgagcatgctgcggacatcgaagccgccaacgcgctggacatgctcgaatccaaggaaaacggcatggatgcgggcaagctcgaccgcctgctgttcgacgtgccgcgcgtggccgccgccgcccaaggcgtgcgccatgtggccaccctgcccgatccggtcggcgagatcgtgcgcggatacaacctgcccaacggtctgcgccttacccagacgcgcgtgccgatgggcgtcatcggcatgatctacgaggcccggccgaacgtcactgtggacgtggccagcctgtgcctcaagtccggcaatgccgcgttgctgcgaggcggccacgccgccgaacgcactaacgccgccacgttgggcgtcatcgccccggtgcttgaagcccacggtttcgaatccgcactggtgcaatccgtcgaccagtacgggcgcgccggcgccaccgccatgatggaggcgcgaggccatatcgacgtgctcgtgccgcgaggaggagcgggtctgatccaagccgtcgtgcgcaactccaaagtgccggtcatcgaaaccggtgccggcaacgtgcatatctatatcgacaagtccggtgatctcgccaaggccatcccgatcatcatcaacgccaaaacccagcgcgtgggcgtgtgcaacgccgccgaaaagctattggttcataaggatgtcgccgccgaattcctgccgcagatcgccgccgctctggccgaggcgaacgtcgtgctgcagaccgacaccacgtcgtacggcatcatctccggcgcggcaatcgagggccttgacctcaaccacgccgccgaagaggattgggacaccgaatacctggccctcaaaatgggcatcaaggtggtgtcggacctggacgcggccatcgaccacatcaacacgcattccacaggccacaccgaatccatcatcgccgaggattatgcggccatcgaggaattcaccaagcgcatcgactcggccgtggtcatggtcaacgcctccacccgcttcaccgacggcggcgtgttcggctttggtgccgagcttggcatctccacgcagaagatgcacgcacgcggtcccatgggattgcgggagatgaccaccaccaagtggatcggttacggaacaggacaggtgcgcgcatgaacgaggacggcaacatgaacattacggctgacacggcaaacaaggcaagcgaactgcggcccgacatcgacctcaacgatcccaagctcggcctgaagatcgcggccgaacggctcagcatcgtccgctacgtgttcctcgtgcagatcgaggacggcatcgcctccgccgcccagcgtgcgtcgctcgaatacgcggacgccgtgctcatcggttggcccgagaccgattcgcccgaagtcgcggacctcgacgatgcccagctcaagatcgtgcgcgaacacatggagctcatggaaggctacatcggcaaatacagccagatggagcacgacggtgaccttgacggcatgaccgacacgctcatccgcatcaccgagcgtgtggccgaggtccgccgcctctaccagccggacttcccgctgcccaccttcgccgaaattcgtcgcgtggtccaggacgaatgggatgaagacatgggcaagatcgatccccgggaagacaatcccaccgccggcgaaatcgaagaggaaaccgaatcagccgatgacgccgctggcgagggcgaccaggcatgagtggtgttaccgacagccacaaaacggctgcgtcagttcagtccgaaaaatcagtggaatccgccgagcccgccgaaatcgttgccgtcacccaaggcgaaaccgaacggcgcatgtctgacctgtccgcgccggccggggccagcagccatggcaaaggcaggctttccgcacgcggcaactggcatacgcgcctgcgcgtcggcatcatgggcggcacgttcgacccgattcacaacggccacttggtcgccgcctccgaagtagcttgggtatacgacctcgatgaggtgattttcgtacccaccggccgacctgtgttcaagctggacaagcacgtcaccaacgccgaagatcggtatctgatgactgtgatcgccaccgcatccaaccccaaattcaccgtctcgcgtgtcgacatcgaccgtccgggcgtcacctacaccatcgacaccctgcgcgatatccgcgcccaacatcccgacgccgagctgtttttcatcaccggcgcagacgccgtggccgaaattatgcagtggaaggacgccgacctcatgtgggacctcgcccacttcgtggccgtcacgcgccccggctactccagtccggacggcgtgaccttgcccgaaggaaaggtcgatacgcttgagatcccggccttggccatctcttcgaccgatgtacgccgccgcgccgaacacgacgagccggtctggtatctggtgcctgacggcgtggtgcaatacatcggcaagcatggtctgtattcatacgaggactgacgattcgtacgaggactagtgtgcatttgtacgagggctggtgaggattagcgcgaatcagtgcgcatcaatcctcaccagtgcaaaggataagcagtcaggccagtcccatcttgattttcaatgccattacgcgagtcgccgccgccgtcactttcgaagcgaaagccggatcggacttcgcccgttcgttgaggccgtccacaattggctttacgtaatccgtctgaccgatgcaggacatgtcgccgcccgcctcgacaagctttactcccaattggcttacatcgtagctgcttaacgcttcggcagacatcgaatccgaaatcaccacgcccgtgtacttcagggcgttgcgaatatgaccgtcgataatcgtagaagaaaacaccgccggattattcgggtcgatggattgatacgtggccaacgacatcatcaccatcgcaggatcggtcttggtgatcgcctggtcaaaggcacctgcctcggccccgcccaacgtggtggtcgtatccagaatgccttcggtggtgaagtcggtattgccgcttaccgcgcccaacccaggataatgtttgaccgccgcgccgacctgagcgtctcgcaaaccttcaataacggcgatgccatgttcggcgttgccggccgcatccaatccgaaatcacgatccagcgcgccaatcggagcatttgaggcacgatcgcccaccaccgtgccgagcaccggtgccaaatcgacatttatgccagcagcagctaattgcgaaccccacgtgcctgccgattgacgcaatgcgtcagcggacattgtgccctgctcaacggcactgggcattgtgtcgaaaccggtaccagtcagatgctgcacctgaccaccctcctgatcggtggcgatgatgagacgattgccggccggcgcatatccttggagttgcgcggtcgcggtcttgaccgtatcggcgccggtattccaattgccaatgagaatggccgagccaatgtgctcatcggcgattgttgaagccaacgaggagggatcggaaccggcaagcaacggcaccatcactaactgtcccacacgttcctcaagtgtcatggcggataccgcacgttgggcttgtgcggccggttcgttcttcttcggggaaggaacgtcggcgcgtggtaacgcacttgtctgggaggtctggggagtggtggtgttgccgtttgatgtggatttggcgaaccatccgacatgccatccgtaggctgccacgccggccaacaccactgccaaagcacatattgtcgccacgattggagtgctcctgtgccgaagttggcgtgtggcgtgtgctgagggacgcatatgttgtggccgttggctgttcataccggcaagcgtagaacggagcgtagaacagaacgctgcctcattctgtgctcagggcataacctacctcccgccctttcgataggcttgagttatgtcttttaacgatcctttctcaatactgttcggcaatggcggcgattcacgacgcaacaatgcgaacaatgacgatccgatcatcctcgatgtcgaggccgatggggacggtccggcccgcaacaccaacgccggcccctccgggtcatcccgccctccacgtggcccggccaatccgcgtatcacccgtaagccagcgtccggtggctcaggaggcagccgtggcagcaagattctgatcggcgtggtgctggccttggccatcatcgtcggtctgttcttcggcctgtcccgattcatcaccgatctgatgtggtacggccagctcggcttccagtccgtggtctggacccagctcggggtgaaaatcggtctgtgggtggcctacgcgctgctcatggccttgaccggcttcgtttccgcctggctggccattcgagcacgccctgattcggccgacggttccaccattcgcattaacggcgatgtggtcgaggtcggcaaatccgtcagctcgaaaaccgctcgccgcgtggccgtggtgatttcgctgatcgtcggcgtcatcttcggctctcagttcaacgcgaactggagcgagattctgctcatgttcaacgcgcagtcgttcggcaccaccgatccgcagttcggtctggacaacggcttctacgtgttcgtgctgccgggcctgaagctcgtgctcgccgccgtggccatgctgctgggcgtgggccttgtgttttccgtggtcactcatgtgctgatgggtggtatccgcattactatgccggttaacggacgcggcctgttctccatcaccaagcgttgccgtcgccagcttggcatctggctgatgctcaacatgttcgcttgggcagtgcgccagatgatcggcgtcttcgaccagctcaccgtgcagggttcacgcatcaccggtgcctcctacaccgccgtgcatgccaacatccccgtcaccttcatcatggccgcgctgaccgccatcctcggcgtggtgctgggcatctggctcatgcgttcccacacgctcgaaggccaggcgtccatcggcgtgcgcgcctccgccgcgctcaaggcctggcgtgtgccggtgacctccattgccgtcgtggtcgtggtgggtcttgtgctcaccgtggcatggccggtgctgttgcagcgcttccgcgtcaacccgaacgcacaggagatggaatccacctacattcagcgcaatatcgacgccacccgcgccgcctacggtcttgacaagctcaagaccgagcaatacaaggtaaccgacaagggcgagcagggcgctctggccaaggagggcgacaccaccgcgcagattcgtctgctcgacccgcaggtcgtcagccccacattcaaacagctgcagcagtccaagcagtactacaccttcgccgacactttggcagtcgacaagtacgagatcgacggcgtttcccaagacaccgtgattgccgcccgcgagcttgacctggccggcaacgacaaccgcaattgggtcaatgaccacaccgtgtacacccacggttacggcgtggtggccgcttacggtaacaaggtgaccgccgacggccagcctgaattcttcgaatccggcatccccactcagggcaagctcactgaatccgaaaagtatgagcctcgcatctacttctcgccgaacaccaccgaatactcgatcgttggcgcaccggagggcacgcaggcttgggagttcgactacccgaccggttcggaaggcgccctgaccacgttcaagggcgacggcggcccctcggttggcaacctgttctcccgtattctctacgcaatccgcttcggctccgatcagattctcttctccgaccgtgtgaccagcgaatcgcagattctttacgatcgttcccccaaggagcgcgtggccaaggtggcgccgtacctgacgcttgacggccgtgtgtatccggccgtggtcgatggccgcgtcaagtggatcgtcgacggctacaccacctctgatgcctacccatactcgcagatgaccgacctcggctccgccaccaaggattccaccaccgtctcttccgcaacggtctcatccttgggctcgcagaaggccaactacatccgcaactcggtcaaggccaccgtggacgcctacgacggttccgtggatctgtacgtatgggatcaatccgacccggtaatcaaggcatgggagaagatcttccccggccagtaccaccagctctccgatatctccggcgacctgatgagccacatgcgctacccggaaagcctgttcaaggtgcagcgcgagctgctctccaagtaccacgtgacctccgccaaccagtactactccggcgaggacttctggcagacgccggtcgacccgaccgaatcccagtcccagcaggaccaggacatcctgcagccgccgtactacctgaccttgcagaccggtggcaccaaggaaccggtgttctcgctgagctccacctacattccggctggccagtccacccgtgagatcctcaccggcttcctgtcggtcgactcggatgccggcaatgagaagggcaagataggctcaaactacggcaccatccgattgcaggagctgcccaaggattcgaacgtaccgggccccggccaggcgcagaacaacttcaacgccaacgccgacgtgtccaaggaactgaacctgctgcaatccggcgacacgcaagtggtgcgcggcaacctgctcaccctgccgctcggtggcggactggtgtacgtgcagcccgtgtacgtcaagtcttcgggtgcgacttcattcccgctgctcaagaagacgctggtcgcgttcggtgatcaggtaggatttgcggatacgttggatgaggccttggatcaggtgttcggtggtgattccggcgcggccgcaggcgatgccgagaacgtgtccggtgacggatcgtctggtgaccagtcgtccggcatatccggtgaccaatctggttccgataccaatggtggccagtccggcaccacggacggcaagtcggattccggctcgtcttccgaccgtagccccgaactccagcaggcgctgaacgatgccgcccaagccatgaaggacagccagtccgccatgaagaacggcgactggaccgcctacggcaaggcgcagaaggagcttgaagacgccctcaacaaggccatcgagctcgacaagtagttccgacaggaattggctcccctcagggtgaggggagccatcgccgaaggcgactgaagggagtcggttacctcaactgacatagcccgtccttatcataaggacgggctatttgcgtattcaaaggaacctcatgccatacaccttccgtccggccgtcgaatccgacgtccaagccatcgccgacatctacaacgcctcagtgatggccggcggtgcgaccgccgacctcaccccgcgcaccttcgatcaacgccgcgcctgggtcgaatcccatacgccgccctacggcgtttttgttgtggaatcggaagacggttcaatcattggcttcggtgcgctctccgtgttctatgaccgcgcaggatatgacggtgtcaccgatttggcctattacatcgatccggcatggcaaggcaggggagtaggcacgttcatgcttgacaggctgctcaccgaggcgctggcccgccacatgcgcaaggcctgcggcatcattttcgccgataacgccggctccattgccctcatgcaccgcttcggcttcacccaattcggactcatgcccgccgctgccaccgactccaccggcaccatgcgggacatgtcctactggtatttggacctgtagccttgcagtaagtcatttcagtcaagaaaagtgtgaggatgccggagcaaacgagcttgacggcggcgttgagtacaatcttgacggttggatccggccgggcatgggccagtgcgcgaggcgaacgcgcgcatgacgtacggaacgtacagaacgtgcatacgggaataaaggaagacggacgaggagcggattatggcatcggatttctggctgattgcgggactgggcaaccccggcaaaaaatatgaggacacgcggcacaacatgggcttcatgaccgccgacgtgctcgccgaacgttggacggtgaacttcgccgatcacaagggcttggccatgctcggtaaaagcgtgatgaacctggacggccgcaccgtcaagttctttctggccaagccgctgacttatatgaatgattccggcaatgcggtggcttccattagcgcctattaccagatcgagcccgaccatattgtggtgattcacgatgacatggacttggaattcggccgtatcaaggtcaaggcaggcggctccgcaggcggccacaacggcatcaagtcgattgaccgttccctcggcacgccgaaatacgcgcgtgtgcgcatgggcgtcggtcactccaagcgcggtgcgaacgcgcatgacaacacggtgaactgggtgctgggcggattcggtccggaccagcgcaagcagctgcccgaattcctggctgacggcgccgacgccgccgaggacatcatcttccacggtcttgccaagacccaggagaagttcaatggccggtgaggcgacgcacccggacctgatcaacggctcactggcaggcatcctgtctgagctggaacaggacaagaccttcctgaagctcgccgccggcgacatcgaggcttcggacgacgtcgacaactccgtcctggccggcatccccgaaggcttgcgcccggctttggccgccgccatcgggcagggtgtgaccggcaaacccggcaagccggtcgtgctggtcgtggcctccggccgcgaagccgaagagaccgtgggctcgctgcgctcctggtatgatggcgacccgaacgacatcgcccagctcgaagcctgggaaaccctgccgcacgagcgtctgagcccgcgcgcggacaccgtggccagccgcatggccgtgttccgcagactcaagcatccgagcgataccgattcgatgttcggcccgattcgcattctcgtcatgccgatccgctcgctcatccagccagtcgtccaaggactgggcgatgtcgagccgctcgtgttcaccgtgggggaggacctgcccctcgacgaagccgccaaacgtctgatcgaaaacgcctacacgcgcgtggacctggtcatggaccgtggcgagttcgcggtgcgcggaggcattcttgacgtattcccgcccaccgcaccgcacccggtgcgtatcgaattcttcggcgacgaaattgacaccatcaaggaattccacgcctccgaccagcgtacctacggcgacggcctcaagaccatctgggccaccgcatgccgtgaactgcagctgaccgacgccgtgcgcacccgcgccaaagccttggtcggttcgattcccaatgctgaggacatgctcgaatccatcgccaacgccattccggtcgaaggcatggaatccctgatgcccgcactcgtggaccatctggaaccggtgggctccatgcttcccaagcacgccgcgatcctcctgagcgacccggagaaactgcgccgctccgccgaagacttggcaaaaaccgcgaacgagttcctggccgcaagctggcatgtggccgcctccggccacggcgccggcgcgcccatcagcttcgacgaagccagcttcctcgactatgcggaaaccatcagctccctcgaatactccgaacatccggtgattcgcctcaccagtttcggcgtggacaccacgttgaccggccatgtgcagctcgacgcccagaacccggccgaattccgaggggatgaggccaaggcctcccaaggcatcgaaggcctgctcgatgccggcttccacgtcaccatcaccgccgctgcggccggcaccttggccaggctcaagcgtgcgatcaacactaccggcatcgccaatttcgacgtcatccgctctcaggccatcgacggcttcgtggacaaagccgccaaaatcgccctgctcaccgaacgcgacctgaccggccgcacttcagccgtggccgtggccaaaacgccgaaacgccggcgcaaggccatcgacttggtggagctcaaaaaaggcgattacgtggtgcacgagcagcacggcattggccggttcatcgaaatgcgtcagcgcaccatcggcaccggcgccaacaaaaccactcgcgaatacctggtcatcgaatatgcgccttccaagcgcggcgccccggcggacaaactgttcatccccaccgaccagctcgaccaggtcagcaaatatatcggcgccgaagcccccaagctcaacaagctcggcggctccgactgggcggccaccaaggccaaggcccgcaagcacgtccacgagatcgccgacgacctgatcaagctgtactccgcccgccagcgcgccaagggcttcgcgttcagcccggacaccccatggcagaaagagctggaagacgccttcccctatcaggaaaccgccgaccagctcaccaccatcgacgaagttaaatccgacatggaaaagcccgtgccgatggaccgcctcatctgcggcgacgtgggcttcggcaaaaccgaaatcgcactgcgtgccgccttcaaggccgtgcaggacggcaagcaggtggccgtgctcgtgcccaccacgctgcttgtccagcagcattacgagacgttcagcgaacgattcgagggtttcccggtcaatgtggcggccatgagccgattccagaccaccaaagagatcaacgagaccatcgaggggctggaaaccggcacggtggacgtggtcatcggcacgcacaagctgctgaacccgaaaatcaagttcaaggatctgggactcgtcatcatcgatgaggagcagcgtttcggcgtggaacacaaggagacgctgaaagccctgcgcaccaacgtggacgtgctgtccctgtctgccacgcctatcccgcgcacgctggaaatggccgtgaccggcattcgcgagatgtccacgctcgccaccccgcccgaagaccggttgccggtgctgacctatgtgggcgcctacgaggatgcgcaggtcaccgcagccgtacgccgcgaactgctgcgaggcggccaggtgttctatgtccacaatcgtgtgcaggacatctcgtccatcgccgacaagatccacacgctggtgcccgaggcgcacgtcggcatcgcccacggcaagatgggggagaagcagctcgaccagatcatccgcgacttctggcatcgcgacatcgacgtgctcgtgtgtaccacaatcatcgagaccggtcttgatatctccaatgcgaacacgctgatcgtcgaccatgccgaccgtttcggcttgagccagctccatcagctgcgtggccgcgtcggtcgcggccgcgagcgcgcgtacgcctacttcctgtacgacccgtccaagccgatgaccgagcagtcccatgaccggctcgccaccatcgcgcagaacacggcgctcggctccggtttcgatgtggccatgaaggacttggaattgcgcggcaccggtaaccttctgggcgacgagcagtccggccatatcgagggcgtgggcttcgacctgtacgtacgcatggtgtccgaagccgtggaaaagtacaaggagcccgaagagaacgtcgagccggtggccgtgtccatcgacctgcccatcgaagcgtcgattccgatcgagtacatcgattcggacaagctgcgtctggaagcgtaccgcaagctcgcctccgtccgcaacgaggccgatctgaaggatttggaagaggaacttaccgaccgttacggcaagccgccggtcgaattcgagaccctgttcgacgtggcccgtctgaagttcaaggcccgcaagctcggcatttcggagattctcgcgcaatccaaccgcgtgcgcatcggtcgcatcgacccgcccgaatccatccagatgcgtatgggccgtatttacaaaggcacccaataccgcccggtcacccaccagctcatcgtccccaccccgttcaccggctccctgggccaaggccccatgagctccgaccaggtagtcctctggaccaaccagttacttgatgatttggcatggaccccgtcgtcaagcaaacggcagagccgtttgtagacggggtgcgaggcggcagtcgagccagctatggctcaccgggcaacctccggtgagccatattcatattcatgccgtcgtttgtgacgatgattcaccccagacggaatcgttccggctgtccagcgagcgggattaagtgactgctatgagcgaaacgactacgaaccgcacgaaccagagcgcgaccacggcaacacttgccggctatgagattccccgcctcggcatgggcacgatggcgctcgccatcgaggggcgcccctccaaccgtgatcaggcgatcgagaccatccatgccgcgctcgatgccggagtccgttatttggacacggcttggtcttattatctgcccagcgcacccggaaccggcgagccggaggatatgggctatggcgaatatctggtccgcgatgctctgcactcgtggcatgggccgagagaacaggtgctcgtggccaccaaaaccggttggctgcgtacgcttgacggcagcggcaactacggctggcaggccgatgcccgacccgaaaccatgatcgccaatgccaaggaatccgccagccgcctcggtgtcgacacgctcgatttgctctactcgcactgcaatgatccgcaggtgccgtacgaagaccagatgggcgcactcaagcagctcgtggacgaaggtgtggccaaagctgtcggcatctccagaatcgacaacgcggacatcgaaaccgcccgcaatattttgggcgatcgtctcgtggccgtccagaaccagttctccccggtccaccgcgaccctgaacacacgttggaaacctgcgaaaagctcggtttggcttttgtctgctggtcgccactcggcggattcctcgacccgttcaacgagcatctgttcgaccggttccgcgaagtcgccaagattcacgactgctcctaccagcgcgtcacgctcgcgtgggaacttgcgcaataccaatatctgttcacgattccctcggccagaaacccgcaggagattcaggactcgttcaaagccagcgaactgaaattgtccgacagtgagatcggctacctcaatggcaaggacgttgactgagcgatttcgtccgtactgccttgcaatcaggcggcacactggcattgtgagcgctaacgctaaattttgggcgtgttgttcacaacgtccacaaatcgcactactcttaagaatgtcattcaagatacacaaccgttttaaggagtagttgtggcagtaattgaaagcgtgtacgcgcgtcagattctcgattcccgcggcaacccgaccgttcaggtcgttctggacaccgaagacggcgcccagggcctgggcctggtcccgtccggcgcctccaccggtgaggccgaggcttgggagcgtcgcgatggcgacaagtccgtctacggcggcaagggtgttcttaacgcggtcaaggccgtgaacgaggtcatcgctccgaaggtcatcggcatggacgctgctgaccagcgcgctctggacgacctgatgatcgagctcgacggcaccccgaacaagggcaagctgggcgccaacgccatcctgggcgtctccctggctgctctgtacgcttccgccgagtccgccggcctgccgctgtaccgctacatcggcggcaccaacggccacatcctgccggtcccgaacatgaacatcatgaacggtggcgctcacgctgacttcgccaccgacattcaggagtacatgatctccccgtacggcttcgacacctactccgaggctctgcgcgctggcgttgaggtctaccacaccctgaagaacgtcctgaagaaggaaggcctgaacaccggcctcggcgacgagggcggcttcgccccgaagatgaagtccaacgaggactccctcaagtacatcatggacgccatctccgccgccggctacgagcctggcaagcagatcggcatctgcctggatgtcgcctcctccgagttctacaacaaggagaccggcaagtaccgcttcgacggtgaagagcgtgactccgcctacatgctcgactactacgagaacctcatcaacgagtacccgatcgtctccatcgaggacccgttcaacgaggaaggctgggaagactgggctgccatcaccgctcgcctcggcgatcgtctgcagttcgtcggcgacgacctgctggtcaccaacccggctcgtctgcagaaggccatcgacctcggcgccgccaactccctgctggtcaagctgaaccagatcggttccgtcactgagaccctcgacgccatcgagctggccaccgccaacggctacacctccatggtttcccaccgctccggcgagaccccggacaccaccatctccgacctggctgttgctaagaacacccgccagatcaagaccggtgccccggcccgtggcgagcgagttgccaagtacaaccgcctgctcgagatcgaggaggagctcggctccaccgctcagtacgccggctacagcgccttcaaggcctgcaagaagtacctggccaagtgagctgaaacgcccgtaaaggcgtgagtttccactgaagctcgatacccgtcgtattcgtcaagtcgaatgcggcgggtattttcgtgtgacatgagcaagtcgtcccgtaccggcaaacctggcaaaaccggcaaagcacgagttaggaaaaaagggtcggcggggcctatagcgttcttcgtctccctgttcattatcgcccttggcaccatccagctggtctccaccttccacacctatgccctgaacctggccgaactcaatggtctcaagcgtgaggaggcttcgctgattgcccaaaagcaggagttggaaaacgacatcaagcgttgggatgacaaggcctacatcaccgcccaggcccgtgaacgcctcggcttcgtattccccggcgaacaggccgtgcgtgtgcttcatcccgaagccgtgaccggctccgatagcgaatcccagaaaacggaagattccagtagcagcaacaaaaaagtcctgccatggtacagcgaactgtcttactcgctcaaaaaggccgatgagcctgtgaccgatagcgagtccggcaaatccgatatttccggttcctctgactcgtcatccaacgactcatccaagcggtccgataagtcagaccagaacacccaatccgatcagaacacccaacagaatacccaacagaacacaggggagggaacccaacagtgaccatcgatatcgccgccaaggccaaggcccttgtcgataccgtgcttgccgagcccgccaacgatcatgacatcgacctggtgcagcgtcagctcggccgatacccgcgcggcatggtcgccgtgggggcgcgatgcgtctgcggtaggccacttgccgtaatcacccgtccggtgttgcccggcggaatccctttccccaccacgtgctatctgaccggtccggaagccgtcaaggccgcctcccatgtcgaggccgccggcgtgatgcagcaatacaacgacatgttggccttggacgaggagctcaaggccgcatatgagcaggcccataacctgtatctggcattccgccacgaactggcaggacgtcttggcgacagtgaggagcatattgaaggcacttcggccggcggcatgccggtgcgcgtcaagtgcctgcatgccctgctggcccagtccttggttatggggccgggcgtcaaccccattggcgatttggtactggaacgcgtcaaagacgaattcgatccgaccgtctgccgctgcacgctggacgattgatcaacagatgagccagcgcgaacagtccattcatacgcactaagggatacgaggagaaggcaatgagcaaggaatccgtaaccgtcgccggcattgattgcggcacgaactccattcgactgaaaatcgcacgtgtcgatgccgatggcatgcatgaggtggtgccgcgcatcctgcgtgtgatccgtctcggccaggatgtggacaagacccatcgttttgccgacgaagcgttggaacgcgcctatgtggccgctcgggaattcgccggtgtgattgccgaacatcccatcgacggcctgcgtttcgttgccacctctgcaactcgtgacgcggaaaaccgtgaggagttcgaggatgagatcgaacgtatcctcggcgtgcgccccgaagtcattcccggcaccgaagaagccgacctgagcttccttggtgccacttccgtggtcaatcgcgacgatctgcccgccccctatctggtggttgatctcggcggcgggtccaccgagctggtcatcggtggcgacggcgtcagtgcgcccactacccaggttcagggcgcgttttccatgaacatcggttccgtgcgcatgaccgaacgtcatctgaccaatgatccgccgacccagacacagatcgatgaggccgttgtggacgtcgatgaacatatcgatgaggccttccgcaccgtggacgcaggcaaggcccgtaccatcattggcgtgtccggcacggtgaccacgatgaccgccttggccatgggattgaaggaatacgatcacaccgtggtcgacgggcatcggctgagccttgaagacgcctatgccgtggacgacaagttccttaggatgacgcgcgccgagcgccgcgaatacaagaccatccaccccggccgtatcgatgtggtcggcggcggcgctgtggtctggagccgtgtgctggcgcgtgtcagcgaagccgccaaggccgatcatggtgaagccatcgattcgttcgttgccagcgaacacggtctgctggacggcattgtgctcgattatggtcgccggttgctggctcaatagcgtaagtggtaagtgcctccagcgggctgagccgttaagcaaacagcccggtgggctgtttgtaggcgaggggagcggctatgccgcgacggctgcacgaagtgcagcaacccgcaagcaatgctcagggcaggagatagcttatactagaaaagttggcctccgtggcgaaatggtatacgcagtcgacttaaaatcgatcgcttcggcttgtgggttcgagtcccaccggaggcaccttgaaatcggcctgtggccgatgccgtttttgcggctgtgccgtggtctctccccagtcggcttcgccgacagcccccctcgtcagaggggggctcgcagctcactatgtggagagcttataaggccgaaacaaaaggccgttaggctatgtggcgttgtgacgatgtacctgatgaaacgaggaatccacatggcttcacgctggaccgatgtcgaacgagtcgaacaaggcgcactgcccaccatgcttgcccaagccgtcattgcgggcactgcactcaccgttggtgccatcgcctgctcgggattctatctgtccatgatcggcaatgtggccgcactcctgccatgggcgactatcgtgatactgatcgccgtggcgttcacctacatcgtcggcttcgccctgttgtggtgtgccgaagccctgaccctgcgtgccaacgacaaactcaagccatggctgtacggcgtcgtcggattaatcggctacggcgtgtggggcatgttcgtgatgagcgcgatgatgaacacgctgaaccagccgctgaacggcgtggtgttgtcgaacggcgatgtgatggccctgaccgtcaactacgcggtgttcggcttcatcgccttcctgttggcacaggcgtacgcgcccaaaatcgccaccaagaagggactgaccatcgggctgatggtggtgcagatcgtattggccatcatcggtatcatcgtactggtcatgatgttctccgcactgtctcactgactgacttatcgctcgccggcatgacgcgcgcggccatcatcgcacaaggcgaaagcgattccgggcgctgggctgggatacgatatcgtgatggtatgacgcctggtaacaccggcatgccgaaccagcaggggagaaggagccaaatgttcagtgtgcttgacatgttcaccatcggcgtcggaccttcatcctcgcacaccgtaggcccgatggtcgcggcacatgctttcgcctcctcgttgcaggccgaccatttggtcgatcgcaccgcacgtgtcaaaatcacgctctatggttctctggcgctgaccggtctcggccacggcaccgatcgtgctgcgatggctgggctcgaaggcaatctgccggccaccgtggataccgaccacatgatgcacatccgcgagatctgcgcgttggatgatactctgaacctcgccggcctcaaacgcatccatttcgactacgaccgtgacgtggtgttcgaacaatggaagcgcatggccgcgcaccccaatggcatgcgattccaggcgttcgacgccgccgcaagcttggtcgacgaacaggtctggtattccatcggcggcggattcgtgcgcaaaggcgctcccgaagacccgatgatcggcattcatgaacgccctccggaaggcgcctcctttgccgatgcggacaagtcatcatccactgatttcggcgtcgaggcaccctacccgttctcatcatgcactgaactggtgtcgttatgccgggaacatcatctcagcatcgccgaacttgtatgggccaacgaaaccgcttcacgctcgggcatccaggtccgatccgatattgatgccatctggcgtgttatgcgcgcctgtgtggaccacggatgcacctcggcggaacccacattgcccggtggccttgacgtaccccgccgcgcgccgaaaatgtatcggcgtctcgcctcgaattccgatgtgctgcgccgcgacagccggcgcaaagacgccgtgctcgagtcttccgacgccgcatgggtggatctcttcgccttggccgtctctgaggagaatgccggaggcgggcgcatcgtaaccgctccgaccaacggttccgccggcatcattcccgccgtgcttcactattactggcatttcgtggacaacgccaatgaacagggcgtggtcacgtttctgctgaccgccggtgccatcggatacctgttcaaacgcaacgcctcaatttccggtgcggaagtcggttgccagggcgaagtcggctcggcctgttcgatggcggcggccggacttgccgcagtcgtaggcggcacgccggaacaggtggaaaatgctgctgagatcggcatcgaacacaacttgggtctgacttgcgatccggtgggcggattggtgcagattccatgcatcgagcgcaatgccatggccgccaacaccgccatcaacgccgtgcgtatggccatgctcggcgacggctcacacatcgtgacccttgatcaggccatcgaaaccatgaagcagaccggtgaagacatgatggccaaatacaaggagacctccaagggtggacttgccgtcaatgtcgtcgaatgctgattgacatgtccggtattcaccagcatgatgaccggaattgacgtatacggccagcgtgtcgtatgaaggactaccgccgattcgccgatggtgctaaggtagggcgcattgtgtctttgaaggaggactaatgacagatcagatgcctcaggtgaacgccgaatttggcaccacgcccgttatcgagttcccgacgcccgaagccccgaagggcctcaaggttgtggagctgaccgagggagacggcccgatcgtgcgtcgcggcgacaccgtcaccgtgaactaccacggcgtggtgtggggtaaggacaccccattcgactccagcttcgaccgtcatcagcccgccagtttcggcatcggcgtgggacaggtcatcaagggctgggaccagactgtgccgggccataacgtgggttcgcgtctggtggtttccattccgccggaatacggctacggttcccgcggcatcccgcaggccggcatcggcggcgaggacacgctggtgttcgtcatcgacatcatttccacccgctgaccataggtcagcacatgacgaacgccggggtcatagccggcgttttgtcataaataacgaagattgtttcagcatcgacaacggttcaggaggacgatatggctgaggacaaggtctacctgctgacgcaggaagcatacaacaagatgaaggaagagctcgcccatcgtgaaggtgagctgcgtgaggaaatcgcgcacaagatcgccgtggcgcgtgccgagggcgacttgtccgagaacggcggctaccaggccgcccgtgaggcgcagagcaagaacgagggccgcatcaccgagctcaccgtcaagctgcgcgattccaagatcatcgagaatgctccggaaggcaccgtgggcgagggctctgtggtgaccatcgagctcaacggcaacgagatgacctacgtgctcggcagccgtgacatcgtggccggcaccgactacgacatcatgaccccggattccccgattggcaaggccatcgagggcgccaaggtgggcgacgtcgtttcctacaccgcaccgaacggccgcgagctgtccgtgactgtcaaggccgccaagccgctggcctgagttaagtgactggtatgcccccgtaggcgggggcatacttatatgtcgtagcgcttattgccacagcgagacgatcaccatgtagatggccaccatatggcaggcatatccggccaccgttccgcagtggaaaatctcatggaatccgaagacgcgaggccaagggtcgggcttgcgcaaggcgtagacgatggcgccgaggatgtagcaggcaccgccggcgcacagcagcaccaccacggctggccccgcatacggcgaattccagaacatcaccatataagccaggccgtagatgccgaagatgatgtacaccaccgtatacagccagcgtggtgcattgatccagatcacatgaatcacgatggcgatggccgtgcacgcccacatcgatatgatgatcacattgcgccagaacggttccagcgcaaacgaaaccggggtatacgtgccggcaatgagcaggaagatgttgacatgatcgatacgccgcagcacatcggtgacgcgcgggctccaatcgcccagatggtagcaggccgaattggtgaacagaatcagcgacgctgtcatgaacacggcacacgcccacttcagactcgcgccatgtgccaagcatataagcacgatgcctgccgccaatgacaggggagcggcaatcgcgtgaatccagccgcgcatcaacggctttggccgtccgtgcacgtcgagacgaatcttgcgttccacttccgcaggggcaatgccctcgattttcagcgcacggttctccgctttggcgagcttgtgccgggccttctcctcggctttggctcgaatggcctcggccttgaactgggccttggcccgtacggcatcagccttggcctgcaacgcctgttcgcgcgcctcgatagccgcctgacgcttggatgcgatggtggcatcctctgcaatcgtcgcgctgttatgagcgtcgtgatgcatcgtcttttccgagtcgccggttgttgatgccatggtgatgcccccgtttcacgagttgacgatacgcttcttacgctgccgtaacctacgttagcgtaacttttatgcttgtcaataccgactcgcacgaacactatcacccaatggcggcgatactatggaatccgaagatgagaacgtcgcagcaataaagggctcggcgatggtgtattgcacggagtgtgggtttgccaacgagcaaggaaatgccttctgttcgcagtgcggaagcccattggagcagcccgaggccaatccggcggcccctgcttctcctgaacctcccgccgggcgtcctggcgtcgatcacaccaaagcgcaggcaaacgcgatgatgggttccatggacacagcaatgccggcaatatggtggcggcttcggatatcaaactgtacgtgatgcttgccgtgtacgataagcaacatgccggcaccttggccacgggcgggaagccgtgcaacgcgattggcgcggtattgaagatgcgatgtcgtcatagtcgtcgtacttgcccgtgtggcttgccgcgacggcggcggtgcgtctgcgtatgatagggatatggctgatttttcacatatccttgcaacgcgccccgacttcgacgacgaggaccgcgagtggctgcatcatcttgtcgccgattggcaggtgatcgccgatttgagctttgccgatctgctgctgctggtacaggatggcgatggcaaatacgtggtggccgagcaatgccgtccatccaccgttatgacgctgcgggcggaagacgtggtgggaaacgtcatgccggacgacatggtcggcgaattggacgccgccatgctctccagcgtggtgttccgctccacggtattgagaaccgtgggcaaggcgaccgtctgcaacgtgtacgcgccggttcggcacaatggcaagaccttgggcttggtcgtgcgtgagaccaatatggccacacgagaatccaacggccgatatgagtcggaaagcatcaacgccggcaagcatctgtacgagatgattccgcgaggccaattcccctacaaggattcggtgatgagccaacgccatatcgctcgcgtggcggacggcttcatcatcctgaccatggacggcgtggttcgatacgcagccccgaacgccatcagctgctttaggcgtctcggtctgctgaccaccatgcctggccattacctcagcgaactcggcacacagctattgaaggagaacgaccctgttccggaaaccctgccgttggtgttgacaggcaaagccgcggtcgactccgaactcaacgccaaccgttccgccgtctcgatgcgctcgttgcccttgtatgacaacaacggccgtatcggagcgattctgctatgccgtgacgtcaccgagctgcgccgtcgtgagcaggagctgcagaccaaggacgctacgatttccgagattcaccatcgtgtcaagaacaacctgcaggccgtctccgcattgctgaggcttcaggctcgtaagaccaagtcggatgaggtcaagaaggaattgcaggaggcgcaacgccgcgtgcagaccattgccatggtgcatgagggattgagccagaccgccgacgaggtcgtcgacttcgacaaggtgatcgccaacctgctgcgcatggccgtggacctagccacgatgaaagaccagcacatcgatatcaactacatgggcaagttcggcatgatgcccgctcaggatgccacgccgctgtccctcgtgctgaccgagctcatcaccaattcggtggagcatgggttcgaaggccgcaaggatggccatatcacgatttccgtgggccgctccggcccgaacctcaatgtggtggtcgaggatgacggttccggtctcggctccgaagaacagggtggattggctcgttcttccggttccggtttgggcacgcagatcatcaacacctttgtgaccaatgatttcggtggttccgtgcattgggagccgcgccgcgaaggcggcacccgcgtggtgcttgatatgaagctcagggctgctcaggacgagtgatgcgaagcccgaaatgaggaaaccctcccaagcgggagggtttcctagtatgacgaagcgataatcaaaacatcagatttgcatctgcatggcctgagaacggcgggcgcgcatggcgcggcgcttcagcgcacgacgctcatcttcgctcaagccgccccacacgccgtaatcctgattggtgtccagtgcgcacttcaggcatgcgtcaatcactttgcaggtgcggcacacggccttggcctcctcaatctgctgataggctgcaccggtgttgcccaccgggaagaagagttccggatccttgtcacgacatgcggccttggctcgccaatcaaaagcgctgctcattgcttgcctcccttaaaagccccgtggctggtgttgttccttaagtccagtaccaaggtaaccacgaaccgtggtgattttcaagaggttttgccgagaaaaaaccgaagttttcacgaagcgcactgcaccagacatgccgatgtgccctcgatgagcacggcccggcccgcgttgtcggcatcgatatgactcatcatatccaataggcgagcggggactccggccataagatcggacgttctctccccgcacgggaacacgattctggtattgcaatgctccggtatacgtatcgggcgaatcgtgctgacggcgaataccacgctgacggactcatcggccaacgcatgtgtgaaagacagcgcctgctcgtcggtgcggaatgggtcgaacaactcatcggcgtcgtcgacgaaccacacgatatgcggaggcggtggtgcatccgagctggcatacggcgtgcagcggccgccatgaagccattgcgagctccatacccgacgatgcggggaactgacacgtaccgccaagccatcagccatgctggcgtgtcgagccaatgttttcagcaacgtggttttgccgcgcccctgcgggccgatgacaccgatattgccaccggtgagggataccgtcgcctctcgcaggttgatgccatcgtcggcaagtccaaatcgaatgcgttgcggtgcgtggtcggccacagtccggtcttttacgtgccgggggagtggcgcggtaaacagggacggttgcggcgggcttccgacgaaccgcgatgcgaacgcgatctggcggcacaccgcatcgatatcgcgtgccgttgcacagcggaatgccgtcacctgttcggaatcgttgcagaacgccgcaccgggcattgccggactgaggtcggcggcacgaccatcgccaagcagctcgcatgattgcagacggtcccgaacccgtaaacaaatgctgacggacatattcgccttcatatcggcactgacctgacccatgggattctgcgtacaggcgatcagatacatgcccagtgacctgccgagcgaggcaatacgcaccagacgattcacataatccgggagctggtccttcagggcatggaattcgtcaatgaccacgatcaggcgcggtggtggattgaccatatcgcggatatcggaagcatggacagcggcggacagctgttcacggcgtgtcagttcggcttccagcgcacgcaacgcgcgtacggcatgcgccagatccagatcgcatacgctgcccacggtatgcggcaaccgttcgagtttgcggaacgcggaaccgcctttgaaatccaagaacacgaaattcagatgctcaggcccgttcatcgaggcgagcgccagacaccagctttgcagcaacacggattttccggaaccagtggtgccggccaccagagcatgcggcccctgacggttcagatcgagcatcagcggctcgcttccggtcatgccgatcggcaccgcaaggtcaaggggttcaagccagcggcccacaatggcgcgccatggcaggcgtgcgaagtgcagcagcgattctatcggctgcgacggcgcatgacggaggtctgcggcgcggtcatcggcgtcgcccgtgataccgacatcgatcgttgcctgttgcggatcgggagccttctccgggcctggaggcgaggggagcgtcagcagcagggacacgagacaggcgaatatgcccggtgcgatcatggcggcgaacagccattgcccgtgcaacagcagtatgaccatcatcaatgcctgcgcgatcatcgggcatgccgcggcaaacatggtcaggcgggcgcgcaatggcggcgcgcccaaacggtgcttcgcccgggatacggcggatgccgtatggacggaatgtcgcttcgaatcgttctgctgtgatgtcatgcttccagcgtgggggaacgcatgccgaaagcgcaagccgaatcaaggtatgtggttctagcttgccgagttatccacatgacattttgcccgtgcatgattggcggtgtaggcaacggtgacgatcatgcgccgatgatgaagccgatgggctccgggaaagcgtcggtcagccttccgccagattgcccacggtgccggccttatacgtgccgtcggcaagttgattgaacagttcggtgttcttggcgtcgtcaagcagcaccgaggaaccaacgccatcaacgtaataatcggggtcggaccagtacacgctgccggagatgccattcgagccggtggcgcttttgaacgccaacgccatggtgagcaacgtgtaagggttggtcttctcgtccacggtgagtgcgctcatcgcggcattggacactgccacgattttggacggattggtcagggtctcactgctggaagccttcttgacgatggccgagatgacctgtcgctggcgttcgttgcgtccgaagtctcctcgcgcgtcggcatatcgcatacgagagaaggacaatgcggtggaaccatccgccgtatggcatcccgccttccagttcagtccggaataggaatcctgaacatcctcgtcatagcacagttcgataccgcccaaggcgttcaccacgttctgcagaccgccgaacttgatctgtgccacatgatcgattttctggccggtgatctgctcgacgttgcttaccaaagccttcttgcccgcaatcagcgccaccgcattgattttcatgtactggttatcgacgttcatgagcgaatcgcggggaatggaaaccaacgaactcggcccgcttttgggcttgatcagcaccagaatcgtatcggtcctgaagccagagatattgtctacgccgccgtaatcggtggaaccgtcacgctcatcggagccaagaatcagccaagtcgaggccggcgtgttgggggtgtcggtcagccagtcgctccgattcagtttgctgtccacccattgccaggcaccgaaaacggaaagaatcaacaccgccaccagtaccgcgattgcgcatagggtgatgcgtaaggctcgcggacggcgtgccgttaccgttttcgccgttgccgccgccggccggccaagatggctgaacttcgtggacacgtttgctgctggcgatgagggccgggaaaccggcatatccgacggattgcgcacggcgttgcgggatgagccggaagacatccgcgctcgcgacggcggaatgctgcgcggtgcggcggcatccggagccgtgctgcgagtggcgcgtccggttttcggagaaaaactgggcggagtccgcctgccgttgtccgcgacgttggcgcttgccgtggcgttggcgttcagttgaggctcttcgatgtcatttcccgtgacggacggacgggccgatggagcttgacctgactggcgcgaggttcgggcgggggcgaaggagcgtggcacctgcccggaaggccgggtgcgtcgatttcccgcaggaatgaagcttggcgggttgatatgcggatccgccccacctgattcctgcgtcataacccctcctgaaactgtcgattgtctgaatgacactttgacacagcatccgccgggtgttcctgcgctatggtgttcctgcgcaggaacggcacaatatcatgtgcaacggcatcagggcatcgtgtccgcgccatagcacacagttccataaaaatgatgtaatgacacgagaaagaatttgacaaaaacgaaattgcatgtgtgtaatttagtccgtatgaaaagctcaataggcaaggagaatcgcatgtggggtgtggtcgacgattcagccgaagagccatggcatgaattgtggggactattccgacctgatggcgatgtatcttggcagcacaaggcgttgtgcgcgcaaaccgatccggaggcgttcttcccggaaaaggggggctcgacccgtgatgccaagcgtgtgtgcgccaaatgcgaagtgcgtgaacaatgcctgaaatgggccatcgaccatgatgagcgattcggtatttggggcggcatgagcgagcgcgaacgccgtcgatataagcgagagcaccgggagcgggcgtagctccacacacccccttcaagtctggtgcgtacactgggagtttatgagtccgacaggtaatagcgatattcatgaggcgttggccgacgccatgtcttctcgaccatatacgcataggcaggatgtggataccggcattacggctgtgatcaccgttgaggaggatatgcgtttcctccggtctacattgcgttcggtattgacgcagaatgttcttccgggagtcgtcatcatcgccgacgcgaccgggcgcgccggttcgaggataaccacttcgttcgaggtcatcccctcgccatcggggccggtgatggaggtgccgcagtccaagcatgtgaccattcacatcgtttcggccaagggcgcgcgttccttcggcgatgcggtcagccgggcgttggatcgtgccgatctggatgacgctccccgcgcattgtggttgctccatgatgattcccgcccctcggatgcctcatgccttgaacgattgcttgaggcgtggcgcaatacgccgggcgccagcgtgctcgggtgcaaacagtgtgattgggaaggatcccacctgcatgatgtcggtatgtatgcaggccgacacgccgtgcattccctggtggtcgatggagaacccgatcaggagcagtatgacgggcggcaggatgtgtttgcggtgtcgctggcaggcgcgctggtgtccatgtcgcaattcacgcgactgcggggcatcaatgcctggctgaccacctacagcgaatcggttgatttctgccgccgtgtctgcctgagcggcggacgcgtggtggttgtcccgcaagcggagatatcacatcgtcgcgcacggtatgagggcattcgtacgcgaggcggggaaccgcttaaggacgatcacacggtcaatcatgcgatgacggtgcatcgctcccaacagcggtatctgtacacggacctggccatgtcgtcctggtttatcgtctggctgtggaggctgctccgcagttttggcatggccatatccatgatgttcggcaagaagccgtatgaagcatgggtgcaattgtgcctgccatggctggccttggccgatatcgcgggaaacatgaaatcacgcagtctggtggccagacaatcgaaggtcgccgcatcgtccctgcatgtcttgttcgcagacagccagcagatcaagcagttccatgatcgtcgggatgcattccaatcccagcagggcagagtgctgctcagtccgctggaacgtgcccatctgcggacacgcaccatatatcgctggagtgcggccgtggtgatggcgctggtgtgctttgcggccatcgcggtgatgtattggccggtgttccgttcgatattctccggcggatcgttgtattccgatgtgttgcttcccaccggtgccagcttcacgcaactggtgcagtccgccaccacgccgtgggtgtttggcagcggcaccggcattcctgcgccgcccacgccgtggctgctggtgctgatgctggcctcgttggtcacgctcggccatgtgaccgccgctttggcgatgatactgtttgtggccgcgccgctgagcgcattgtcgttctgggcgctggcgggcgtattcacccgctcggacgtggttcgtgtgctgggaggactgctgtgggcatccaccggcattatgttcggctggtatgcgcaggccaatatgccgatgcttaccgtaatggtgttcctgccggccgcgttcgcattcgtgttccgtgccgtgggcatgtaccataccgaagacccgctcaagccgcgcacatccgttcaggccgcggccatcgccgcactgtgcttcatccctgtggtggccgctgaaccgcagctgctgttcgcgctgatcgtcgtgttcctgatgttcctgctattcgtgcgtcgcaagcgcgccatgctgttgctaattccggttcctgccgcctttgcggtggctcctacgctcgtcaatgcggtgcgttacgccgatttgggcatgtggcgtcaactgttcggcgacatcacggtgccaacgtcatccgccaacgggtcgccggcgtcgctgagtctgcttgaggccgcacagcgtgcgctgggatggcgaatggggtcgactgattatgccgatttggcggtcactgtgctgtttggcgtcatcacgctgcttgctcttgcttcgctggtgctgccgttcgcgttgcggacctcgcgactgatgtgggtggtaatcgtctgcggaggcgcgctcgccctggtctccagccgtgtggccataaccgtggatgccgatggtgtcgtggccggttccgcgcagccgggcatcgcgatgatgatattgggcttcctcgcctgcgtgtgtctcgtcgctggtggggcggtgaagcgattccaaccgttgcatgcgtctggcagtgatcccgcatcgaaaaaggaccgtctgcatgtgctcatcgtgtctggccgtgtggtgcttgctctgatactggtgtgctgcattggcatccaatgcatgtatggcatcgaacgtcataaggatgcgggactgggcgtgtctgaaaacggcctgcccatggtcaccaccgattatctggaggccggtgccgatcatcgtgtgcttgccgtgagcgcggagacccgcaacatcgtcaactatgcggtgatgcgcacctcgcgcggcgatttgatcgacagctctccggtccagcgggcgcgcctgctgtccggcaagcatgatgcggttgacgaacaactggcccaggcctgtgcctcgctgctgtccaatcccgacgaagaggccatcgcggccatcagcgcgcttggattcggcggcatctacgtggttcccgagaccggcgattccttgaacgacatgccgtatgaacagttgagcgcgaatatcgccgcatcgaacggcacccagtccctggtctccacggatagcggcagctactatcgtctgacgctgcgtagcagcgcctcacagcaggtggatacctcatggcagcaacgtgcacagcatagtgtctggaggcacgcctggctgatatgcctaggtgtgatcacggcgttgtactgcttggtcgccatgcctcgcagacgaccgtcctacggattggaggagcaggcatgagcaacaaaacttctggtttcaaacgtgcgatcggcatcgtgctcggtgtgatcaccatgctggtgttgattgcgctgttcgtcgttctcgtcatggcccccatccccaatatctgggtggataaggtggccgcttccgataatgccatcgaccagaccgttagtccgacccagtccgaaacctactgcccggcacctataggattggccgataccggcacgtacggcgacagcgccttccaggccactgtcggcaatctgagcacacaagcgcgctatgcggcgttcggctccgtctacagcgccactgtctcggcgatcgggcaaaagtccagttcagatgacgtaactttgaaagacgccgattcgaccgacgattcctcggtgaaaaccggtgctcagaagatcaatcagggagctcgtctgatcaatacccgtatgctgcaggccgcagctggcaccggcaccgtcggcaccatcgcatcatgggccgatgatggcgatgtgagaggcatatcggcggcatcctgcgtatcgacctcgctcagccagtcgttcctgctctccgacagcacgaccggtaccacacagcagctcatcgtctcgaatctctccaccaagccgaccaccgtcgacattgccgtctggggttccgagacagccgggaaaatggcattgtccacccaatccacgctgtctgtgccagccgagggggagtcctcgatggaactgtccgccgcggtcgatgggcagcatggtctgttcgtgaccgtttccagcaaggagactcctatcgcgtccgtggtgcgcacggtgaccatggatggtctgacaccgaagggttctgatttcgcgctgccgctgccgaccgcatccaatgcatcggtggcgccgtccatcactgccggcgatgcggtcaccgcttatctgttcgccaaggcagacaccagcaccgggctgtcatggattaccgccaaaggcttggttcccgccaaagatgccaccgtcactgctgataaagtgacggcgatcgacttgggagaagctcctgatggggcgttgggcgtgatgtccaccgcagaggacgccgtgtcgttctccgtcaaggccacacgctccggtgactccggccaagccgatttcgcattggtcaatgccggcgagccatccgaattctcggggttggcccttcccgacggagtaaaggcctccatcacgctggccaatacgtccaatgcgcgcaggacggtcaccttgcgcgcctacgatgatgccggtgcttcggtaacctccaaggaaatcacactggatgcgaacgcagcacaaacgattgaagccggcaatctttccggcgatcatggcaccgcggtcgtgctgatgttggaggactcatccaagaaagtgagctggggagcgcggttcagtcacgattcgttgcaagacaaggacatcgccggattgtccgtcatcgacgcttcaacgctgatgcccgccacggttcatgtctgggctcggaacgattcctccatcgtcaagtagaagggtatgctcgccgaagcgtcagtttgatgatgtttcggcggcgatatagctgcgggccgtgccactaccttattacaagtgacacggcccgcagtgttgtcacaggccccagtcggggtcgatttcctcgggcctgcgcccatacaattccgctatgcgggccaccagctcatccctgacggccaattgcagttcgagcttggtaggtgcctcggtctgcaacggcatgcggtagagcacgactcgtgcgggaatgccgtggctggcggggaagcactgggacgtcatattcggctcggtctgccaaggcgtcggatccgaaggcggcacatcctccaccgcgaactggagcggacgtatcagttccggccacgcttggccgagcctgcgaacctgggccgccaccatatcgtcgaacatgccggtgcgagtgcggtaacggggcagacgggtgccgaacatcggggttcgtgtgccgcgaccgtggcggttgcggtagattcgtgcgttccaaggtggctgaagcatggttcccaccatagggcatggcggaggcaacatgcgttaggattggttcattggctgtgaacattcgtcaacgagggaggcgcgacaaatggtggtacgttcgtggtccgaacttgatttcgataatgtctgctccaacgccaaggtgttcggtttcgatttggacaacacgctggccagctcaaaacagccgatgaggcccgcgatgatcgaacggttctgtgcgctgctcgaccatacggtggtggccctgatctcagggggcggcatggcggtggtcacctcacaggtgctggatgtactcaccccgaatgccaggcgcggcaatctgcatgtcatgcctgcctccggctcccggtattaccggtgggatggcacgcaatgggccttggtgtatgcgcatgatctgtccgaagccaccgtggccgctgtctcggaaagtcttgagcgacatgcccgggaactgggattgtgggaacagcaggtatgggggcctcgaatcgagaacaggggcagccagatcaccttctccgctctgggacagttcgcacccgtagcggccaaacaggcatgggatcgcgataacacgaagaaacaggcgctggtcgaagcggtcaaggccgatctgccgcacatgcgggtcagggccggcggctacaccagtgtggatgtcagcgaatgcggcatcgataaggcctatgccgtgcgcaagctgacgcagacacttggcatacaggccgatgaaatggtgttcgtgggcgatcgcatgacgcctacgggtaatgactatcccgcggttgaggccggtgcgatcggtgttcgtgtggagaatccgcaagacacggtacaactgctggatgcactgcttgcgcgattcgatactccagcttgatggtgacgcgttatggacgggccgagcgtatacaagtggtggcatgcgatgtgggcacaggtctgcaatctgctgtttccacgcggctgcgctgggtgtgacgcgccggatgaggtattgtgtgcggcatgtcgggccttgttcgcacaatgccgggagcgggatacagacggtggtggcggagcccgtatatggtccgcatcgatttaccagggagcggcgcgtcgtgccattctcgactggaaggaccacgacgataccgagcttgacggccctttcggccgcatcatggtgtcgctgctgaacaagacgccaatatcatcatcatgcttggggcatcgcgtattggtggttccggtgccgtcatcgcgggcgtcaatgcgccgaagagggcgtgcccatacggcaccgttggccaaatcggtggcaggggcattgcgtgggtacggtgtcaatgcgcgaccatgcaatgccctgagctcctccaccaaggcacgctccgtgcagcagacctcttcggcacagcgtgcccgtcgtatcaccggtcatgtcagggtgaagcgtgatctcataggccatggcgacgcggtgcttctcattgatgacatcgtcaccacaggtgccaccgtgcggcaatgcgttcaggtgtttcagcaggccggcaccaaggtggtgggcgtgctggtattggcggatgctgtggtgcgacggtccgatgacgatatcaacgggtgaatgacatcggtgacgatgccccagatagcaggcgaagcgccgttgctcggcatgtaatcgggatatcgaggattctcggcgtgcaatatggtgatgccggcccgtgaaactagtcgtttgatggcgatttcatcgtccatgacagccgcaaccacatctccggggactggtgccaacgaacgatcgacaatcagcagatcgccgttatgaataccggcattgatcatggaatcgccggccatctgcatgacaaacagcgtggtgtcgtgcggcatggttcgtgacttggattgctgtgtcatgctgtgcctcccaccctgtattcgaacatctgttcgaatacagtatacggtaggacggcggacaatatcagcgttcggcgacgtgatatttaggcaggatgatttcgaaatcggcgcctcgcgtgtcatcgaccactttgacggtgccgccgtgcaattgggccgcccaacgtgcgatggacaggccaaggccggtgccgcccgactcggtgccgggacccgtcttgcctttgacaaagcgccggaagatatccgaacggtcggacggtgcaatctgggagccgaaattcaccacattggtcacgatggtgccttggctgtcatcctcatgggcatcgaccagcacggtggtgccgtcggccgaatgcttcagtgcgttggcgatgatgttggtgaacagctggcgcaggcggtcctgatcgccttccatcgagatgtcggccggcacggtgacgcggatgtcgtgggcgtggccgccatcggcgatttccaacggctcgatggtctcgtcaagaaagtcggcgaagttgaacttttcgatattcagactcgccgcaccggcctccatacggctcaaatccaacaggaaggcgatgaggtcggagagacgctgcgtttgggtgaggatgctctccagattggcgggagtgggctcggtgacgccgtcggccatgttctcgaccatcgcctgcaaagcggaaacgggcgtacgcagctcatggctcacattggctatcatgtcgcggcgcattttatcggcatgttcgagttcgccggccatctcgttgaacgagcgagccagctggccgacctcgtcatgacgatcctgatcgatatccacgcggaccgtgtaatcgccatccgccatggcttcggccacatcgcgcatctggcgtaagggagcggtgatgccgcgggagaagaaataggtgatgcccaaggccaccaccaaagtcagcggcatggcgatccaaccggaccagccgaatttcaggaggaaccagcacatggcaaacgcgatggcagtggcgataacgatcagtacgctgagttccagcttcagagaggagaacaaatcaaccggcttgacgcgaggtttcatcgcatcaagccgggattgctgttgttttttggatgccatcacgcggtcggcggctcgaaagcgtagcctacgccgtgcacggtgcggatggtatcggcgccgagcttatggcgcagcgccttgacgtggctgtcgacggtgcgggtgccggatgcgtcgacccagtcccagacctcttcgagcagcttttcgcgggtgagcaccgacttcgggcggcgggccagcgtggccagcagatcgaactcggtgggggtcagatgcacctgctcgccgttcacggtgacgatgcgctgggccgggtctatgaccatcgaaccgaagtcgagcagcttctcgttctccgaattcttggcgatgaccttcgcacgctccacgcggcgcagcagcgccttgcagcgggcgatgagctcgcgcatggagaacggtttggtcatgtaatcatcggcgcccgctcccagaccgatgaccttgtcggcctcgtcatcacgtgcggtgaggatcagcaccggcaccggacgttcggcgacgatgcgtttggtggcctcaagaccatccatgaccggcagcatgatgtccatgatcaccagatcggggcgtagctgggacgcggcctggacggcggaagcgccgtccccggccacgcgagcggtccatccttcagcggtgatgcgctgggcgatggccgtggcgagtgtgggctcgtcctcgaccaccagcaccgtgcgcggtgtcgtattctgacgcgctgtggtattgagcataaataaaccggttacctttcagcctgttgaccagttcagtcttccggcttcaagaatacaactcccagagccggaacggtgatcttcgccgagaacggacgcgaatgatattcgccctcgaccgcttcgaaggtgccgttgtggatgtcggagccgccgtacttggcgtcatcggtggtgaacacttcggtccacttgccgccggtgggcagcgccacctggtaatcgggccaggcttcaccggagaagttgaccaccacggccaaggtctcgcccttggtgccgatgcgcaggaagctcagcgtgttgtggtcggcatcgtcgctggtcagccactggaagccggccggatcgaagtcctggctccatagtgccggatgcgccttgtagaaggcgttgaggtcggcgaccatggtctggacctgacggtgctcctgccagttcaggcaatcccaatcgatggaggcgtcgtgatcccactcgccccactgggccagctcgttgcccatgaaggagagcttcttgcccgggtgagcccactgataggcgaacatcgaacgcacgccggccagcttctgccagccatcgcccggcatcttgccgtacagggagcccttgccgtacacgacttcgtcgtggctgatgggcaatacgtagtgttcggagtaggcgtacaccatggagaaggtgatttcgttgtggtgccacttgcggttgatgggctcctcgtgcagatactcgagggtgtcgtgcatccatcccatgttccacttcataccgaagccgatgccgccggcggaggtgggggcggtgatgcccggccatgcggtggactcctcggcgatcatcatgacgccggggttgttcttgtacgcggtggcggtggcctccttgaggaagtcgatggcctccaggttttcgcgtccgccgtagatgttcggacgccaatggccgggttcgcggctgtagtcgaggtagagcatggagctgacggcatccacgcgcagcgcatcgacatgcaggtcctcgagccagaacagggcgttggccaccaggaagttgcgtacttcgcggcgtccgaagttgaacacataggtgccccattcggggtgttcgccgcgcagcgggtccgggtcctcgtacagcggggtgccgtcgaagcggccgagtgcgaaggcatccttcgggaagtgggcgggcacccagtccatgatcacgccgatgccggcctgatggaactgatcgaccaggtaacggaagtcgtcgggggagccgaggcgggaatccaccgcatagtagccggtgacctgatagccccaggagccggagaacgggtgctgtgccagtggcatgaactccacgtgggtgaagccttcctgcttgacatagtccacgagctgcttggccaggtcgcggtaggtcagtccctgcttccagctgccggcgtgcacctcatagatggagaccgggccatcatgcgggttggtggtgcggcggtgctgcatccaggcgtcatcgttccactcgtaggtggattcggtgacgatggaggcggtgttcggcggaacctcgtgctgacgctccatcgggtcagccttcatctcccacgtgtaattggcgttcaggatctggaacttgtaggtctcgcccgcgccgatgccggggatgaagatctcccacacgccggaggagccgagctcgcgcatggcatgacgacggccatcccaggcgttgaagttaccgaccacgcgcacggcatgggcgttcggggcccacacggagaacgcggtgcctaccacctgttcgccgggcgtgccgtccacgccgcccatcggatcgtcatagcgcagcacatgcgcgccaagcgcctcccagagcttctcgtgacggccctcgccgaacagataggtgtccatgtcgccgactgtgggcatataacggtatgggtcgtcctcaatgagcactgcgccgctttcccactcggtcctgacgcggtagtcgggaatcgtgggctgcttcttggtgccggaagccggcacggtggtcacgaacacgccgttgtattcgtgggtcatcgggtattcgccatcctgggtgaggatggtcacggacttggcaagcggacgcagcacacggattgtggcggtgtcggcatgcttgccgatgccgagatgcccgccgagaactccgtggggattgtagaattcagcattgctcaccgcatcgaggtcgccttgggcgacaggcacggtgacggtatcttccttgatcttcgtttcttcagccatgacccaaagtctacgtgcgttggagtcgtaaacgctacattggcgcgtcgaaaatggcgaattcttgcccttttcggtgtgtcttcgtggttgtgagcgctctcataggggcggtccaggccgcatggcataattattcgagtttttgtgtgtaagccgtcagttctcggagggtacatgtcttacaaagtcggcgatatggtcgtctatccgcgtcatggtgcagcgaaggtggaggccattaccgagcggacggtcaagggagtgacgcgcgaatatctgcagttgtccgtactctcttccgatggtttggtcatcaacgttcccgtggacaatgccaagaaggtcggcgtgcgtgacatcgtctccgcatccgaagtggccaaggtattcggcatcctgcggaccccgatcatcgagaaagagatgaactggtctcgccgttacaagctgaacgtcgaaaagatcgccaccggcgatgtcaacaagatcgccgaagtggttcgcgatctcgcccagcgcgatgtcgacgagcacggcctgtccgcgggggagaagcgtatgctcaccaaggcccgcgccattctgacttctgagatcgccttgtccgagaagatcgacgaggcggaagcccagcgtctgctcgacgtgaacctgggctacgagcccgctcaacccggtgacgacaagcatcacaccgccgagcccgaagaggccgcggccgatactttggctcgtgtcgaagccgagaagaagtccaagaagaagtgatttgattgttgaggccccggtcgtgtccttatgcgatacgccggggcttcgtgattcataatcgtttgctgccgttcgtctgggcagcgccatcgaaggggactgcatggggtctgcaggagtgttgatagggcagggttttgacgctcaccgttttgcgcctgccggctcaggccgtgaactgtggattgccgggctctactggccggcgtctgattcatgcagcgaggccgatgccgccaaatacgaggggatcgaaggcgattccgatggcgatgtggccgcgcacgctctgattgacgcgttgcttgccgccgcccgcttgggagacattggttcactgttcggtgtcggtgcggacgcgcatggtgccggaatgcatggcatcgatatgttgcaagaagttgtggcgcatctggcatccaacgggtatacgccggcatcggcctcggtggcgatcatcggcaaccgcccgaaaatcggcacacgccgtgctgaagccgaagccgccctgtctgcggcggttggttgcccggtatcggttactgccaccaccaccgaccatatgggattcactggccgcggcgaaggcatcgccgccatcgccaatgccttggtggagaagatataacaaagcccccgctatgaattcgccagcgggggcaagaaaaaatggatgagattacttccgcatcgtctccacggctttggcgatagcccagaacagggtggaaagcgtcacgatgatgaagctcgggggagcggggaacatcgccgacagcacgagtccggcccaaatcgacaccaagcacagcacgctggcgatcaccattgccttgaatggggagccggccagaatattggcggtggccgcgggcgtaatcaccagtgcgaaaatcagcaaggtgcccactgccggcacggcgatggtgatcacaccggccataatcgccataaacgccacgttcatcagcccgatcgtcacacccttggcctgtgccacctgctcatccagcgagctgaacagcagcgggcggtagatgatggccaacaatgccagcagcagtacgtcgaacacggcgaagccgatgatctggccggtggtgatggtcaggatcgagccgaagaggatcgactgcatctgctgggaggcggaactcgacaatcgcgcgaagaacagacccaagccggtggcgaaggccagcacggtgccggtggcgatttcacgctcggaaacgcgcttgcccaaagcaccgatcaccagtgcgccgcccagtgcgaacacgcccatgcccagtgacacgggcaggccgagcaacaccgcgccggtcgcgcccggcagaccgatatgggccagcgcatgggccgcgaaggtggaacgacgggcgatggtgaagtatcccatgacaccggcggctagggcaatgcacaggccggcgatgaaggcgttggtcatgaatggagcggacagtgtatccagccattcgggatcatacgaaaagttgatggtgctcatgtctctgtattttctccatgcctgagctgcagtccgttgatgggctgtgggtcggctcgcttgatgttatcgattctcggcgctgatggcggcactgccattggtggcattgccgtgctcgtgatggtgcaattgcgccacttcggctgccgtgtgcatatcctgcggctggtcctggagctcatccggcgtcggggtcacgaacatgtctccctgcggagtggtgaccacctgcacctgtgtgccgtagaggtgggtgagtaggtcggagtcgagcactttgtgcatatcggcgtagtgcgggtgaccgtcgagcaagtagacggcaccggtcagaatcggcaagagcatattgagatcgtgcgcaaccacctggatggtcatgttcagttcgcggttcagcttggccagcacgtgtacggtggcgcgctgactggccagatcgaggttggccaacggctcgtcaagcatcagcagttgtgggtcgcacaccaacgcctgggcgatggccacacgctggcgcaaaccgccggacagttcggacagacggtaccgcgccttgtcggcgatgccggtgaactccatcgcctcgagcgctttggctttctgggccttggtgatggggtggatgccgaatcgggtgccggtcaggcccagcaacacggattgttcggcggtgagattggaatcgacattcgccacatagctctgcggcacatatccgatgcgtttgttcatctcgcctgcgggcttgcccagcacggtcaggctgccatgacagagcggcaaaaggcccagctcggccctcatcatcgtggttttgccggtgccgttggtgccgacgatggccgtgaccgaaccggtgggaatggcgaaggtgccatgctgccagatgatatggtcgccacgcttgatggcggcatcgctgaacacgatgcaatcggaagtttcactcataacgcccgattgtggcaaacgatgctgacaatcgttctcaatatcgtgtacggatggtgataaccaaagagaagggttgtgcggccatctcgacaatggtcgcacaacccttctcatgcaaggcgtctattggcattggcacgaatccgatgccggtgtcctttgctcctaactatttgccggagtcggtctggtcgttgccggaggcatcgccggaatcgccattggcggcatcggcctttgccgaatcctgagatgagtcactggatgcggccgccttgcactgacggatgtacttggggtccgtgctggaaccggtgctggccttggagtcttgcgcattggcatcatccgtggcggagccttcggcgctggaatcatcggaattcgcgttgctgtccgcggtatcgccgtccgtggcgtcttcgcagccatagcttggatccaccgcgtcgatgatggtgttgatgagctggttgatccaggcgttcagcgtgtcggcgtccttgggcatttgttcggagacgtcgactaccggcacatcggcgcgaccggcagcgccagtgatcatattggtcgcgtcactggcttcctgcgtgttgttgaccagcacatccacgcccttgtcttcgatgagtttctggaaagactgcaggtccgcgggtgccggttcgccgccggaagcggtcgattgcgtataccccttgggcgtctgatctttgaacccaagatcggccatcagataatagaccacgggttcggtggctgcataggtgaggttggagtgggacttggtgaactcggacgcccatgtttccaacgatttctcgtccgcctgccatgccttgagccgcttctggaaggctttcttcttgctggggagtgcctttatatatgcatcggtgatggccgtggccatgctggatcgagcgtctttggagaaccacagatgcgggttatcgccctcgacggcacccatgacggaagcggcggatacgatattcgtggtcttggtcatcgatttggtggcccaggaatcgtagcccgcaccgttggccacgatgatttgggccttggacagcttggcgacatccgaggtctttggctcgaaatcgtgggcatccacattggtggagttcacgatggacgtgacttccacatcatcgccgcccagctcggcggccagcgagccccattgattgagggaggccaccacattgatcggcccggtcggtgcgggaacgctggtcttgttgtccggctcggtttcagcgggggaggtggctgcgcatgcggtggtcgcgaacaacaggacggcgctcaggccggctgcggcgagtcgcgtaagtcgtgtgatttgagtccccatggcacgccttcttcgtgagagcgaacgatatataatcctgacttgttccaacgatagcctatcgtttcgatagaatgcaccgaaactacaggggagggcgttgatgtccacaaaaatcgacggtaagcagattgcggccgaaatcaagaccaaccttgccgagcgagtgaacaagctcaaggcgcagggcatccaaccggggctgggcacgctgctggtgggcgaggaccccgggtcgatgaagtacgtggccggcaagcacgccgattgccaggaagtgggcattacctcagtcaagaaggaactgccggcggacgccagcttcgacgacatcgccgctgccgtacgcgaactcaacgaagatccggcttgcaccgggttcatcgtccagctgccgttgcccaagggcatcaacgagaacgcgatcatcgacatgatcgacccggccaaggatgccgacggcatgcacccgtacaacctcggcgaactggtgctgcatgtgcgcggcgacatttcgacgccgctgccttgcactccgcgcggtgtgctcgagctactcgacgcctatgacattgatctgaacggcaaggaagtgtgcgtgcttggccgcggcatcaccattggccgcacgattggcctaatgctcacgcgcaacgccgtcaacgccaccgtcaccctgtgccacaccggtacccgggatgtggccgaccacatgcgccgcgccgacgtgatcgttgccgcaatgggttcggccggattcgtgacgcccgacaaaatcaaggacggcgccgtgctggtcgacgtgggcgtcagccgcgtctacgacgaagaagccggtcgctaccgcatcaagggcgacgtggacaaggcctgctacgacaaggcctccgcctacacccccaaccccggaggcgtgggccccatgacccgagccatgctcctagccaacgtcgtggaaatggccgaacgacacgcctagagtttcctaggaaatttgggcagagttgcttgtattgtgagtatctgtatgcctgtagggtgtgcgtataactgaatatcgagaaattatccatccactattagaaaccatatatttacatggcagagaacaacactgaagtcaccaaggttgccatcaacgacatcggcaccgaagaggacttcatcaaggcagtcgattccaccatcaagaacttcgatgatggtgatctggttgagggcaccgtcgtcaagatcgatcacgacgaagtcctcctggacatcggctacaagaccgagggtgtcatcccctcccgcgagctttccatcaagaaggacgttgatcctgacgaagtcgtcgaggtcggcgacaccatcgaggcccttgtcgtcaccaaggaagacaaggaaggccgtctgattctgtccaagaagcgtgcccagtacgagcgcgcctggggcgacatcgagaagatcaaggaagctgacggcgtcgttgaaggcaccgtcatcgaagccgtcaagggcggcctcatcgtcgacatcggtctgcgtggcttcctgcctgcctccctcgttgagatgcgtcgcgtccgcgacctctccccgtacatcggccagaagatcaaggccaagatccttgagctcgacaagaaccgcaacaacgtggtcctgtcccgtcgccagtacctcgaggagacccagtccgaggtccgcgagaccttcctgtcccagctcaagaagggccagatccgtgagggcgtggtgtcctccatcgttaacttcggcgctttcgtcgatctcggcggtgttgacggcctgatccacgtttccgagctgtcctggaagcacatcgaccacccgtctgaggtcgtcaaggtcggcgacaaggtcaccgtcgaggtgctcgacgtcgatctcgaccgtgagcgtatctccctgtccctgaaggcgactcaggaggatccgtggcagcgcttcgctcgcacccacgttcccggccagatcgtcaagggcaaggtcaccaagatcgtccagttcggtgtcttcatctccgtcgaggacggcatcgagggcctggtgcacatctccgagctcgccaaccgtcacgtcgagaacccggagaccgtggtcaagccgggcgagtccgtgttcgtcaaggtgatcgacgtcgacctcgatcgtcgccgcatctccctgtccctcaagcaggccaacgactccgttgacccggcttccgaggacttcgatccggccatctacggcatgccggccgagtacgacgagcagggcaactacaagtaccccgaaggcttcgacccgaacaccaacgagtggatcgctggttacgagaagcagcgcgaggagtgggagtctcagtacgccgccgctcacgagctgtgggaggagcacaaggagttcgtggccaaggagctggagaacgctgccgaatccgcagccgccgacggccagggcccgaaggaagagaagccggtcgaggagacctccaactactcttccgctgctccggctaccggtaccctcgccgactccgatcagctcgccgccctgcgcgaccagctgctcggcaagtgagtttgccgcgaagctagcgcttagcgtgtaaagaaacccggtccgattgggccgggtttcttgtgtttttggagttatccgccaatgactcccctcagtctcgctacgcgagccggctcccctccctgaggggagctgtcggcgatagccggccgaggggagcgccagctatcatgggcaccatgatgcgaataggactgaccggcggcatcgccgcgggcaaaagtacggtggcggcgcaactcaagcaactcggcgcgttgcatatcgactacgatgcgctggcgcatcagatcgtcgaacccgggggagtggcgctgccacagatcgtcgccgagttcggtcctgatgcattgctcgccgatggcactatgaaccggccatggattgccgatcatgtcttcggcgcgaacgccgcgccgggcgcacgtgaacggctcgacgccatcgagcacccattgatctatgccgaggcggcgcgactggagcatgagcaccccgaggcagccatcatcattcacgacattccactgctcgccgaggtcattgacgatattccattcgcctttgaccatatcgtcacggtcgaagctcccgtgtgcatgcggctcgaccgtatggtcgaggaacgcggcatgagcctggaacaggccgaggcccgcatccgccaccaatccagtgaggaggagcggcgggccatagccgatatcgtcatcgactccacccatccattgcccgagatgctggcccaagtgggtgagatatacgcaggatggtgcgcaggtcgctaagatgaggccctatgggattcaatatcgagcgcgcggacaagcctttcgtcgtcaaatcgccatataagccatccggcgaccagccgcaggccatcgccgaactggccgaacgcatcgaaaacggcgagaatgatgtggttcttatgggtgccaccggtaccggcaaaaccgcaaccaccgcctggctgatcgaaaagctgcagcgaccgaccctgattatcgagcccaacaagacgctcgctgcgcagctatgcgccgaattccgcgaactcatgccggacaacgccgtgagctacttcgtgagctactacgactactaccagcccgaggcatacatcccgcagaccgacacctatatagaaaaggactccaacatcaacgacgatgtggagcgcctgcgccaccaagccaccgcaaacctgctgacccgccgcgactgcgtggttgtggccaccgtctcctgcatctacggcttgggcacgccggaagaatacgccggtcgcatgctcttcctcaaagtcgggcaggaaatcaaccgcgacgacctgctgcgccaattcgtggccatgcagtacaagcgcaacgacatcgccttcacgcgcggcaccttccgcgtgcgcggcgatacggtcgaaatcatccccgtctacgaggaactggccgtgcgcatcgaattcttcggcgacgagattgaccgcatctccacgctgcacccgctgaccggcgacgagatcgacgaggaaaacgaagtccacatcttcccggcctcccattatgtggccggccccgaacgcatggaacgggcgctcaaaaccattcgcgaggaactcgacgaacgcctggcagaactgcgcaaacaaggcaaggagctggaagcgcagcgcctcaacatgcgcaccacctacgatctggaaatgctcacccaagttggcgtgtgctcaggcgtcgaaaactattcgcgccactttgacggccgcgccgctggcaccccgccgcacacgctgctcgacttcttccctgacgacttcctgctggtcatcgacgaatcacacgtcactgtgccgcagatcggtgccatgtacgagggcgatgcctcccgcaagcgcacgctggtcgaacacggcttccgcctgccctccgcgatggacaaccgaccactcaaatggccggaattcctgcagcgcgtcggccagaccgtgtacctgtccgccacgccaggcgactatgagatgggactgtccgatggggtggtcgaacagattatccgcccaaccggtctgctggacccgaagatcgacgtacgcccggtcaaggggcagatcgacgatctgctcgccgagatcaaggcccgtgtggccaagaacgagcgcgcgctggtcaccactctgaccaagaagatggccgaggacttgaccgactatctgctggaacgcggcatcaaggtcgaatacctgcattctgatgtggatacgttgcgccgcgtcgaactgctgcgcatgttgcgcgaaggcaagatcgatgtgattgtcggtatcaacctgctgcgtgagggcctcgatttgccggaagtatcgctggtggcgattcttgacgccgacaaggaaggattcctgcgctcctatcgttcgctcatccagaccatcggccgtgcggcccgaaacgtgtccggcacggtgatcatgtacgccgacgagaccaccgaagccatgcggcaagccatcgacgagactgaccgtcgccgcgccaagcagattgcctacaaccaggagcatggcatcgatcccaagcccctgatcaagaagatcagcgacgtcaacgacatgctcgccaaggaggatgtggacacccagaccttgcttgaaggtggctaccgcaacgcgggcaaggccggcaacacgcacctgggcgtgccggtactcgatcccaacgaggcagacaaacgccacgaggagatcctgaaggccggcctgcccgcgcaggacctcgccgacctgattcgccaactgagcgaacagatgcacaccgccgccgaacaactccagttcgaacttgcggcccgtctgcgcgacgagatccgagacctcaaaaaagaactccgtcaaatgacggaagccaacaagtaaccaaattcccatacccgaggcgggcagtcaggggatgcgttgtcgaccgtaaagacttggcctgagcggcccggagcgtgtcgaacaacacatcccctgactgcctggcgatcagcgctaccggaacggccccaaaaccgtcacatacataagttagtgtagggaatcatggcagaaaccccactcgcatttgaaatcatcaccttcgtggtgctcgcgttgttctttatcgtcgacctgttcgtcatcgggcgtcgaccgcatgtgccctccaccaaggaatgcgtgcagcatatcgccttcttcgtggttatggcgctgatcttcggcggatgcatctggttcttcgccggctccaagcccgccatcgagttctattccggctggctcaccgaatactcgttgtccatcgacaacctattcgtgttcgtcattatcatgtcgaacttcgcggtgcccaagcagattcagaagtatgtgctgtccatcggcatcaccattgctttgattttccgtggcattttcattctgatcggcgcggccctgatctcccgcttcacgtgggtgttcttcctgttcggtgccttcctgatctacaccgccgtcaaactggtgctcggaggcgatgaagatgaggaatatcacgagaacggcatcatccgtaatctgcgcaagatcatcaagattaccgacgactacgacggcgagaagctgcgcaccaccaagaacggcgtgcgttactggaccccgatgctcatcgtgttcctgaccatcggcaccaccgacgtcatgttcgctttcgactcgattcccgcgatcttcggcctgaccaaggatccgttcctggtgttcacctccaacgtgttcgcactgctcggcctgcagcagctgtacttcctgctgggtgctctgctcgacaagctcgtctacctgcctgccggcctgtccgtggtgctgggcttcatcggcgtcaagctcatcatggaggccctgcacggcaataccttgccgttcatcaacggcggcgaaggcgtccattgggtgccggaggtgcccacatggctgtcgctggctgtgattgtgctcgcaattggcggcgcatccgtggcttccgtgatcaagatgaagagcatggaaagcgctgaaaaggcctgaaatcgttagagaatacaacccttaaacccagtcaacacaacaatgtgagcgctcacaacacaccgtgaagaaaacttgtcatgagtcggctcgcgctagtagactgggtttcggcaaatggggcaatcgcgcctcgaaccaaattgaacaagaataggcaggcattcatgcgtaaagccaagatcgtagacaccatcggtccttccaccgaggattacgacaacctcctgaagctcgttgaagctggtatggacgttgctcgtctgaaccgctcccacggcacccccgaggatcacctcaaggtctacaacaacgtgcgcaaggccagcgaagccactggtcgcaacgttgccgcgctcgttgatttgcagggcccgaagattcgctgcggttggttcaagaagaacgccgatggcgaagacaaggttcagctgcagctcggccaggaattcgtcatcaccactgatgacgtcgagggcgacgagcacatcacctccaccaccttcaagggcctgccgggcgattgccacccgggcgacccgatcctgatcgatgacggcaaggtccgtcttgaggtcaccaaggtcgagggcaacaacgtgtacaccaaggtcgtcgtggccggtcctgtgtcctcccacaagggcatcaacctgccgggcgtcgccgtctccctgccggctctgaccgagaaggatgaggccgacctgcgttgggccatccgcaccggtgccgacatcatcgccatgtccttcgtgcgtttcgccaccgacatcgaccgcgcccacgagatcatggacgaggaaggccgtcgcatcccgatcattgccaagatcgagaagccgcaggctctggagaacctcgaagagatcgtcaagaccttcgacggcgtcatggccgcccgtggcgacatggccgttgagtgcccgctggaagaggtcccgctggccactaagcgcatcatcgagctggctcgccagtacgccaagccggtcatcgtggctaccgaagtcctcggctccatggtgaactccccggttccgactcgtgcagaggcttccgactgcgccaacgccatcctcgacggctccgacgccaccatgacctccaacgagaccgccgttggtaagtacccggatgtgaccgtggccaccatggcccgtatctccggctacgccaccgaccacggcttcgaccgtatcccggagctcaagaaccttgacatgtcctccaccggcgctgtctcctccgccgctgtggacctggccgacaagctcaacgccaaggccatcgttgcttacacccagaccggtgccaccgtgcaccgcgtctcccgtgagcgtccggccgccccgatctacggcctgaccagcaacgagcacacctaccactggctggctctgtcctggggcaccgaagccttcctgctcaaggaggactaccacgacaagtcccgcaaggatctcatggtctacacggacaaggtcctcaaggatgctggcaaggttgctgacggcgacaagatcgtcatcctgagctctgctcagggcgatcaccagccgggccgcactgactccatctacgtgcacaccgttggcgcttgcgactgatttcaggcttctggtagctgctgacagctagcatatagcacacgaaagcccccatccaaagtggatgggggctttcgttatctgttatgttgcgattgtgtggtgattgcaatggcccacagtcaccgcggtgatcgagcgtggcgatcagtcgttgagatgatcgagcgtgccgctcttcaggcgcaaaatggcgaccatggtcttggcatccacaatcgtgccattgaccaccatctcataggcatcgtccaccgacaccatacgcacgtcggaacgcggagtctccgggccgatttcctgacgggaagccggggtaagaccggtggcgaagaagattgcggtgtgctgggtggaatagctcggcgtgttcataaaacgggtgaactgcgtaagcttggtggcgtcgaaaccggcctcttcggccagcttgcgcttagctacatcggtcgggcgttcggacgggttgttggcgtgaccggccggaatctccaacgtccaacgatggttggcgatgcgatactgctcgaccagcggaatcatgccatcatcggtgacggccagcacagccacagtgtcgccattgttctcctgaacaaagtagcgttcaaacgaaccgatttgattcgactcataggagacgtgatcgacattgaaataatgcgtctccacaatctgtctacgggaaatctccttgaccggagaggggcgccagggatcgaactgacggtaagtttcgttgctcataagccctcctaacaaaagcgatacatcgaaactacagcccattgtaagcggtgaaaccacgcaggagaacgggcaacacacgggtgcgccgtccgcgatatcgacgtgtttcgcctgtttcaccgggggggaatggaggattggcgcgtgtcttgtgtcgcaagagtcgaattggtatgctactctcttcagagtgctttggcacgccctcgtatcccaattggtagaggaagcagcctcaaaatctgcgcagtgtgggttcgagtcccaccgagggcacccaaaagtccgggtcatacggcatcacgatggcgcggggcgaattgttcgctccgcgctttttcgtattctcagcaccgtcgtctggcctcacgatgtagcgtgggcccgttgctccggcaagttcacgggactccgcattatcaggtgcaacattatgttgcacctgataacgagttgataatgaaattgcattaccagcctcgacatgttgtcgaggctgataattggattcgccaggaaccagatatgcggcgagtttatctgttgtcagcagtacgtaaaacggtattccaaagaagtctgcaacattagcaatatctgctggcatccaatcagcctttccgttgagttttctactcaaggaaggctgctttattttcaaggcagcggccaagatctcctgtttgggtttatagaaagccacaagcaatcgaatattgcctcgcgcaatgcgttggaattcttgtgcggcggcggtttgagtggattcaatattgttcatatacgtaattgtatacgaagtgatttgctttatagttgaaaatgcgtatatttatacacatgaagtataaagatgttgtgactgcgtatagaattgatgagcagaggaagcaaaataagctgacgcaggagtatcttgcccattatttgggtgttacccaggcgtcgatttcaagaaagttggcaggtaaggccccgttcacttcaccagaagtgaagtcttgtgcattattgctacacacttcaacggattacctgttaggtcttcaagaatctgcaagtcgggaggtcgtcgcatgagcgaaagagtgttgtggcttcggttgtgcgtgaccggtccgactcccgagtgcggggagattgtcggattgcgcatcgtcgacaggcaggcgcatcgcatggtgttcgacgcgttcttccaccccgtcagggaagacggctggaagagcgtgccggcaggaggggtgaacgtgaacctggcgaaccgtctgccgttgaacatctacgtggatgggatcgaatggatcctatccggtgcgacgctgctgcgcggcgagcatgtggaacgcgacatccgtttcctgcgcgccgccggcgtccgtatcgaggaccaggtcgtggagcgcagcgtcacggccgaacatcataagagacttgcgtcggggattgccgtccccacgcgcaccgggaaccgggcttgccggcccatcccggtgggatgaacaaccatcccttacccgaaacaaacccatccaccacccatctgcagcgaaaagagagaaccaggaatgccaaccctacaagcgcgtgcggcccacggcggccacagcggatcgacgcccctcggcgaccgcggaagcgacgtcgtggacgaacccatacgcgtcgtcacaggtcgcggcggcgagcacgatgccggacgagagccctgcgtcgaacagctcgccgtccgtgacccccgtggacagcatccaacgcagcccatccatgacggcgggatccgtgacattacggaacagaccatcggcgacggccatgcgataggccagccaggccagacgcgcccgccgcgcgagcaccgtttcgtcacgggccagcgcctcgtaccgaatcgcggctcggaccgtcacgatcggggagacatggagacgcaggggtatcgatgcgccctgcaggaacccggatatccggtccaccgtcatgagacggcgacggagaacgggaacgaagcccgcagtgttgtcttccatcatgcccgccgatcgattgtgtttggagacgatatccgttctaccgatacacatgcgtccggcatgatatcggccgcatgggatggtccgtgaaaaagagaatgcccgcacgcgaattgccgttcgcgtgcgggcgatggtcccatcctttacccatttgcactgccccttgccggacgaatccggctcgggcgagggaaccagtaaaagccaaccccaccaatcatcacatcagaaggagccggcaagaccgaccccgaccaatcgtcggaccagaaggagccaatcatgaccaattcttacatcaaccccacccagccgaacaccggcgaaccccgatattcacaggatgcccccgcatggcaggacgtggagatcgtcgacgtgcccgccgtggaggaaccgggaccggccgagggcgctcccgagccgatccgcatcatagacgagccggaccccggggaggccacggcaggcgacgcggtcatcgaatacacgcgcgaccacctacccgtcaacatgggcgtcgacacgaaccaaagcgacttcacccgcgaacaggccgaacagctcgtcggcgacatccaggaacagctctacgagaccgcgaaaagccagaaacgccttcacgacctgatcgcccaggcatacgacggacgcgcctggatcgccctcggataccccgcgggacagatcggctggaaccggatgtgccaggacaagttcaccgccgacgccgtccgcatgaccgtccagcaacgcaccaacctcatcctcagcttccaggacgacccgatcagcaacgtggccctcgccgccgcgctcggagtgagcgataggacggtcggccgcgcgctgaaaaagaacgcgaaatccccgaagggcgcctccgcgaagccgaagccggtcgtgggcacggacggcaaacgccacagcgtgccggagctcacgccggcggaacgcctcgaactcgacgcgaagatccatgacatgaacctgcccgtcgaggagggcggccagggcatgacccagcaggagatcgccgcgaagctcgacatggcgcaatccacgatctgcgcgagcatcaaacgcgagaccatgcggcgcatgagcgagggactcgaacccgcggcccccgcaccggtcgacgagaccggcgcgatcggcgtgctgcccgacaatactgcaatcgacctgggaggcgaccgtctcgccgcggacgacatgaacttcgtggaagcgttccgcaccgccgcgggagacgcgaacgccggactgacccgcctcgtggagctgatgagctccgaacgctggcagccaggcagcgagaccgtcgacgagatcgtcacccgcgccggccgcgacatcaagggcgtgctggccaacgtgggcccgttcatgcgcctcgtcgaccacgacctcgaggacatgtggcccgccgacgagaacgaccgcagccgcgaccaggacgaggtcaacggactgttcgaccagatcctgaccgtcgcgtcggaatgcgcctgacccgttagcagagaaggccggccatgagggccggccggagaggaaccggtatgaacgacaagaaaaccaaggaagtggacgggcgggagagcgtgagcatgctgcccggcgtgacggtgggcgtgatgatcgcggtcatcgcgttcgtgctgagcttcgacgcgttgaggctcgtgttcgtgtccagcggcatcaacccgctcctgtcatggggaggccccctgtgcgtggacggcacgatcctcctgtgcacgtgggcgacatggggattccgcaaaggccacatccgcggacgctggtacccgtgggccggactcgtgctgttcagcctgttcagcgtgacgggcaacgcgttgcacgcatggctcaacgccggcggcatgctccccacgtggggtgcgcccgcaatcatgagcatcccgcccatcgccctgctctactcgacgcatctgatcgtgatcatcgccggcgaccgccaggacaaactcgccaggaccaccggcaaggccgccggccccgatgacgggcacgccggacccgccgcagccacgccggaaacggccggcacggaaccggtccggacggaaaacccgcgggccatccccacgccgacggccggaccggagccgggcaaagccacggaacccgcgcccgccgacccgctggaccgctacctgttcgacccgccggcccaagcggaaaccgacgcgaatcggggaaagaaggaggatccggaggacatcccgttcgaccaggacctctcatggccctccgtgacgtccacgaccacgacgtccgcaaggcccacggagtccacaatccacatggtccgcatggaccaggcccatgcggaccaggcccatgcggaccaggaccttgcggaccaggaccgcatgggccggaaacccgagatggatcccaagggccagccgggcccggaggcagggggtcatgcgggccacgccgaacctgagcccgcggaatcccacgaaggggccatgtccggcccggaccgttcctccgacacgggatcggcccacgatgccggcccaaaagccggtgagccggcgcgcaaggcgacggccggcttcgaccccgacgaatggctcgcatgggccgacaggctgaaggccaacggcgagacggtcacctcgacccgggctgtggccgacggtctcgccccatccaccaccacggccaaacgacgcctgcacacgctgcgccgcgagcatcccggaaggttctgaccatgagggaaagcgatgaaccgttgacggacacattggtccgctgcctcgccgaccccacggacctgaaagccctcgaacggctcgagaacgacggggaccaagccggggccaggctcatgcgcgcccgcctcgccgaccaggccgcactccggctcgacgccgcgctggaggacaaccgggcgcgcgtgcgccggcagctgggccgcgactgggcatgggccacggacgaggtcatgagcgacctgacgatacgcaccatccgccgactcgactactggcaccgcaccaacacggaccgggcagagggaggggcgacgagcctggccgcgttcgtcaaccagctcaccggcaccgtggtcggcgaatggttcaaaacccaacggcccaaacaccgcacgggcatgacccagaccccggaacggcgcgcgggaaggctgaaaccacccacggacccggacgaccggacggcgtgggaacggtggcgccggcacgagcagaccctcgccgactccgacgtgatctgcgacgcatccgacatcttcgagggacgcgacggcgacggcgagagccccggatcgcccgccgcgggcgaccgggaaagctaccggcaatgggacggcgacacggcggacgccccattgccggtcagcgccggtgttttgcttcaatgtttgttcgacaggttcggcagtgtttttccgtagtgtgggctgatggttttccccggtgtcgtcatcgtttcccggtgatgtgataggcatcggtgccgccgcctgtatattaagagaagatttgcggcggccatggcccaggtgagacgcccggtcccattccgaacccggaagctaaggcctggcacggcgatggtactgcacccgacagggtgtgggagagtagcacgccgccgcaccacacgtacaggaagcccctcggagcacacgccccaaggggctttcgcatacccgaaaccaacaagacaagacaccgacaagacataggctctcgcacctagggtgtggccgaatcgaaagcatatagaagagggaaccctccaatgacggagagttccctctttgcgtatctggaccgataaaggtctagaaattgaaattgtccggatcagcaccgttgcgcttgccggtgttgatggcggagatggcggtcatatcatcgaccgataggttgaagtcgaagacctcgaagttctgcttgatgcgctcggcatgagtggacttgggaagcacgacgatgccgcgctggatgtgccaacgaatcactacctgtgcagcagacttgccgtacttggcaccgattccggccagtactgggttgctgagtaggttaccgccggtgccgccgagcggactccaagcttcagtgtgaatgcccttggcacgcagctggtcaataagctcttgattggtgaattgtggggaagactcaacttggtctacagcaggcaccacatcgctatgggtcagtagctcatcgatatgatgcttttggaagttgctgacgccaatggccttggcgcggccagaggcataaatctcctgcaagtcgtcccatgcctgctgccagccgtctgctggccagtgaatcagatacagatccacataatccacgcccaagcggtcgaggctttcttggaatgcatccttgccgcagcgtgcgcgaatatcgtcattccacagcttggtggtcaagaagaaatcgctgcgcggcacaccagcacggcgaataccttcacccactgaagcctcgttgtggtaaatcattgcggtatcgatatggcggtagccattctccagagccgtctgcaccgcgttcactgtagtatcaccatccggtgtctggaatacgcccaagcccacctgcgggatgacagtgccgttgttcagcatgattgtcgattgaattgccataatgcctcactagtcgtagtattcgttcaatttcccattctagaaacaagacgatgcaataagccgcgttttgctggcaaagaatgattcttttttcagcgctacgatgaacgatatgactacggaatatgtggctgcatttgatgcggggaccacggcgttgaagggtgccttagttaatgggcagggttgcattgtagctagtgcgagtagcgaacttgaccttattatcaacggcgactatcgggagcagagccccgatcaatggtggcaagctttctgctcggcctccaggcacatgattgagcaggcgcggcaatccgagtcagaattcaatgtgactcgcattcgtggcatcattttcagcggtcagatgcaggatgttattgttttgaacggcgagctcaatcccgtccgcaatgccattctgtattcggatggccgagccgaggaacaggccaagcaactcgccgagacatatcagggcggtgcagaacgtttcctgaacaccgttggtaaccggctcgaaggctgcttgccgttgcccaagttgatgtggctgcgtgaacacgagccggaaacgtacgcgcgcattcgtcatgtattgatcagttccaaggactacttgatcgcccaattaactggcgaatgcgtgggcgatgtggcggcgtgttccacagctggggccatgaatatccgtaatggccagtgggatgccgaattatgcgaggtcgcagaaatcgacatgaccatattgccacacctgcacaatccgcaagacaacattggcacagtgacggaatccgctgcacaacgcaccggtttttccgccggaactgcggtatacgcgggcattggagacgcgggtgccaccacacttgccagcggtgtcagccaccctggtcaatacaacatcaatatcggcacctcaggctggatcgccaccgtttcgcccgagccgttcaccgacaagccaggtgctgcgaatctggcatttggcgtggaagaaggcttcgtgaatgccgtgccattcctcaacgccggcgacgtgcataaatgggttaccggcgtattctccgatggcgattacgcagaggcgcatcagcttatcgaaacatccaaacccggctccaacggtgtgctatgcctgccatatctggtgggggagcggttccctgttatgaatccgaatattcgcggtgcctatgtgggcctcgatccagacaccgccaaggcagacatgatgcgtgccgcgcttgagggtgtggccttctccattcgtcaaggtatggaaagttttgacgccaaacccaccgagatttccctgattggcggcggagccagagaaaatgcgtggtgccagattctggccgatgagttggagcatcctattgaagtgttcgccaatgccgatattctgccagcagtggcaatggcctcgttggtattcaatgtaccagacctgctgcaatcagtatgcgaatgcactgtataccagccgaatcctgacaccgcacgcacatatgccgacgcataccggcgattcctgagcctctacccaatgctgcgaacgatggattaggaactgagcatcatgaggcaatcggcgaatttggtccgcaaacatatagtggtcaacggactggtgcaaggcgtgggattccgttattttacggtgactcaggcacgtcggcttggtgtacggggttgggtgcgtaattgtcgcgatggctcggttgagctggaagcacaaggcagcagcgacgcagtgcaagccttggttgagcaattagccattggcccgcgatggtccgaagtgagtcacgtcgccgtgcatgacatgccgattatcgatgagaccgctcgggcatttggcgtgcgtcaataacctgtatcacgaacccacatcacgcacgataatctcacgatacgggtgaacatgggcgttcctcgccgcttaggcctcgcacattgctacgatggggcgttatgagtgagaacatcatgcgaatcattgacctgcgtggtcagaacctgtcccgtgccgaactgcttgccgcgatgccgcgtgctgcaatgggtacttccgaagccaccgatttggtgcgtccgattctggacgatgtcaaagaacgcggcgccgctgccctgcgcgacttcgaggagaagttcgatcacgtgcgtcccaagaacctgcgcgtgccggtcgaggcgatcaaggacgccctgaccacgctcgaccccgaagtgcgcgccgccatcgaggaatcggtgcgccgcgcccgcgccgtggccgccaaccaggtgccgaaggacttctacaccgacctcgccgaaggcgcccgcgtggccgaacgctggattccgattcagcgcgtcggcctgtatgtgcccggcggcaaggccgtctacccgagctccgtcatcatgaacgctgtgccggcccaggccgccggcgtcgaatcgctggccatcgccaccccgcccgcccgcgacaatgaggaaggcctgccgaacaagaccatcctcgccacctgcgccatcctcggtgttgacgaggtatacgcggtcggcggcgctcaggccattgccatgttcgcatacggcgccaagggcagcgagccgcaggacggcgacatcctgtgcgatccggttgacaagatcaccggcccgggcaacatcttcgttgccaccgccaagtcgctggtctccgcattcgtgggcattgacgcggttgccggccccaccgaaatcggcatcatcgccgacgaaaccgccaacccgagcctgctggccgccgacctcatcggccaggccgagcacgatgagctcgccggttccgtgctgttcaccgactccaccgagattgccgacaaggtgcaggagagcctcaagtaccgcgtgccgcgtaccgagcacgccgagcgtgtccacacgtcgctgtccggcacccagtctgccatcgtgctgaccgacggtctcgaccagtccatcgacgcggccaacgcctacgccgccgaacaccttgagattcagaccaaggatgccgatgcggtcgtcaagcgcatcaagaacgccggtgccatcttccgcggtccgtactccccggtgccgctgggcgactacatgtccggctccaaccacgtgctgcccaccggcggcaccgcccgcttcgccgcaggcctcggcgtgcacaccttcatgaagccggtcgaagtcatcgaatacgacgaggaaggcctcaaggccctcgccgcccgcatcaacgccttcgcggtatccgaggacctgcccgcccacggcgagtgcgtgctctcccgcttcgtcaaggatccgtatgacaaggccaccctgcgcgagcaggagaaggaagccggtctgcgatgagctcgattcctgcaaacctgccgctgcgcaacgacctgatcggtgaggagccgtacggcgctccccagctggacgtgccggtgtgcctgaacgtcaacgagaacccgtatgcgccggacccggccgtatgcgacaccatcgccaagcgtgtgcgtgaaatcgcccccacactcaaccgatacccggaccgtgagcacatcgaattgcgtcaggcattctccgattacctggcccgcgaatccggtacccgtctggacgtggacgagctgtggggtgccaacggctccaacgagatcatgctccagctgttccaggctttcggtggcccgggccgcaccgcactcggtgccgacccgacgtactccatgtacccggagtacgcccgcgacaccttcaccggttggaagctcgcccaccgcaacgccgacttcacgctgaacgtcgacaaggtgcttgaggccatcgccgaggtcaagccctcgatggtgctgctcactagcccaaacaacccgaccggcaccccgttgccgatggaggatatcgaacgtattctcgccgcctgcgaaaccgctgaagtggtcggcgcgggcgagggcgtgcatccgattctcgtcatcgacgaagcgtacgtggaattccgcaagcccggcaccccgagcgccgtgagcctgatcaaggaccacccgaacttggccgtcagccgcaccatgagcaaggccttcgccttcgccggtgcgcgagtcggctacctggccgcgtccaagggcatcatcgactgcgtgcgtatcgtacgtatgccgtaccacctgtccgccgtgactcaggccgccgcactggccgccttcgaacacaccgacgagcagctgagccgtgtcgagcacctgcgcgaaacccgcgaggccaccgccgcatggctcaaggaacagacctacaaggaccagccgcttgaagtggccgaatccggctcgaacttcctgctgttcggcgggcacttcgacaagcgtgaagccatcttcgacgagctcctgaagcgcgacgtactcatccgcgtggtcggaccggacggttggctgcgcgtgtgcatgggcaccgacgaggagatggaaaccttccgtaacgcccttgttgaagtgcttcgtatagtggaagcagcataagggacgtttctttccgattgcggcgagacccgaagcgattcgagtcccgccgcaatccaatatgacgaatcacacaggagacatgatggcaagaaccgcgcacatcgtccgcgaaaccaccgaatcacacatcgacctcgaactgaacctcgacggcacaggcaaaaccgatatcgatacatccgtgccgttctacaaccatatgatgaccgcgctcggcaagcattcgctgatcgacctgaccatccacgcccacggcgacaccgacatcgacgtgcaccacactgtggaagatacggccatcgtgttcggcgaagctctgaagcaggctctcggcgacaagaaaggcatccgccgctttgccgacgccaccgtgccgctcgacgaggcgctggccaaggccgtggtcgacatttccggccgcccgtactgcgtgtgcagcggcgagcccgaaggctacgaattctgcatgatcggcggccattttaccggctcgctggtccgccacgtcatggaatccatcgccttccacgccggcatctgtctgcacatgcaggtgctcgccggccgcgacccgcaccacatcgctgaagccgaattcaaggcgctggcccgtgcgctgcgcttcgccgtggaaatcgacccgcgtgtagacggcgtgcccagcaccaagggagccctgtgatgaccgacgacaagttcgatccggacgaatcgcacttctccgacgaggagcttgaggctgcgctcgccggattcgagaaagaactcgcggacgattcggtatccggcgatgccagtgataccagtgatgccgataaaacagcggacgctgcttcagcgaagtccgattccgacgcgaatgatgatacggctgataaggcttccgctgattccggccggcctatgaccgacgacgtcaccgggtccgttgcggatgcggtgaacgaggccatggccgatgtggtcgacccctcgctcggcttcgacaacgaactcgctggactgttgggtaacaaggcgaaggtggcgctgatcgttacccgtcttgcctccgccgaactgttggccgcgttctgccagctgtcggacatctccgccgcatgcatcggtgccaatcagggggccgtcgcggtgctgaagaatctggacggcgacggcccggaagccgcagccaaggacctgaccaccgtggtatccggcatggccgtgattcttgcagtcaatcgtgccgacaagctcgaagtggccatgtacgtgcagggagaggccggccagagtttcgcgccgcccgtgctgttcacctccacaccgcgcttcgtcgaggacctgatgctcggcatcgtaaccctgaaccaactcaagacccaagggttcgaagtggtggattccgctggactcgaccatgatcaggcgatgcagattctcgccaaccacactaggcgcggacgtggcgggcgcggctcccgcatcgaatagacgccaaccaaaccagtaggggataggagagcagatgaccacagcggttgttttcgattacggtttcggcaatgtacgttccatggtgcgtgcgctcgccaatcttggcgtcgacaccaccctcacctccgactaccggcagtcgttggaggccgacggcctagtcgtgccgggcgtgggtgcgttcgccgcatgtatggaaggactgaagaaggtcgacggcgaccgtgtgatctatgatcgcatccgcgctggccgcccggtgctcggcgtgtgcgtgggcgagcagatcatgttcgaacacggtctggagcacggtgcccatgccgcaggcatcggactgatcggcggttcggtgaacctgctggacgccgacgtggtgcctcacatgggatgggacacgatcgaggccgcccccgattcggtgctgctcaacggcgtggagaacgaacggttctacttcgtgcactcctacgccgcgatggaagtgaagccggcggatacgtcccgcttcgacatcgatctgagcgattcgcccgaacgcgtgagctggtgctcgtacggccgatcgcgctttgtggccgcctacgaacacggcccgctgtccgccacgcaattccacccggaaaagtccggggacgctggctcccagctcctcaagaactggatcgccacgctgtaaaaaagcatgaagctccctctgacgagggagctcaaattgtgtataagtaactgaagaaaggctcttcttatgtcgttgactctgctgcccgccgtcgatgtacgcgatggcaaggccgtgcgcctgcgccaaggcgaatccggttccgaaaccgattacggttcgccgttcgaggccgcccgtacttgggttgaggccggtgccgaatggattcacctggtcgaccttgatgccgctttcggtacgggcaacaatcgcgatcagctgcgagaaatcgttcatgagctcggcgaccgcgtgaacatcgaactgtccggcggcgtgcgcgatgacgcttcgttggacgcggcccttgaggccggtgccgcccgagtgaacatcggcaccgccgctttggagaatccggattggaccgcctcggtcatcaagaagtacggcgaccgcgtggctgttggtctggatgtgcgcggtcacacactggcggcgcgcggctggacgcgcgaaggcggcgacctgtttgagaccatgaagttccttgactccgtgggctgctcgcgttacgtggtaaccgacgtggctaaggacggcatgatgtccggcccgaacattcaattgctgagtgaagtcgctgaacgcaccgacgccaaggtcacggcttccggtggtatctccaagctggacgatttgcgcgccatcaaggaactggctgaaattggtgttgattctgccatcctcggcaagtccctctatgcacgtgcgttcacgctccaggaagcgcttgaagtagcgaagtaggcaaaggactcgccttagcgagactgttaatctaccttcgctcagctatcgcttcactcagacccctcctacggacagcccattgggctgtccgcttaacggctcagcaagggaggtcgccggatttgaggagctttttgaagacggcgtagtcttcatcattctgttcggcgtagctgacggcgaatgaggcgatggcctgatcgaattcgtcggtgccacccatgtaattggcgatcgcaatcgaatcgccggtgcgggcgtgggcgtgcgccaacgaccatgcgcacatgcgtgacagatcgctcaatcccgaagcgttgagattgtcgatatcaatcgaccccttgccattccacaactggcgcacgtaatagtcgcgcggtcggccatcctcggccataaagctcgaccaacccaacagcacatcggccgtattctgaatcagcttctgcccctgaaccacgcgctcaccgtgcgtggcgtacggcgacgcgccgcagtaatgctcgagcacggaatacgtggcctccttcatctgaatcatcatcggatcgtcgatatcacgcgcgatccacaccgacgtccacgcgcgctggcccaccgagcccacgcccaccaccttgcgggccgcatcctgatagcgcaaatgatcgaacacccaacggcgatcgtcgtacagggaatgccggtagctctcgaacagcgtgtctatacgtgcctgcaacgcatccaagtcggcgtaatcatccagctgattgatcggcaccagctcgggcggattggatttgaacctgagcttgccgctctcataacggcacagtttggccgccgccgcgtcgttatccttcagcagcgccttcatggccgcctcacgcagcacacggctgcgtttggaaccggtggtctcgaagcggtcgagcgtctcctccacgtccaggtgctcataccacgcgtcaaggtaatccatttcggagaaccacttcatgcgtgtgcggtacgtgtgtacgcactggaccacggcggcgcgacggtccttctccttgattttgttggcgcgtccgcagatctccaccgaggcggcgagacgtttcagatcccattcccacgggccgatagcggtttcgtcgaaatcattgatatcgaacaccagacgggcggaaggggagcggaaaatgccgaaattgccgatatgcgcgtcgcccacgcactgcaccggaatgccagtgaccggcgtggaggccaggtcattggtcatgatgagcacggtgccccggtagaaggtgaaggggctggcgctcatacgcttgtaacgcagcggaatcagatccggtacgcgaatcgcggactgctcctccaaaaggctgatcgcctcacgccggccctccttgaccttccagatggcatgtgcgtccagcggcgccttggtacgagtggcgatgccggcgcgcgaacggtcgcgcgggtcggtggcctgcgtccagctggtcacgtcgacgggcggattggcggatggggtgagatgatcttcgctcatagtcactaccatagtgccgtgccggcatgggcctgaaccatgcctgacatgcggaccggggcatgttgatgaaatctcgcgactcgcaggtgacgaacagtgagatgttaacgcccttcgtaacacggttatggaacgataggcgactatggataaacagcaggagtttgcgctgcgcacggtcgaagaacgcgacgtgcgctttattcgtctgtggttcacggacgtgttgggaacactgaagtccgtggcgattgctccggccgaactggaagccgcgtttgaggagggtctcggcttcgacggttccgccatcgagggcatgacccgcgtgtccgaagacgatatgatcgttcaacccgatccctcgacgttccagatcctgccgtggcgcggtggcccgcaaggtaccgcccgcatgttctgcgacattctgaccccggacggcgagccttcgctcggcgatccacgtcacgtgttgaagcgcacgctcgccaaagccaaggacaagggcttcacgttctacgtgcatccggaaatcgagttctacctgttcgaaagccaggacgactggtccaaggccccgaccccgatcgacgagggcggctacttcgaccacgtgccgcgcagcccaggcatggacttccgccgtgccaccgtgaacatgctcgagcaaatgggcatctcggtggaatactcgcaccatgaggcggggccaggccagaacgagatcgatctgcgatacgcggacgcgctcaccatggccgacaacatcatgacattccgtacggtggtcaaggagatttccttggagcgtggcattcacgccagcttcatgcccaagcccctggccgacgcgcccggttccggcatgcacacgcacctgagcctgttcgaaggcgattccaacgccttctacgaggccggtcaggagttcaacatgtccctgaccgcccgccagttcgccgccggcatcctgtaccatgcggccgaaatctgcgcggtcaccgaccagtacgtcaactcgtacaagcgcctgtggggcggtaacgaggcaccaagctacatctgctggggccacaacaaccgttccgcgctgctgcgtatcccgcagtacaagccgggcaagggcaactccgcgcgcatggagttccgtgcgctcgacccggtggccaacccataccttgcctactcggtgctgctggccgccggtctcgacggtatcgataagcagatgcagttgggcgagcctaccagtgatgacgtgtgggagctcaccgacggcgaacgtcaggctatgggcattcagccgctgccgcgctcgctggacgaggcgctgaagatcatggagaaatccgacttcgtggccgacgtgctcggcgaacacgccttcggctacttcctggacaacaagcaccaggaatgggaggagtacaaccagcaggtcacgccttacgagctgaagaagtatctgccgaagctgtaatcgcaagcgttgcacatgtgccaaaccccgtcgatgattggtcatcggcggggttttctatggcgtgtcgtggtggtgggtagtgggcagaggtgggaataacgttgtcgctgagttgatacgaaaaaacgattgacataaccgacgaatcagcttgtagtacgagcgagagcactcaagagagcacccatgacgaacgcacctgcgaacaccgcgcgtaccggccggcacttgggtggccgatacctttggttggcgtgtcacctttgccttggtctcggtgctcaccgccgtgctgatggcatcgatggcagtgtctctgccacgcaactcgcatccggcgaagatcggtttcctgaggcaattccgcctgttcttcgaccgccgcatccagctcggcgtggcggatgtggtcttcggcgcagccgcctcctatgtcttctacacgtatctttcgccgatcatgcgcgacgaaatcggcgtgcccgaacgctatatcagcatcggcttggtgatttacggctgcgcctgcctgtggagcaacctgtacggcggcaagctggccgacaaaggtcatggcgtggaaccattgacccacattcgaccgatctactgcgtgcaggccgtctgcctgtgtctgctggctttcgcctcgctgctggcggttggcgccacgaccctgctgcgtccatacgtcgaacgctgacagtgttggccgagtccaatcggacaagaccggtcagctgccgttatcagcttcgcggcgaaccgaaccagctggtgtagataagcgcgaagttgcggttgccataactggagcaggaatcgccggtaccgttgccagcggccagtgcggcgatgttcggctggtagggcgtatagatgtagagcagggcggtcgccttgttctcgatatacacttgtgcgccgccgcatgccgcgttcggatgatattggatgtagttgagattgtgcgccgtatacccgtactgttcctcgtgctcgagatagtaacggtaccgcttggccgcgccatacacctgccgaaagaatccggcataggcgggatcgcagtcggcggtatccggacagttcaaccccatcgccgccataagctgatagtcgctgggatcgacggcagtgaccagatgctgctccttctgcatcacggtgagcagcactttctggctcaccttgcaggcgcgggccgactggtcgatgattgtcgccgccgactcgcctttggtgcctgtatagtccgcgcacaggccttcgcctgactcgttcgatgtgtcgaaggtcatcgcggccagcgagccaccttgtgtgtccaaaaacgattggacttcggcctgactcatcgccgaaccgttgaagaactgaccatccgaaataatattgcccggattgaaatcgtatgttcgcgtcagttccagctgtgccgcctcggctgcgcgaacctgtgcccgccagtttgtgaaacgaaccagcccggccaccagcgctacgacaacgaccaccgccaccgtgggaatcagcaccatcttgatacgggtcggccagttcgccttacgccaggaacgcttcagagcattgatcggaccgtgcctacgattgcgtttcctgttccgattgccgaggcgtccgcgcacttgcccacgctgtgatgacggcttgcgcgtgcgctggcgcgtggcctggcgacttgtttgccgtccggtcacgccagcgctttcttgatacggttgagcgaagccggccccttggtgccaagctcctgcgcccatagggacacgtagaactcttcaagcatccaacgggcctgttcggcctgcttcatcaatgcctcatgcttcgggccggccggctccgccttggcacgggccaacgccttatcgaccacctgacgggcctcgtcggcctgccaagcccacttgacatcacggttcttatcggttttcgccttattgagtcggctcagatcggctctcaaatatcggctcaacgacttcagcgcatccgggggagtgcgcccgatgaatccggggtagacgagcgtggcgatatggtcgcgaatcgactgcaacaccgaaagcatcggcagatcagccttgccgccagtggccttgtcgacctcggcataagccttgagcacggcgatcacgtcatgcgccacctgatagacggtgtcctcgtacacttcgcgcacatcgagcaccgcattggctaacgcctcatcgtccgagagcctgtcgacattcggcatcagccgtttgaccgtggccagctgcaggtcttcgaccagatccttggtggacttgtacggagcagaagccagcatcaacgcctcggtacccagccagcgcgacgaaatgcgttcggccggcaaccgcagcgcatccaatgcgccacgccagagcatcgtggcccgggactcggtggtggcacccgccttatgtaacaggttcgcctgactgaccagcttgccctgttctccagcctgatcggcctgcttcttgaccatttgacgggccgacgcctccgcctgcgcggcgaacttgcgttgcagcgccttcagatccttggacacacccagcaccttgatggggccgcgcgcatgccggcgtccacgagggtgcttgccggccggcagttgctgctccaccgagaacgtgaccctgagatacggggaaagacgctcgaccagttccggccccaacacttcgggatgaatctgcgcacccttggtggcgatggccgccttggtgaacacatgtgccagatcgggccagccaacggtcgtgccatcctcatccaccggcggcagattcggcttctgctgcgagcccgagcccggcagatccgggtaatgctcgtcgatccagtcacgaatcgcacgcgcggcatccggggccggcacgaactggacgcgcagctgcttgggcagcgccttgatcatcgacaggatcagctcatccaacagacccggcacattccatgtgaactggtcgggcgtgatacgcgagagcgccttcaacggcacatgcacggtgacgccgtcggccgggtcggccggatcgtacacgtagctcagacgcaggtcgatgggttggccgtccgatccggtcgtatgccaatggtcggggtaatcgtccaggctcaccgaatcgctggatgccagacgctccaccttggccgggtcgaaatcaagcagattcggctggcggtcatgctcggacttccaccatttcgccagatcggccacgctggtcacatcgttgggaatgaccgcgttgtagaagtcgaacagatcctcgtcggacacggtatccgccagctggcgggtgcggctcgcatcatcggcggcatcctcgagaatgtcgcggtttttgcccacgaagtcgtcgtaactgaaacgctgctgaatatcgccctcgaccagaccctggcgaatcaggaagtcgcgcgcctcaagtggattgatgcgtccccactgcacggcacggtcctgtacgatcggcagaccatacagcagcacgcgcgcggtggccacagccgagccacgcgaacccgaccagtgcggctccgcatacgtggtgcgggtcaattggccggccaacggttcggcccacgcggggtcgatggccgccgaatagcgggcccacaggcgagaggtttccaccagttcggtgctcatcacccatgacggggtcttcttggccacggcggaagcggggaacagggcgaaacgggtgccgcgtgcgccctgataatcgttcttcgactgcttctgggcgcgtttcatcgcacgggcgcgcgccgaaccggtcagccccgcgaaatcggaggccttgggctcgcgcaccacctgcatgcccatcatcgacagcaatccggcgagcatcgacttgtggatgccatccgcatcccacgcgcagcacagcgaatgcgcggcctgctgattcaacggcagctggcggatttccaagcctgggcgggaggtgggcagcgggtcgccgaccttgaacttcagctccttgcacatctggcgtagctgggagacgagatctttccactggcgcatcctcagccagctgaaatactcggttttgcagatacggcgcagcgcgttgttgctcggatcgccgtctgcttggaacacgcggtcccagatattcagggccgtcaggaagtcggaggtctcatccgcataccggttgtggatgcggtcggcatcctcacgcttgtcgtccgggcgttcacgtgggtcctgcaagctcaggaacgccacgaccacgagcacctgggccagaagattcggcgaaccggttttcgcggcctcgataaccatacgtcccagacgcacgtcgatggggatgcgcgccagctgacgaccggtatgggtgagcgtcacctcgccgcgcttgcggccgatggccttgagctcggtgagctcattgaaaccgtccgacacggccttcatatccggcggatcgatgaacccgaagttcgtgacgtcctcggccgtgcgggccacgcccaccgacagcatgtggagtaccacggcacccagcgaggtacgcaggatttccggctcggtgaagcgcggacgggtctcgtaatcctcacgcgaatacaggcggatcgcgatgccgtcggccacacggccgcatcggccggacctctggtcggcactggcctggctgatcggctcgatcggcagacgctgaacctttgcggtcttcgaataccgggagatacgggcggaaccggggtccaccacataccggataccgggcacggtcagcgaggtctcagccacattggtggcaatgacgatgcgctggtgaaggtgcgattcaaacaccttatgctggtcggcggcggacagtcgcgcgaacagcggcatgatctcgatggcatccggccggcgcatgtcgtcggcgcgcgggccgtaatgatgccgcagtgcggcctcgaactcgtggatgtcgcgctcgccggaggcgaagaccagaatatcgcggggaccgcgctcgtgggaggagtgaatcaccagctcggcgcaggctcgagccacggcggtaggcatatcggtgatgccgtcatcggcataggaggcaccggaccggccgcggggccggtcggaatcggattccgcgatggcgctggccagctcgtcgtaatcggcgtcgccggggcgggcgcccaccgcgaatcccggcacttcgcgcatcaacgcgggcgcggtgccaagcggctcgtagaccacctgcacggggaaggtgcggccggaaacctcgattaccggcaccttctcatgcaaggcgtgctcgaaatgctcctggaacttgaccgaatcgatggtcgcggaggtaatgatgagcttcagatcgcggcgctgaggcagcagtgccgtcagatagccgagcagaaagtcgatgttaagactgcgctcatgcgcctcgtcgatgatgatcgtatcgtatcgggtgagtttcggatcgcgctggatctgggcgagcagaataccgtcggtcacgaccctcaatcgtgtgccgggcgagctttcgtcggtgaaacgcacctgatagccgacctcgtcaccgagcttcacgcccatctccgaggcgatacgttcggccaccgtgcgtgcggcgatacggcgaggctgggtgtgcacgatctgcttgccgtgcgtgccacggccaagctcaagcaggattttcggcagctgtgtggttttgcccgaaccggtctggccggacacaataacgacttgggaacgtttgaccgcgctggctatctcatcacgcgcggcagatacgggaagttctgcgggatactcatatttcatgacgaacttcaatgatacggaagcccttggagctcgcgtatttgctcgcagtgaacccctcgccgagcgcatcgtccagccaggggatcagcgaatcggaaccgagattcttctgcactacgagataggcggcaccgcccaccttgagcttcggcagccaagccataagcaatgtatgcagcgcttccttgccgactcggatcggtgggttcgaccaaatcacatcaaacgtgaggtcgctcggcaccgtctcgcagaacgccggctggttctcggcaggcaggggagtgctggactcgtccacctgagccgtatgaatgttcgtgtggccgttcgcctgtgcgttggcatgggtcaggtccaccgcgcgctcgttgacatccaccgcccacacgttcgcttcgggcgactcaaacgccaatgtcagggcgatagggccccagccgcagcccaaatccagaaaatcgccggtaagcggcggctcgggcgcatgcttcagcaataccgacgtaccgaggtccacgcgcgagccggagaacacgccgttcgacacctgagcggtcgcctcatggccgcgcaacgttacgttcaatgtgcggcgcacatccttcgatgcgggttccgcagagaaatactgttctgccatggtcgctccatttctgcgggattcgccgctctcgtatgccgacctgtatcagccggcctatgccggtacgtgccgatctatgccagcatgtcacctcatgtgatgataataaaggaccatagaagaatcgtgaaccattccaaccaaacgaggcgcacttgaccgacaacacccagtacaccgacatcaaccgcggcaacaacgacgttacccctgaaggtgtgctggccgagcagtccgaagtgttgctcgacgacagccagcgcgcgaccggctggcatgaggacgccaaccaggaatgggaggagcgcgaggcccgcaacgagctcaagcatgtcgccggtctcggcgagctgcaggacgtcaccgaagtcgaataccgcaaggtgcgtctggaacgtgtggtgctcgtcggcgtctggtcgtccgccgtcaccacgcaagccaaggccgaggaatcattgagagagttggcggcgctcgccgaaaccgccggtgcggtggtatgcgatggtttgctgcagcatcgctccaagccggatgcagccacgtacgttggttccggcaaagccaaggagattgccggcatcgtggcgcgtgaggaagccgatacgattatcgtggacgacgacctgccgccgtcacagcgccgtgcattggaggacgccgccaaagtcaaggtggtggatcgcaccgcggtgattctggacatcttcgcccagcacgccacctcgcgtgaaggtaaggcgcaggtggagttggcgcagctcgaatacatgctgccccgactgcgtggttggggtggttcgctgtcccgtcaggccggcggtcgcgcggccggcgcggatgcgggcatcggatcgcgaggcccgggcgagaccaaaatcgaaatggaccgtcgtgtaattcgcacgcgtatcgccagactgcgccgtcagattcgtgagatggccccggcacgtgaggtcaagcgcggttcacgccgtcgcttcggcctgcccacagtggccgtggtcggctacacgaacgccggcaaatcctcgttgaccaaccgtctgaccggttcggccgaactggtggaaaacgcgctgttcgccacattggacacggccgtgcgccgcgccaaaacccgcgacggacgcgcttacgcttacgtggacacggtcggcttcgtgcgccgcctgcccacccagctggtcgaggcgttcaaatccaccctggaagaggtggccgaggccgacgtgatcctgcatgtggtcgatggctcccaccctgacccgttctctcaggtcgacgcggtcaatgacgtgttggcggacatcgaaggcacggcctcgattccgcgtattctcgtattcaacaaggccgatcaggcggacgaggcgactcgtgaacgactcgccgcgctgcagccagacgcgttcatcgtctccgcctataccggtgagggattggacgagctgcgtaccgcggtcgaaagtctgctgccggtcccgcatgtgcatgtcaacgctctgctgccgtataccgctggctccctgatctctcgtgtacgcgaatacggcaaggtagacaaggtggagtaccgcgatgatggcatacagcttgaagcggacgttgacgcccatcttgccgctcaggtggtcgaacagtccattgactaacgtgataaacatcacagtatattcgtgagcgctaacaaccgttgaaaacattaccatacggttatcaaacagggtggtgtgctggtagcaaaacgtcttagcgggtttatagagtgaagacgttagttacaaggcctgccattcatcagcagaccgcctttgaagagaggttcatccatcatggcggaaactaccgttaagcccacgaagcttgctgttattggtgccggtgccgttggctccaccctcgccttcgccgctgcccagcgtggcatcgctcgcgagatcgtgcttgaagacatcgccaaggagcgcgtggaagccgaagtgctcgacatgcagcatggctccagcttctacccgaccgtgtccatcgacggttccgacgatcctgagatctgccgcgacgccgacatggtcgtcatcaccgctggtccgcgtcagaagccgggtcagtctcgtcttgagctcgttggcgctaccgtcaacatcctcaaggccatcatgccgaacctggtcaaggtggctccgaacgccatctacatgctcatcaccaacccggtcgacatcgctacccacgtggctcagaagctcaccggtctgcccgagaaccagatcttcggttccggcaccaacctggactccgctcgtctgcgcttcctgattgcccagcagaccggcgtcaacgtcaagaacgtgcacgcttacatcgccggtgagcacggcgactccgaagtcccgctgtgggagtccgccaccatcggtggcgtccccatgtgcgactggaccccgctgcccggccacgatccgctcgacgccgacaagcgcgaggagatccaccaggaagtcaagaacgccgcttacaagatcatcaacggtaagggtgccaccaactacgccatcggcatgtccggcgtcgacatcatcgaagccgtcctgcacgacaccaaccgcatcctgcccgtgagctccatgctcaaggacttccacggcatctccgacatctgcatgtccgtgccgaccctcctcaaccgtcagggcgtcaacaacaccatcaacaccccggtctccgacaaggagctcgccgctctgaagcgctctgccgagacgctgaaggaaaccgccgcccagttcggcttctgataaaaaatcgctgtacggagcgcctttcgcaccgcacaagactcgacctacctttgtaggccttcaacttgtgcggcacgaaaatcgcacacatacagcgattttttataccctgccgaatgctcccattgggagcattttttattcgtggagttcgttggaggagggggagctatagccctcgggctcgagctggaaggtggtgtgggggaccgagaccgggaagtgctcgcgcaggcaatcctgcagttgggtgaggattgtggcggcatcttccatggtgaggtctttgtcaactaccacgtgggccatcagaatcggcatgccggtggacaccgtgctggcgtggaggtcatgcacggcaagcacatgcggcacgtcttccagatgttcgcgtaccttatcgaggtcaagtccatccggtgtttcctccagcagcaccttgaccgcgttgtgcagcaacttgatggcgcgcggaatcatcatcagtgcgatgacggcaccggccacggcgtcgaagccattccatccggtggagatcattaccagggcagaggccaccacggccaccgagccaagtgcgtcattcatcacctcgaggaacgcggccttcatattcatgttgtcttcgcgctgcgaggcaaggatgaaaatcgagatgatatttgcggcaagacccagaatgcccacgaacagcagcaagccgatatcgtcgatttccgctttggaaccgccgaacagacgcatgccggcctccatcaacgcatagatgccaacgacgagcagcaccacggcacctgcggcagcggtgagcacctcaagcctggcccagccccaagtacgagtgttgctgggcttgcggcgcatcagtatggcggtgattgtggatgccgccagcacggacatgtcggtgagcatatgaccggcatccaccagcagggccaatgagccggttaagacagccgacaccatttcgatgaggaagaccgaaccggttacggtcaacgtggcaatcagcctacgctggtgcgcggcagggtttatggatgtggatggtgcgggtgcatgggtatgagccatatgtactccttcgctctatcgagttgaaaccgcttctcaataccatttgcgatatggtctgaatacgacgaaaccccggcgcgaggccggggttccgtaagctgtgcgtgactatagcacgaccggcgcgattcggtgcacgctgatcagctggtggcgaacaggctacaatttgcgcagcacggtgaccaccttgcccataatcgtggcatgtgtgccgtcgatgggcgagtatgcggggttgtgcggcatcagccagacatggccgttttccttgcggaaggtcttcaccgtggcctcgtcatccagcagagcggcgacgatatctccgttgacggcggaattctgttcgcgcaccaccacatagtcgccatcgcagatagcggcatccaccatggaatcgccgtggacttccagcatgaacagggtgccggagccggtcagccgttccggcagacgcatgacgtcgtccacatgctgttcggcggtaattggcacgccggcggcaatacggccaacgagcggcacatcgtgtgattcggcaatggcttcggcggggaattggtatatctccgccacattactggtgctggttgcctcttcgctggcttgggagggcttttcggcattcggggcggatcctgccaccacctcgatggctcgacccttgttcgcgttcatgcggatgaagcccttgtcttccaaaacttgtagctgatgcttgaccgaagacggacttttgagcccggcggcatttccgatttcccggaaagagggagcgaagccttgttcgtcgatatgcgtgcgaatggcgtccaacactttgcgctggcggtcggtcagggtggactcgtccggcttctgcttgggggagaagggaatggtgctcacgtcagggctcctttcgttatgtcaccagcataacgtgttgttcgtgtgaaatcaaacatctgttcgagtttcgacttgaccgtgtcgaacgtttgtgccattataagaacagttgttcgatagaacatctgttcgagagaggtggtcgtgatgactggttcaatggtgatggccccggcccgtagcgcacgtgtagctatgcagcatgctggaacgtcccgccggaatgcgcgtgggaagattatcgcagtgatggtcgccttggcgctggcctggtgtggtttcggcgcgcttaccgttcagcgggcccaatcggatacgggggccacgcaggtgaccggttatatcgtgcggccgggggatacgctctggtcatatgcttcggctatcacgcctgctggtcatgatgtatcggaaacggtggatgagctgattgcgttgaacaatcttgagtccggatcattgcaggccgggcagcgcattattgttccggttgagtaaatgaaacccgagcggcatggtttttccgcccgtacacgttattctggggagcatgcattgtcctttttgccagaaccccgacaccaaagtcattgatacgcgcattagcgatgacggtcattccatccgtcggcgtcgcgtatgcccgaaatgcagcaagcgttttaccacggtggaaaccagtatgctgctggtcactaaacgttcgggtggcgtggagccattcagtagagacaaagtgatttccggcgtacgcaaagcttgtcaggggcggccggtcagagaagaggatctgaagctgctgggacagaaagtcgaagaggatcttcgctcccgaggccttgccgaagtcacctcagatgaagtgggcaaagccatcctgaaaccgttgcgtgacttggatgtggtggcgtaccttcgattcgcgagtgtgtaccagaactttgcaggtctggaggatttccaaagcgccattgatggtttgcgtgaataatatgcgaatgccatgcaccgtgatatgcgagtgattcgcaaaccatggtgcgagccaatcatgaagcccagcacttatgaaaaagacccgtcatgatgacgggtctctttcatatcaatcgaggatgagctgcgtcagctgatgacacgcatgcgaatggtgccttcgatgttgcgcagtgcttcaagcgtggcggcgctgggcttctgagccacgtcggtgaccacatagccaagttcgccttcggttgccagcgactggaaggaaacgttgatgttctcctcgccgagcacatgattgacatgagccagcacaccaggaagattgtcgtgcagatgggcgatacggcacacacccttgcactcaccgaggttgatctgcggtaggttcacggacaaggaggtagaacccttgaaccagtaatcctcaagacgctgagagacgaaatggccgatggattcctgagcttccaaggtggagccgccaatatgaggagtcagaatcatattgtcttcattggccagtgaggtctcgaacggatctccgctcttcttcggttcaacggggaacacgtcgaccgccgcgccagacagatggccggaatcgaggtgctgcttcagagctcccagatcggcgacgaaaccgcgcgaaaggttaatgaaaatcgcgtcctgcttcatgtgggcgaattggtcttcgccgaagaatccggtgttcgacttgcggccatccacgtgcagggtcacggcatcggactgttccagcagttcgttgagggtgtcgcaacggtaggcgttgcccagtgccagtttctcctcaatgtcgtagaacaccacgcgcatgccgagggcctcggccagtaccgacagctgggagccgatgttgccgtagccgatgatgccgagggtcttgcctcgcacttcatgcgagccggaagcggacttgtcccacaggccatgcttgatgtgatgcgtgtgtgcgggaatgcggcgcatcaagcagatgatgtcgcagatcaccaattccaccacggaacgggtgttggagtagggagcgttgaacacggcgatgccacgcttgccggcatgtgccagatcgacctgattggtgccgatgcagaagcagccgatggcgcttagcgtaggacgcgcatccagcacgcgggctgtaacgttggtcttggagcgtacgcccaccaagtccacgccatccagcgcatcgatgagttcgtcctcgctcagggctcctttcatggtctcgacttcgaaaccgtgatcacgcagcgatttggccgcatcggggtgaatgttttccaataacagtgctttgggcatgcttcataccttagatgttcagggacttttcgtccgcttttgtccgaactataaccagtttctgggtcggcctggtcattgccacgtacaggtccgaggcggcgaccaggcggctcggcgcgtcatcctcgatgagaccgggctcgaccaccacgacggcatcgaactccagacccttgaccgtttcagtgccgcagacgctgatttgctcatcccattcgggctgctcgatgagccttgcgtattcggccgggtcaagaatgacagccagtttgcggcgcacggcatcgcgcaccggggcgatgagattatccggacagatgacggcgatgcggccggtgccgtctgccgaaacgaattgttcggcaagctgcgccgcctgctcggccgtcgtttccagcaaggacgacatgtcgggcaccacattgcgggacaccgaatcggggatggtgcgcaccgcattgaccgtggagatgtagaggccttcctcctcggcaaatcgtgaggcaagttcggaaacttcctgcggattacggtagttgatggtcaactcgttcaaatcccagtggctttcgccgaacaggcggttcatcgatttgctccagcgtcgggtgccacccagcgccgaagtctgcgccacatcgcccacgatggtgaacgagcgggaggggcaacggcggatcaacatacgccagtccatgtcggtcaattcctgcgcttcatcgaccacgatgtgcccgtaggtccattcacggtcggccgcggcccgctgcgcggtcagctcagcgtcgtccccgttcatctggtcgagcagcatctgactggagacgatgcctccacccagaccggtcgcggccagagtgtctttggcatactgctcttcggcggcacgacgtgcgtcggcggcggactggcgggccaccgccttgggatcggggcccagcatatccattgcttcgtcgagcagcggaatatcggagcgggtcaacggggagcctttggggcgggcaagtgccgcgatgtcgttgtcggtcagccaaccagccagagacttcagacgttcgggatgggcgaacagctgatcgatgagccatggggcggtcatcggcagccagcacaggttcagggtcttgcgaacctgctcgttcatacgtagcagcgacatcgcgcggttcagctccgcctgatccggcgtgtaatcaagctgttcggcataacggttctgcatgctggtcagcatcgaacggataaaggtctcgcgggccttgttatgaggttgtcgggtgcgcttcgcgtccgcctgcgcctgctcgatatcagtggccagcattggtacctgaatgccgctaatggttactgtcggcagagcagcgggaacacgcacgcgtgcggcgatggcattggccactacggaggtcatgcgtcgatcgcccttgagcttggctgcataaggggagtcgaccgccgtggcggtgatgccgggaatcagatcgctgatggtgcgtgagaccacgccggtctcgcccaaggaaggtagcacctgatcgatgtagtgcaggaacgccgagctggggccaacaaccagcacgccggaacgttccagcgtgcgccggtgcgtgtacagcaggtaggcggcgcgatggagcgccacggccgtcttgccggtgccggggccgccctgcaccaccacggcgcgattcatgtcggagcggatgatgcggtcctgctcggcctgaatggtggccacgatatcggtcatcttgccggtgcggcgtgagctcaacgaagccagcagcgcaccctcgccggtcaatgtgccggcggaagacgcctggccgacctggtctgaatgcacgtcgagcacctcatcctcaacgcccacgacttcgcggaaactcaaggtgatatgcctgcgcatcacgatgtcgccgtgattggaaggggtcgcctcatagaaaggacgtgcggcttcggcacgccagtcggtcagaatcggctcatggtccgggctcgacaggccgatgcggccgatgtagtgacggtcgccgttcttggcatcgagacggccaaacaccagccgatcctcaacgctgcgcaattgcgtgaggcggttttcgtacattgtggcaaaggagtctcgttcgctgcgttgcgtgggggatccgtgggagccggcggcgcgtacggtgtccaggcgttgccacatttcggctcgcagatcatccaatcgtccataggcgcgatcgacggcctgctgctcttcatgcagctgggaggcgtaactcgacatgctgttctcttcgttccatttccgtggggcagaaaaacttaaggcattcaaatttaccgcacaccccctacgtcagtgatgcggacaactcggaataggtgaattcagcgtgaattcaccatgctgctcggtcggtggggtgcgcgacgtggattggatgtgcggagcgtccattcgtgcgacagtcgtggccgacacgcgcaatccatcggtaattgccctaaaagggtgagcaaatcgtgcatgagtggggagaaatggggaatcgtggggtagagtggtgagccagttggccgaagtgtatcccacgtaacgatgaaggaggtggagccatggttgccgatcagacgattcgcgacgctgatgccaacgcacaaggctccaccactatggccgatctcatggctggtctgccgccattgcttctcggcacatatacgccgaagatcgatgccaagggccgtatggcgcttccggccaaattccgctcccagctggggcagggcctggtcatggcccgaggccaggaacggtgcgtgtacctgctgccgttcgacgaatttcgacgtatcgcctcgcagattcagcgtgtgtcggtgggaaacaaagccgcccgcgaatacctgcgtgtgttcctttccggtgccgtcgaccagcagccggacaagcagggccgcgtgctggtgccgcagatgctgcgcgattacgccaatctgggttccgacgtcgtggtgatcggcgttggcacccgtgccgaactgtggaataaggacacgtgggagtcctacctcgccgagaaggaagagggatattccgatattgctgacgatgtgttgccggaggtggaattctgatggttgatgtggcgaatattcatctgccggtattgcttgacgattgcgtgaacctgatggcacctgccctggaacatgagaacgccatcgcagtggattgcaccctgggccttgccggccattccatcgccttcctcaaggccgcgcctcaggctcggctcatcggcattgaccgtgacagtgaagcgctggggctggccaccgaacgtatggaacgggaggggctcgccgatcgattcattccggtgcatgccgccttcgatcagctcgatcaggtgttggcggaccaagacatcgaacgcgtggacgccgtattcatggatctgggattatccagcctgcagatcgacgaaaccgatcgtggcttctcctattcgcatgatgcgccgctggatatgcgcatggacgtcagccagccgttgacggccgaacggattcttgccacctatgatgcggcggaactggtccgcatattcaaggaatacggtgaagagcgtttctcgcgtcagatcgcccgcgccatcgtggcgcgtcgagacaaggagccgtttaccaccaccgcacagctcaaccgtctggtcgatgaagtggtgccgcaagcccaccgcccggcgggcaatcccgccaaacgcgtcttccaggcgttgcgcattgaagtcaacggcgaattggacaagctcgcctccacattgccgcaggccgcgaaccgactgcatgtcgggggacgactggtggtggagtcctatcattcgctcgaagacaaaaccgtcaaatcgttcatggcacaagggctgcgagtggatgttccggctggcctgcctgtcataccgccggatgcccaaccgtttttcacggatctcacgcgaggtgccatcaaggccgacgaacatgaaatcgcagccaacccgagatcggcttcggtgcggttgcgggcggtggaagtcagccgtgagattccgtcacgatggaggaaacgctttacgcaaaccgcgcagggcctgaatgacgtcaagatacaaggctccgcgtctccgggcagagccaaaaacacggcacgaattcgtacaaggaggggataacagcatatggcaactgcacgtagcattcgatcgaacgcggctccagcctcgaaccgaccgcacaccaagcatcagtcctcctcccgacctgagctgcgggtggtctccaacccgcgtggaaacgagcagggcaatgtcgtcggacgggtcatcgaatggaccagaacaagaagcgcaccgctggtgcacgtggccattgcagtgatcttcctcgtcggcaccttgttcggcgcgctgatgctgcgtacccagatggtgcagaactcgtttgaggcggcacagatcgaaaccaacatcaacagacttacccaagatatcgaagacgatcaggccaaactcgatcaattggtcgcgaacctgcccgacaaggccagcgacatgggcatggtcccgcagcagggatcagtgtccatcgacttaagcggataccagtccaacaaaggcggaacccagtgaacaccattcgtcgcatcgtagagttcgccaaggtcaagaccttcgcgttcaaatgcatcgccatcggcgccgcattggcgttggtggcgtcggcatgcgtgattcagctggcctccacccagctcatcggcggccgtcaaaccgcacaagcggccacggctaaccgcaccctgaccgtgacgttgagcgccaaacgtgggcgtatcctcgacgccaacggctccgtgctcgctcaaagcgtggagcgttatactatcgtcgccaatccggaggctgcacaggagttcgagccgattacttgcaatgacaacacccgtgattactgccacgaaattgacggcaaacccgtgggcgctaccggagcggcggccgtgggccgactgctggccaaagtcctggatatgaacgccatggaactgggcgctgatctgtccggtaccgggcagtatgtgattctgaagaaagatgtgactccgcaggtcaagcgcagcatcgagtcgttgcacctgggcggtattgtctggggtgagctgagcagtgaacgactgtatgcggatggcgatctcatgggcgcgctgcttggcggcgtgaacgacaacggcgatggcgtcgccggcatcgagcaggtcgagaacaagacgcttaccggaaccgatggccatgaaacctaccagcgtggtaatggcggcgaagagattcccggcaccatgaccgaatcggtggcggccaaaaatggcgacgatgtcaccctgaccattgaccgtgatgtgcaatggtatgtcaaaaaggtcttgaaggaggccgaatccaagtatggtgcagcgtgggcgatcgccgtggtgcaggatgtccagagcggggagattcgcgcactggccgatagcgatgaagtacaggctggtaccgatgcggcgaagatgagcccgtctcgggccgtgtccgaaaccttcgagcctggttcggtgggcaaggtcatctccatgtccggctatctgcagatgggactgcataagatgagcgatcaattgtcggtcccggaccacatcacacaggagggccagacctacaaggactcattcgaccatggcactgagcgctggacgctcgccggcattctgcagaactcatcgaacgtcggcatgattatggccggggagaactatccggatgagcaacgctacgagtacctgaccaaattcggcatcggacaaccgaccggactgaacctgcccggtgaatcgagcggtctgctcaccaacccttcggcgtgggatctgcgtacgcgcaacaccatcctgtttggtcagggctacaccgtcaacgccctgcagctcaacaacgtggtggccaccatcgcgaacaagggtgtcaagcagcagcagtcgatcatcaaatcaaccaccgatgccaatggcaagaccactgagaccaagaagggcgaagccacccgcgtggtggatgaaaaggtcgcatcggacatgatgaatgcgatggaatcagtggcggaaggctacaacaagttcgtcaaggtcgatggttaccgcatggccgccaagtccggtaccgcagaggtgcagggctcggatggcacgctctcgtccattatctccgattattccgtggtgattcccgcggacaacccgcgctatgcggtcaccgtggtgatgaaggatccgaatggtgtgttcggcggtctgacggccggccctgtttccgcacagatttgtgagttccttatgcagaaatacgaggtgcctgtctccagtccacgcaaaaatgctattccagtcacgtggtaaggatcaggggagaaaggcgatagcccatgagtgcagtgagcgaatccatcgcccagcgggtgaccctgggaatgctggtcgaacggtacggttttgaagtcgatccacccttcgccaccaatgtcaccattacctcactcagcgatgccgtggacaccgtgattcccggctcgctgttcatctgcacgcatgagcaggaacccgatgtactgcatgccgcacaggccggtgcctatgcggcgttgctgccacgcgcgtccaaagggcagatcgccaatgccgatataccgttgctctacggcgatttcgacgatcgcgtactcggcgatctggccagcggtctggccggcggaccgtccaatgccatggcggtgttcgcggtgaccggtgcggatgagcaggccgtcgacgcaggcgtgtcccagctctccgaattcctgcacatgctgggcaatccggtggcggtaatcaccgcatccgggtccacgtcgatgacacgtaccatgaacctgaactatcctctgggcatcctcgatatgcagcgcgcgctgtccgtgtgcgccgaagacggtgtggcggccgtgatcatcgccatggatgaccgcacgttggccgagcatgcgttggaatcggtgaacgtggatgtactgggcacggaggatgtcaacgcaagcgcaagcttgaacgaattgaagacacgctacgcattcgttgcggaacatgacatgtccatgacctcgtcgacacccgaatcggatgaaatggctgcggattcaccggcaatgtatgaccgcgtccgactcgggcacatgtccttggccatcgccatggtgctggccgccggcgtgaggaaaaacaacatacgcagtgccctgcacgtggccaataatctcaattaagtccgtggatacgggacgaagcgtaatcgtaaaggagtttgaaacaccatggttccgatgagcgtggaggagatcgccaaggccgtcgatggtcgattgatcggagacgccggttccgagtctcgagccaccaatacggtcagcgactcgcggcaggccggccccggatcggtgtttgtggccatccgaggcgagcgtgtcgatgggcatgactttgtggcgaaaaccgctggacagggagccacggtggccatcgtcgaccatgaggtgaagtccgatggccttccgcagatcgtagtgaaagacacggtcgacgcccttggcgaactcgcccgatacaacatcgttcgccgccgcgagctggacggcgacttcgacatcatcggattgaccggttcggtgggcaagaccaccaccaaggatctgctctcctccctgcttgccaccgtaggtccgaccgtggctccggtgggatcgttcaacaatgagatcggcctgccgctcactgcgttgcgggtcgatgagcacacccggttcttcgtggctgagatgggtgccagccatatcggcgaaatcgcgcgactgacccgtatcgcaccgccgaacacggcaatcgtattgaaggtcggcgtcgctcaccttggagaattcggctcccgcgaacgcatcgcacaggcgaaaagcgaaatcgtgcagggattgcttcccggaggcaccgcggtactgaacgccgatgacgaacacgtggttcccatggccggcctggccaacggcgacgtgctgtggttcggcttgggatcgtcgcaggagcccgaggtgcgggccattgatgtcactgccgaccggtccgatcatgctgaattcacgttggtcgatgcggacggcaaccatacgccggtgcatctgggcattcctggacgtcacaatgtgatgaacgcgttggccgccgcaaccgtggcgatgcgttacggtatggcacccgaaacggtggcacggattctggcctcgcagcacaccatcagccctcatcgcatggcattgtccacggtgaatcgcgaggggacttccttcacgctgatcgatgattccttcaacgccaatcccgactccatgaaagccggcctgaacgggttgaaggcctggaactcaaatgacggcaaggagccgttccgcgtggcgctgctgggtgccatgctggaactcggcgccgatgaaacggcattgcacacctcgatcggcacgtatgcggacgaattgggcatcgacgcgatcatcgcggtcggttccgcccaagaccaacatctcgatgcactggcacaggctctggcggacggtgcccgtcagagccaatccgcgtcggtggattgcgtacacgacatcgatgcggccgaacagctggtcatcgacttggctcgcaaccatcccgacgctgtggtgctgctcaagggatcgcacgcgtcaggcctgagcgctttggctgaacgctgggcaaagaactgacctgataaccaccccaagaaaccgacaagaaagagaagctgcacgtgattgctctgatcattggaatgctggtgtcgctcatcgtcaccttagtcggcaccccgctgctgattcggctggtccacaagctgcactatggccagtacatccgccaggatgggccgcagtcgcatctggtcaagcgcggcacccccacgttgggcggcgtggtcatcaacttcgcgattctgctcggttgggcatcctccgcactgtaccgatacctgcgttcgggcgacgtgccctcctggtccgcggcgctcgtactgttcgccatgctgtcgatgggtctgctgggctttatcgacgacttcgccaaggtgcgtaagaagcagaacgaaggcctatcggtgggcggcaagttcatcggccagttcatcttcgccaccatctacgcggtacttgcgctgctgattcccaccaaatcgggattccccagtgcgcaggcaggcatcagcttcatcgaacagccgttcttcaacttcgacttcgccggccgtgccgtagccatcatcctgttcgtcatctgggtgaacttcctgatgaccgcatggaccaacgcagtgaatctgacggatggacttgacggtctggcggcaggttcgtcgatgatcgccttcactggttttggcatcatcgcattctgggaaagctaccacatcaagggcggcagccatggcggatattcctatgccgtgtccgatcctctcgatctgaccgtcatcgccgtatgcgcggccgtcgcctgcttcggcttcctgtggtacaactcgaaccccgcatcgattttcatgggtgataccggttccctggccttgggtggtctgttcgcagccctgtccatcgccacgcacaccgaattcctggcggtggttctgggcggactgtacgtcatggaagccatgagcgacgtcatccaggtcgggtacttcaagatgacccacaaacgtgtattcaaaatggcgccgattcaccatcatttcgaactggagggttggaccgaaaccaaggtggtggtgcggttctggatgatcgaactcatcttcgtgctgctcgccctgacgattttctacggcgactgggtcacccgctccggcctgctgttcagctagcggaaatctgggtggattatgctcacccacggaattcctatatcaggaggaacaatgcaagtagcggataagacagtggtgatcgccggactgggggtgtccggcacctcgttggcggaggtattgagggaacgcggcacccacgtgattggcgtcgacgagaggaagcccgaggccgatctccactcctttgatgacgtggactgggaccacgtggactacgtcatgtcgtccccggtgttcaacccccgcaccccgttcgtgctggaagcccaacgccgtggcatccccgtgatgagcgaggtggaattcgcatggcagctgcgtgtgaataacgagcgcaccggtactccggctccatggatcggcatcaccggcaccaacggcaaaacctccaccaccgagatgacctcggaaatgctcaccgcctgcggactcgacgcgccgaccgccggcaatatcgcctccggagacatgagcatgagcctgtctcgttgcgccaccaatccgcagcacgacgtactgtgcgtggaactgagctccttccaattgcacttcaccgattcgctggcacttgactgcgcggcgatcaccaatatcgccgacgatcacctcgactggcatggcgggcgcgagaattacgccgccgacaaatccaaggtgttccacaacgccaaacgcgccatcgtctacaatgcgcaggacgccaaagtcagcgaactggcggccgaggctcagactgccgaaggatgccgcaaggtgggattcacgctcgaggcccctcaagccggccagatcggcattgaagatggctggatcgtggacaggagcggcgtggccggcggcgcagtaggagagtcggtcagactggccgccatcaccgatttcacgcatctggcagagccggacggctcactgtacccgcatctggtggccgatgcattgacggcattggcgttggtgctgggacttggcgctgatcgcgataccgcgttgaaggcgcttacctcgttcaagccgggcggccatcgcatcgaaaccgtggctgaggccgcagtcgagggcggctctgttcgttttgtggacgattccaaagccaccaacggccatgcggcacgcgcctcgctgtccagcttcccggccaagtctgtgatctggattgccggaggtctggccaagggcagtcgattcgaggacctggtcaaggaccaggcacacaccatcaaagcggccgtcatcatcggcaaagaccagcagccgatgatcgaagcgtttgccagccaagctccggacatcccggtgactatcatcgatcccgaagacaacgataccgtcatggatcgtgccgtcgaagcctgcggcacgtataccgccgccggcgacatcgtgcttatggctccggcctgcgcctccatggaccagttcaagtcctacgcggatcgaggcaatcgattcgccgccgcagccaagacgtggagcgaggtgcatggcctccactgatacccataagcgtaaggcatacagagtccctgacaagcccgcactcgaaatcactgactacacgggttggcgaagcttgctcaacccgctatggtgctaccacggcttccgcatggccgtggtggggctgacatgcttcggcctgatcatggtgttctccagctccacggtcaccatggccgcactgggcaagtcgccgttccttcagcttctgaaccagggcgcgttttgcctgatcggcttggtgctgggcttcgtggcattgatgatgccggtgacgttctggaaacggaccggcgtgctctttgtggtgggtgcctgcctgttgcaggcgctgacctttactcctttgggtatcgacgtctatggcaacaaaggttggctgaacctcggcttcaccactatccagccggctgaattcatgaagttcgcgatgtgcatatggctgccctcgtcgttgcatgcctgcagcaagatgtaccacaagaagggaatcaaagcatatgccgcgccgttggtgttgtatgcgataggcgtggcgctggtgatgggcggcagggacctcggcacggccatgattctggtcttcatcggaggcgtggcctttctgatcgtcgggttccccggcaaatggatgggagtcggcgtattgggcgcggtggttatggtcggtgcattggcggtttccagcccgaaccgcttgcgtcgtattctggccacatatggcgattgctcggccgctgacgcgcagagcgtatgctaccagtccattcacgccaagtacgccatcgcctccggaggttttctgggattgggcatcggcaattcgcgggagaaatggaactacctgccggccgcccataacgatttcattttcgcgatcatcggcgaggagaccggattcgtcggttgcgccatcgtattgctgttcttcgcgattctcgcctggtgcatgatcgtcatcgcattgcaggtcaccgatcgttatgttgccatggtgctgatgtgcgtcgccatttggatcgtgggccaggccatggtcaacatcggcgtggtcgtgggtgtgttcccggtattgggcgtgcctatgccgttcgtctccgcaggtggctcatccatgattatgtgcttgacggcggccggactggttgtgggacttatgcgctctcaaccgcagataaaacagtcgcgtcagagcgcgtaagtagactcggtaatcatgaatcaaggcacaccacatatcgttcttgctggcggcggtaccgccggacatgtcaatccgctgctcgcggtcgccggggcgattcgcgacatcgaacccacggcacaggtcaccgtcatcggcactgcggtgggtttggagaaggatttggtgccggaggccggctacgagctcgacaccatcgaaaaagtgccgttcccgcgtcgccctaacctgtacatgctgcgcttcccggcaaaatggaagcgagaaaccgccaaggtgcgctccattcttgaaacgcggcatgcggatgtcgtggccggattcggcgggtatgcttccgcccccgtctacgccaccgcacacaagatgggcattccgattgccatccatgagcagaatgcgcgtgccggcatggccaataaactgggcgctcgttgggccgatttcatcggtaccgtgtacgagggcaccggtctcaaaccgcgtgccggagccgacgtcgagcgcgtcggtctgccgttgcgcccggccatcgcctccctgaccaaacgcatcggtgacgaccgtgccgccgtacgccgtgaatcggccgcgcagcttggcgtcgatccgaaccgtccgctggtgctggtcactggcggatcgctgggagcgcaaagcctgaaccgcgccatcgcctcctccgccgcagacctgttggcccacgcacaaatcatccacttgaccgggcgaggcaaaatcagcgaagtacgcgaactggtcacggcctcggccggcgcggacgtgcttaccggcatcggccccgaatcggccggacaaggtgactaccataccgccgaatatctggaacgaatcgatctggcctttgcctgtgccgacttggtgatttgccgtgccggagccggatcggtatccgagctggctgcactgggcctgccggccatttacgtgccgctgcccatcggcaacggcgagcagcgtttcaacgccgagccagtggtgaacgccggcggcggccttctggtcgcagacaaggacctgaccccgcagtgggtgcatgagcatgtgcccgatctgctcgccgatcacgaacgacttgccgaattcggccgcaaggcatgggaatacggcatcagaaacgctgccgaaatcatggcccggcacgttctgcaattagccgaaccatccaagtagtattcagatatcattccgtgcgcgatactgaccaattccgttccgcagcacgagatacggtcataatatagggtgctggaatccctaaaggagttttgaattgtctcaagatcagcccatagtgcttgaccctacgtatgcctcattcgatgctgcggcccgccctgcggatctcggcgccacccatttcatcggtatcggcggtgccggtatgagcgttctggccgaaatgctgcacgccgaaggagtcgcggtggacggctccgatcgcgcacacagcgccaaaaccgaccgacttgaaacgctgggcatcaccgttgaattcgggcagcgagccgaaaatgtcgcccaggccgagaccgtggtctactccagcgccatcaaaccggacaatccggaaatcgtcgcagcacacgcggcgggcaagcgcattgtgcatcgcagtgacatcctcgccctgctcatgaacggcaaacgagccgtcaccgtggccggagcgcacggcaaaaccaccaccagctccatgctgtcccacattctggtgaacgccggtgccgatccaagctacgccatcggcggctttatccaaggcccggacggcaccacgctggacggcggacacgcgggcaaaggcgacatcctggtggccgaagccgacgaatcggacggcagcttcgccaaataccatccgaccatcgccattatcaccaactgtgaagccgatcatctcgaccattacggcgacgaagcccactaccgtgccgcgttcgttgcccacgccggccgggccaccggtcacgtgatcatcagtatcgacgaccccgacggacttgccgtgctggaggccctgcccgccgacgtgaaatcccataccgttgcctacggcactaccgcgcgtgaatccctgcccgatttgggcggtgccgcgtatgtctggatcgcttcggaaagcgagaccgctggcagcggcgtcgaacagctcaccctgcatctgccggccgcggtgacggcgggggagccggtgtctcagagcgttgccctgaaggttcctggcgtgcacaatgcgcgcaatgcggccgccgccatcagcgctgccgtgctgctgggcgtgagccccgcagacgcggccaaggcggccggcacattcctcggtgcggcacgccgcttccaggtgcgcggcacggtcaagcaggtcactgtagtggacgattacgcccatcatcccaccgaaatcgcggccctgctggatgcggcccgacgccggtaccccgattcgaccattcgtgtgatcttccagccacacctgttctcccgcaccaagttcttcgcgcaccagttcgccaaatccttagccaaagccgatgacgtcattatcaccggcatcttcccggcccgtgaaaagcaggccgatttcccggacatcagcccctccaccatcgtggacgcggctgcgggactcaaagatgcttccgcaggcacgtggattcagccggttgaggatatgtgcctggccgccaagatgatggccatgcgcgcccaccacggcgacgtgatcttcaccgtgggcgcgggcgacatcaccgacatggatcaggtgctgctcaccgcacttgaggcccatcgggaaagctgcgagtgatgtccgggcgcacggtcagatccgggggcaatgacaacggctcacgtcgttcgtctgggagctcccgcaagccgcgcaccatcggttcacgcggaaacacgggtcgctcgtcgaagtctcgcgctccccggtccgtgtcttccggtcatgagatcgacgagccggagatcatcgacgatgtgacggtagccaagggccaggccggtgccttcgtcgatgcacggcggttgcacagcgaggattacgttgccgaaacgctgcatcagaccaccggctccctaggagtcgcatcacgcccgaaagtggtgaatttcaccgaacgcgccaaagaacgcaagcgtgcaaacgtgcgcgtcgttgcgttacgcgtgttgattgcggtcgtcagtgtggctgtagtggcggggctggcatggctgctgcttttctcgtcggtgtttcgtctggaaaccagcgagatcggcgtatccggtgccaacgaatgggtgagtgcgcagaccatccatgtcatcgccgataagcaggctggaaagtcgttgttcctggtctccgcccatgaggtcacagagcaactcaagtccattcccggcgtcagcgaggccaaggtctccaaacagttccccaagtcgatgagcgtggaagtcaaggcgcaacggcccgcggccatgctgaaaagaggcgataccctgaccgcggtggattcccaggcgcgtgtgttgaactcggtgaagaacgccaacgtggatggcatcccggtgatcgaggtcaaggatatagacgccagtctcaagaaccgttcggtgaaggagacgctgacgattctgggcgcgttgccggaatcgatgcgtaagtccattaccaaggtcaccgctgagacgcaggattcggtgactaccacgcttaacgacggtgaccgcgtaatcatttggggcgattcttcgcaactgaagctgaagttggcggaagtcgaggaaatcgacaagaacatcaccgctggcacggctggctttgccgggaaacatcagattgatgtttcctcatcccagaagcccatcatcaagtgacggcgatttcgttggcttcgttggttccggggcgatgttcgctgctggcgatttgcgcgagtagcgccatagggtgtatgctgaaaagtccggccgaaaagccggaagcttgataactcaagattgggggcgatcggtttcgacggtgacctgttcgctgcagggaagcgtgccgagaacgccgggtccgctcgtggatgaccccggcaaaagaataagtgctaaatctaaccgcactgagttcgctctcgctgcctgatttttagtcaggattaaccagtgagcagccgctccgttcactcctcctcgtctttgggaggatgctgagcgtcgtttagaagacttgctgatgcagttgagcctcagggctgcatcgggactttaactgcggatatgctcgccatcagttgtctgcgacatcgatgggggcagaaagatcgccaacttggccagcagactacgcacgtagaagactgtgggctcggtcatcggaccggggttcaattccccgcgcctccaccaatccgcttcggcggaaacaagccgcttggctttacgaaagtaaggctgagcggctttctgttattgctccgttgattccttgttttcccgctattctctcgtgtcggatatgtcagttggacgaacttgcggggaagaaacgatttagacttagttcagggctgccgattgcacgatgtgtagaggctattatgctacgccgtaatcagggaggatatatgccgctggaattggtccgacaggatattacgaagatgaaggtggacgccatagtcaatgcggcaaacacgcagctcgccatgggtgggggagtgtgcggcgcgatattccgcgctgcgggagtctcgcgcatggctgctgcctgcgatcggtttgctcccattcataccggtgaggcggttatcactccgggattcaatttgccatcacgctatgtgattcataccgcaggcccgatatggcgagacggcaagcatgatgaagaacgtctgctgcgttcgtgctatcgcaattcgatggaactcgcggcacggcaggggtgtgccagcatcgccttccccttgatttccagcggtatctatggatatccgaaagccgaggcccttcatgtggccctcgatgagattcgccgattcctgggcgacgcagccgactccggacacgatctcgacgtatacctatgcgtattcgacaaaaccgctttcgaaataagcagcagtattgacaaacgtcttcgcgcatatattgatgattattatgtagcggagcatgaagatacgctaggaagcagaacgtatgagctgcttgctctccaacggttttcggataataagccgaaggcggatagggccgtaccttccggcgtcttggacatgccggatttcctgggcgatatgcgtgaaacgcctgtctactcggcgccgtcggcagctccatcgccgaaatccgccgggcatgtggatgatgcggtgctctccaatctggatgaaccttttaacatcattctcttgaggcttatcgacgccaaaggatattccgacgtggaggtatataaacgagcgaatatcaatcgtaaactgttctctaaaattcgctgtggcgatggctatatgcccagcaagaaaacggttttggcactggccattgccttacggctgaatattgacgagacgcaagatatattggcgtgcgccgggtatgcgctgtcgcacagcgtgaaattcgatgtgatcgtggaattcttcatcgtccatgagatgtttgatgtattcactattaacgagatgttgttccgatacgatcagccgttgcttgggcaatgatgcggagcggtacgctcgtctcctgacctgctgccgatacgcggcatattgtcgcttgccaagcgacctaggactggtcccatgatgcgaagctcattgatatcgccgacaatccggctggcgaatgagcgaaaggattcatcatgggcaagaacgacaatggcaataacggccgtacggaactggtgttcgtcgtcgacagaagcggatcgatgggaggtctggaatcagacaccatcggtggcttcaacagcatgctgtccaagcagcgaacaattgccggcgagtgcagggtaacgaccctactgttcgatcatcgaatcgaaaccttgcataatcacctcgacatccgcgaagtgaacgatttgacgagccgggattactgggtgcgcggtagcactgcgttgttggatgcgattgggctggccattgaccgcatgatcgtgacgcaacgacatactgcggcagcgtaccgtgctcaacatgtgctgtttgtcatcattactgacgggtatgagaacgcgagtcgtcgatattcgttgcatcagatcaagcagatgattacctatgagcgtgaacgctatcattgggagtttgtgtttctgggcgcgaacatcgacgccgaacagacggctggtgattttggtatctcaccgcgatgcgccactgattttcatgccgatggacagggaatcaaagcctcgtttgaggccgttgcctgtgccgcgaccgccgtgcgcggaggtgctgaccttgatgacctcagcgcgccggactttcttggtggtgttcgtgatgactatcggtctcgtcgtcgaatgaagcggtaaacgatgaactgcagtgcagatattaccggtcaccagtcggtcgtgtacgttaccggctggtgactgcacacgttgtactgtagggaaccatgaaagtcgtattgcaacgagtatccgaagcgtccgtggacgtggtcaatgaattgggcacgctggatcccacgttcgagccgcagcagattggcccgggattcatgattctggtgggcgtcaccgatgaggacggcgacaagcagatcgcctggttggcccataagattctgaatctcagggtgttcgaggatgcgcagggcaagatgaaccgttcgattcaggacatcggcggcgagattctctccatctcgcagttcacgctgttcgccgacgtgcacaagggcaatcgcccgagcttcatcaaggccggcaagcccgagcatgccgatctcatgtggatcaagttcaacgaggcgttgcgctccgggggagtgccggtgaaggaaggtcgtttcggcgcgcatatgcgggtcggactggtcaatgacgggccggtgaccatcgtcatcgacaccgagcatgacatgcctgacggaacacgctgaattgcgatagtaatttgacatcatatcccgttccctccaatatgttactaaagcgctttagtcttctgcgggcgagggcgcatgtcgatatgtttcccatgaacgggcagcacaatgatgtggccgcacaagcggcagagataaggggagtgaacagcagatgttcctgaaacctgaacagcaactggagcggtgcaggcgcatagtgcgccagcgcgtggaccctcatatccacccatcgatcgcacagcttgcggtggagtcctttgacattcccggagagccgatgcccactgacgagttcttcgagaagctcaatcgaggtgacatcgacttcaagccgtttacgctcggtggtgaatggggcaccacatggggcacagtctggttccgcctgaccggtaccgtgccggccggctacccgaaaggcaagccgctggagctcatcctcgacctcggctggtacccgcactcctgcggcggccatatcgagggcctcgtctaccgtgccgacggcaccgccatcaaagccgtacacccgctcaactattgggtgccgttcatggatgctgagggcaacgcgcaagtgccggtcgccgaagacggcagcttcaccctgtacctcgaagccgccagcaacccgctgctgctcggcgtgcctccgttcattgagaccgaactgggcgaccatgccaccggcaagccggacgagccgtacgtattcaagtccgccgatctggccgaattcgatgaacgctacgagaactactccgtcgatctcgacgtggtgagctccctgatggaattcgccgacaaacagtcgccgcgctactggcaactcgccaaagcattgcagcgttcgctgaacgcctacgacgagcgcaaccccgaatccgtggaagccgcgcgcgcagcactcgccggcgtactggccaagccggccaatgcctcggccatgaacgtcagcgccatcggccacgcgcatatcgactccgcatggctgtggccggtgcgcgagacccgccgcaaggtggcccgcaccgtatccaacgcattggcgctgatggacgccgaccccgacttcaaatacgcgatgagctccgcccagcagtacgcctggctggaagaggatcatccggacatcttcaagcgcatgaagcggcgcattgaagaaggccggttcatcccggtcggcggcatgtgggtggaagccgatggcatgttgcccgccggtgagtcactgatccgccagattgcatatggccgcaaatacttcaaggaacatctcggtgtggagcccaagggcgtatggctgccggacagcttcggatacaccggcgcatggccgcagatcgcccgccgtgccgggtacgaatggttcctcacgcagaagatctcgtggaacgataccaccaagttcccgcaccactcgttcatgtgggagggcatcgacggctcgcgcatcttcacccacttcccgccggcggatacctatgctgcttggtgcaaggttcaggaactcgactacgccgagaagaactttcaggacaaggatctctccgaccgctcgcttctgctcttcggtttcggtgatggcggtggcggccccacgcgcaacatgatggagcacctgcaccgctacgagaacctcgaaggcgtctccaaggtaactattgagagcccgaacgatttcttcgacaaagcccaccgacagatcgaaaagaacgccggagaggaaatgcccgtctggaagggcgagctgtatctcgaactgcaccgtggcaccttgacctcgcaacaggacatgaaacgcggctgccgccaagaggaatcgctgttgcgcacggtcgaatacctgggcgcagccgccgtgttgtccgatccggagtacgtctacccgcgcgaggagctggaccgcatatggaagacgctgctgctgaaccagttccacgacatcctgcccggctcggccatcgcatgggtgcaccgcgaagcccgtgaggactatcgccgcgacctgaagcgtctcgctgaaatcgcccaagacatgtgcgccgtgctgcgcaaggccaacccgcaggccgacctgctcgccgaagcccgcatcagccagttccgcaatgacggtgcgtcttggcgtgccaaccgcatcaacgaaccgaccgacgcgctttccgtgctgacccagacattggacaacggccgtgtactgctggccaacggcgtactgtccgtcaccatcgaggccgacggtacgatctcgtcgctgcttgacgaggagcatggccgtgaactggttccggccggcacccgactgggccgatacgagctgttgaaggacgaacccgccgtttgggatgcctgggagatcgaacgcgaatccctgctcatggcgaatgccatgaccggatcaatcgaatcggtcgataccgaaaacggtgcggcacgagttcgcgtgcgcaccgccgacgatgacaccgtcatcaccaccaccatcacgctgcgccccggttcacacacgctcgatttccacgccgacatcgactggcatgagcgcgaacgcttcctcaaagtcgccttgccgctgggcattgtggccgatcaggcgacctacgactgccagtatggtctggtccgtcgcccaatcgtcaaaaacaccgcatccgacgaagccaagtatgagagcagcacgaaccgcttcgcccttatcggcgacgccggttacgccgcggccgtcatcaacggatcggtatacgggtccgatgcctcaccgatcgccgggaacgccgccgaaggtcgtgactcgggcactatgttccgactgtcattgctctccgcgccgaccttccccgacccgcgcaccgatatcggctcgcacgagttcgactggtccgtggtggccgacgccacggtggaccgtgcgcttggcgccgccggtgtgctcaacgcaccggtactccatgatgtgcccgatatcacgccgctcgcctcgatcgagtccgtcaatggtaccgtggtgctggactggatgaagctggccgatgatggttccggcgacctgatcgtacgtgcctatgaggcggccggcggccaggccgatgccatgctgcacgtctgcccggcgctcgcaggcgcttcggtgcatgagaccaatgtgctggaaggcgacgatttggccgccgaccttccagtcgcgctgcaagacggtaggcagaacgccgaaggtgccacgctgcactttggcccgttccagctcgccaccctgcgcgtcacgcgctgaattcccatctgatgcttctgcctcctcgaaccatgaggaggcagaaacatgtcgtattacggttttccaaattaccaccacacccatcatttccatcattcccaccagacacagcaaaggagaactctccatgtttcttctgcccaatcagcagttggagcgctgcgaccgcgtcatgcagcagcgcgtcaaaccgcatatccacaccacgctcgccgcatgcaccttgcgttcgttccacaatcccggcgaaccggtgccctccagcgaatttctagccaaagtgcgcaacggccaagtgcccttcgaacctttccgcgttcccggcgtttggggcaccacatggggcaccacatggttcgaggtgaacggccacatcgacatggcggcggtcaaaggacgaaaagtcgaactcatggtagacctcggctggctcgatcaccgcggtcccggattccaatccgagggacttgtctatcgtgccgacggcaccgccatcaaatctgcgaacccacgcaaccactggattccactcgtctacgcggacggcagcagcactgtagaactcgatgaacatggcgacttcaccgtctatatcgaagccgccgccaacccattcgtcgaaggccccaccccgttctcacccaccgaactcggcgaagaggccaccggcgcctgtgacttcccatacacactgagtcgcatggatatcaccatcttcaacgaagacgtgtttgcctatgacatggacttggaaaccgtatcttccctgattcgcgaactcaaagacgacgacccgcgctactggcagctcgccaaagcgctgcaacgctccttgaacatctacgatgaacgcgacttggaaaccgtgccggcagcccgtgcggcgctcgccggcgtgctcgccgaaccggctgcatccagcgcaatcaaccacattgccatcggccacgcgcatatcgactccgcatggctatggccggtgcgcgagacacgccgcaaagtggcccgtaccgtatccaacgtgctggctttgatggacgaagacccggacttcacgtatgcgatgagttccgcccaacagtacgcatggctggaagaagaacatcccgacctgttcgcacgaatgaagcggcgcatcgaagaaggccggttcatcccggtcggcggcatgtgggtggaatctgacaacatgattccttccggcgaatcattggtgcggcagatcacgttcggccgccgatatttcaaggagcatctcggcgtcacgccgcgtggcatctggctaccggacagtttcggctacaccggctcctggccgcagatcgcccgccgtgcaggattcgactggttcctcacgcagaagatctcgtggaacgacaccaccaagttcccgcaccactccttcatgtgggagggcatcgatggtacgcgtatcctcacgcacttcccaccctctgacacctactgctcgtcgatgagcatgcgcgagctcatgtattcgcagcgcaatttcctggacaaggatctttcccgcaacgcaatcctgctctacggtttcggcgatggcggcggcggtcccacgcgtgagatgaccgcgcgcatccgccgcgaccatgatctcgccggtgcgccgaaaatcgatttcggtactcctgatcagctgttcgaccgcgtgcgcaaggatatcgtggacgatgcccgcggcgagacaccggtcttccatggcgagctgtatttggaactgcatcgaggcacactcaccgcacagcaggatatgaagcgtggttgccgccaagaggagtcaatgctgcgtgtcgtcgaatacctgtgtgccgtggccagtatcaagaacccaggttacgtctatcctcgtgaggaactggaccgtatctggaagaccctgctgctcaaccagttccacgacattctgcccggttccgccatcgcatgggtgcaccgtcaggcacgcgaggaatacgcgcgtgacatcgcacgtctgcgtgacatcgctgcggctgccggccaggccgttaaagaggccgatccaggcatagcgacggtgaagcatgccgtgattgcgccatatgcaagcaatccgcagtattcatgggctgtgcgtgacggtggtggaacggctgtggaagagtctgtcattccggtttccgtcgagcgtgacggaaacgccatcatacttgacaacggacgtcttcgtgtgcgtattgaggcggatggcaccgtctcatccctgatcgatctcgctttgcgtcgtgaacttgtgccatccggtgtccgcatggggcgctatgagctgttgaaggatgagccattccattgggatgcatgggatatccagcgtgatgcgttcctcgccgccgatacgctcaccgacgccatggtcgagcatgtggaagatatgcccgacggctcggctgcgattcacgtcgtcacccgtgcgcgcggtgttgagatccataccgtcatcacgttgcgcccggggtccggcagtcttgattttaccgccgacgtggattggcatgccgtggagaagttcctcaaggtggatatgccggtcacggtgcaggcggtgaacgcgcagtacgaatgccagtacgggttggtcgaacgtccgatcaacaagaacacgcgcagcgatgatgccaaattcgaaagctgcacacaccgcttcgtacgtatcgccgacgccggctatgccgccgctgtggtcaacgcctccacgtacggatccgacgtcagtccgatccacgccgccgcggcgcacggcgccggccgcggcaccatggtgcgactgtcgctcctgtccgcaccgctgtaccccgatccacgcaccgaccagggagagcatttcttcgcctggtcgttggttgccggtgccggtatggaatcggtgctggccgaagcatctcgtctcaacgcgccgattatggatgagctgccggccgtgagaccgctggctacgctcaccgatgttgccggcacgccggtactggattgggtaaagctggccgacgatggttccggcgatcttatagtgcgtctatatgaggccgccgggggcgacgccaaggcaacgctgcgccttgatgatacgttcgcaggatgcacggtggaggaggtgaatctcatggaggagccggtgctggccgatgatctgccccgtgcactggtcgccggagggccggtgcccgctgagggtgcatccgtctcgttcacgccgttccagatcgtcacattgcgtattcggcgatagggacagatggtcttaaccccgatattgcaatcgcgctcgatcatgcgggaatcggattcctccgagatgctgcatggtcgcgcgcgattgcgcgttatggcggggatgggagacggggtaacgatatgcgacacggtgatgttgcgttcgtgcacacatcatgttattctctaactaaatcgctttagtaaccggcgaatgaccatggtggtcagctaagtcgctttagtctcagcgaaaagtacacgacaaaaggagagctatgctgctcaaagtcaatcgcgagattgatcgttgcaagcgcgttatgcgggagcgtgtttggccgcatatccatcaggtgcttgcacagtgcacggtcggcgcggtcaagaacccgggagaaccggagatgcccgctgcgttcatcacgcgcgcagtgtccgggcaggtcaattttcagccgctcgctgtaggcgaaccctggggaacctcatggggcacgacctggatgcgtgtcgagggacagttgcccgaaaccctgcccgaggggcgagccatcgagctggtgttcaaccttggttggctcgaatggcccgtcggcggtcacattgaggccatggcataccgtgccgatggcaccgtcatcaaggcactgcacccgcgcaatcactggatgccgcttgtctccgctgacggtgtcaaggatcgtgtggtcaatcctgacggctctttcgtggtttatgtcgaaggcgcttacaaccctaatgtcccgtcgtttaccgttaccgagctgggcaccaagcccaccggcaaagcagacgaacgctatgagttcagttccatcgatatcgccgctctggatcaggacatgttcgactactgggccgaccttgacgtcgtcaccggatctctcgaaaacatgaacgacgctgacccgcgctattggaagctcgccaaggccatgcagcgatccatcaacctgtgggacgagaaagactacaacacgctcgccttggctcgaaaggcgctcgacaaggtgatgcacaaccccgccaatgcctcggccatgaccctgaccgcaatgggtcactcgcatatcgactccgcatggctgtggccggtgcgcgaaaccgagcgcaaggtcgggcgcaccgtatccaatgcgctcgcgctgatggatatcgacccggacttcacttacgtgatgagcgccgcccagcatttcgcatggctcgaggaacgccaccccgacctgttcgaacgcgtcaaggcccgcatcgcggaaggccggttcatcccggtcggcggcatgtgggtcgaatccgacggcaccatgccgtgcggcgaatcgctgattcgtcagatcagttacggcaaacgatacttcaaggagaagctcggcgtcgtgccgaacggcatctggctgccggacagcttcggctataccggcgcatggccgcaaatcgccaagcgctccggctactcgtggttcctcacccagaagctgtgctggaacgacaccacacgcctgccgcatcactccttcatgtgggagggcgtcgacgggtcacagatcttcacccacttcccacccgccgacaaatacgattccgacatgtccgcgcacgacatggcctacgtgcagagcaactacaaggacaaggacctctccgaccgaggtatcttgttattcggctatggcgatggcggcggcgggcccatccgtgaaatgacgatgcgcgagcaccgctttgaaagttttgaaggtatgccaaaagtcgaatacggcactccggacgacttcttctccaaagctgaaaccgagatgaaggccgaggccggctcggaaatgccccgatggaaaggcgaattctatttcgagctgcatcgcaagacgttgacctctcagcaggagatgaaacgcggatgtcgcaaggaagaatcgatgttgcgcacggttgaatatctcggtgccgtggcttcgctcgaatctgccgactatgtgtacccgactgagcggattgatcgcatctggaagacattgctgctcagccagttccatgacatcctccccggctcggccattgaatgggctcatcgcgtggcccgagaagaatatgcccgcgatcttaaggcgctctcggatatcgcccgtgacgcgatcgcggcaatcgccgtcgccaacccggacgtggcccgtatcgccaaagcccggatcagccaattcgccgatgtcgatccgtggcgtccggcatcgctggtctcctgtggcgaaccagtcgaggtgaatcgtcgcgaagacggctcggctacgctggataacgggctgctgtgtgtccacgttgccgccgatggcaccgtcgactcgatgatcgacctgaagtccggacgcgaaatggtcgccaaggatcacgtaatgggccgttacgagattctcaaggacgagcctggcgtattcgatgcctgggatgtcgaacgcgatgccttcctgtgcgccaccgcattggctgacggacatatcgtctcgatcgagaccaccgcagacgggtccgccgtgatcgtcaccaagaacagttaccgcgacgacgagatttccaccacaatcacgttgcgcccgggcaaaagccagcttgatttccatgcagatgtcgaatggaatgtgcccgagaagctgctcaaggtagacatccccatggcactgagcgccagccgtgcccagtatgaatgccagtatggcctcatcgaacgcccgatcgtcaagaacaccgaaggcgaagaggcgatgttcgaaagctgttcacatcgcttcgttcgcatacacgattcctcatacggcattggcgtggccaacggctcgacctatggctccgacgtcagctcgctacgtgatcgggatgatgccctcgccggcacgatggtgcgcatgtcgttggtcgcggctccgacggcaccggatccacgcaccgacatcggccaccacgagttcgactggaccgtactgccatgcgcttcggtcgcgccactggtcgccgccgctggcgagatcaatgctccgacgattgagaacatgcccgacatcgccgcgccgatcacgctggaacccatagagggcacgccggtcatcgactggatcaagctcgccgatgatggttcgggcgacatcgtggcccgactctatgaggccgccggggcgaaagccaaggcaatgctgcatgtcggcggtacgctggacggctggacggtgcgtgagacgaacacgctcgaacaggatgaatcctacccggatgaacctgccggacttatcggcggcaagcagcaggccgaaggcgccgaactggcgctcaaccccttccaactgaccacattgcgcctaagccgcgcctgatacggattcggcccgggtcctgaacccgggcatggtccttgcctccaaccgtcaatcgacatagcagtcgaatcgatgcgttcgccaacggaattcagcctccccgtgagcgctcaacatgaaccggtcggcaatgaccgcgttcccaccatacgtttcgaagaacaaaccaaatatatcaaaggagaaaacaccatgaaaggcacattcaagaaggcggtcgcattgggctctgccattgcccttgtgggcggactcgccgcttgcggatccagctcgggcgacggcaccgccgaactgaagttccagacatggaatctgaagaacgagaagttcaccgactacttcgagggactgatcgaccagttcgagaaggagaaccccggtatcacgatcaagtgggtcgaccagccagccgacaactacgaggacaaactgtccaccgacgccgctgcgggagaactgccggacgtggtcgatatgggccctgaaccggcatatacgctggccagtgcgggcatcctgctcaatctcgccgatgccgtgccggaagccgaagatgacttccttccagccgcctgggacgccgccacactcaagggaaccgaccttgaggaaggcacctacgggttcccctggtacctcaactccggccccaccttctataacaaagcggtgcttgaggagtgcggcatcaccgtggatccgaacgacccgccgaccaagcaggacgacatcttcgcgatggccgacaccttcggctccaactgcggtggcaagtatgcactgacctccggcatcccatccatccaggacttcggcatgtatggcgtggaactgatgaacaaagaccacaccgagttcacgttcaacaacgcgaaaggcgtagaattcgtccagcactacatcgacatgtacaacgccggcgccttcaccgatgacatgctcaacagctccacctcgggtgagtccaagagcttcaacggtggaacccaggcgtttatgaacggcaacgcctacagtgtggacgatattcgcaagaacgccccgaaggtgttcgagaatctggcgatcaccgatttcatcgccaacaccaagccgaacatgttcatggagatgcttacggtcaatgccacaagcaagcaccaggaggaggctatcaagttcgcccgattcgtgaccaactcagacaaccagctggcattcgacaagaaggcgaacgtgttcccgtcttcgaagggtaccattgacgacaaattcttcaacccgtccgacgataccatggacgccgaagccatgcgtatgtccgccgatcagattcgcaacggtgagatttggggcccggcccagttcacctccgcctgctccaccatgctgcgtgaggaaatcgctcaagcgctgcaaggcaagatcacggccaaggaagcgcttgacgccaccgtcaagtactgcaacgaacggctctaattatggcaagcgaagcgaaatcaaggaagcgcgcggccaaggcctcacgccaggcggggctgggaccgaacagtagcggacgcattgttccttggctgttcgtgctgcctccgatcctatggatctgcactttctccctgttcccgttcttcaatacgatcaggctctccttcaccgattccaccctgctcaagcccggtacgttcgtcggccttgaaaactacatcgacatgttcaccgaccgccgcttccagacggcgttcttcaactcgtcgctgtatgtggtgtgcatcgtcccgttcatggtgattctgcctcttatgctggcctccctggtggccgagaagacccgcatcatgaacttcttccgcaccgccttctacacaccggtcatcatgtccagcgtcgtcgtcggcttgctgtggaccaatatcctcgataaggatggtctgctcaacggcacgttcaaggcactcaaatggatcaccacgccaattccgttcttgaccgatcgctggctgctgcttttcagtgccatggccgtcacgatctggagtggtctgggctattacatgcttatctatttggctaacattgccaatatagacagcacattatatgaggcggcttcgattgacgggtgcggtggcatccgccagttcctgcacgtcacattgcccggatgcagaatgacgatgatcctagtcatgctgctcagctcgatgtccgctttccgagtcttcggcgagatctacatgctctccggaggttccggcggcgtcggtggcgccgatctgacgatgaccatgctcatcaagcaggaaggtaccggcatcaacgcccgaaccggctactccggtgccctcggcatggtgatgttcgtggtgctcggttgcatcatcggcatcgaatggttcattcagagcaggagcgaagactgatggcaggcacacacgcagtcatggaaaacaaatataatcatgtcactccgggcaaggtcgttcgcatcatcgtgctgatcgctctgctgctcttcctggcggcacctctgctgtggcagatctcactggcgttcaaaggtcccaaggacgacatgtacgccgcgccctacctcatccccgttgacccgacaatccagaacttcgtcgatgtgttcaatcgtctgccgttgctcttctacgtgtgcaacacgttgatcgtggcggcattgaacatcggtggcaacatcatctcaggatgcttcgccggctactcgatcgccctgctcaagttcaaaggcaaggggctggtcgtaggcctgctgttcctatcgatgctggttcccggtgagacgatcctcatctcgcagttcctgattatccgcaaccttcagctgcagaacaacctgatcggcgttgccttgcctggattggtcagctccatgaacattcttctgttcatgaatgcgttcaaggccatacctcgcgagatgatcgaagccgcagaggtcgatggagccaatgtctggcaacggttctggcgcgtatgcgtacctcaggtcaagggaaccatggcgttggtcggcatcttctccttcatgggatcgtggaacgacttcctgtggccgttaatcgtgctgactgatgactcgcactacacgcttacactcggcatgagccgtctgcagggcaccttcgtgtccgatccgcgtgtggtcgcagccggcaccataatcgccctcgtcccgatcatgatcttcttccttgtcttccaacgttatatcttcaatggcctggaagctggatcggtcaaggaataatcaaaggttcaccatgaaattcggagtcaactacacgccttcgggcgaatggttctacacctggctcaatcccaaatgggaagtcatacgccgggatttggcgcagatagccgagctgggtgcggatcatgtgcgtatatttcccctgtggacgctgctgcagcctaatcgaacttggattaatcccaaggcattggcagatgttcgccgtatggtcgaactcggtggagaagccggtctcgatgtctatgtggatgtgattcaggggcacttgtcgagtttcgatttcgtgccttcctggctggtctcctggcatgaaggcagcatgttcaccgatcagtcggcgatagaagcccagagtgcgttgactgaggcgatttacggtacgttgtctgacatgaaggcctttgcgggccttacgttgggcaacgagtgcaaccagttcactgatgccacacatcccagacgcatgccggccaatgccgagcagattggtgaatggctggatacgcttatcggattggttgccaagcgatgccggcgcgatggccgtctaatcgcgcatagcgaaaacgacgcaatctggtacgccgatggccatgccttcctgcctagatatgcttcatgcaagggcgacgtgaccaccgtgcactcctgggtattcaacggtaccggacagcattacggtccgatgtcatgcgaaagcctgggacacgcggcctggctcgttgaactatccaaggcattcgctgctgatccgcatcgcccggtgtgggtacaggaaatcggagcacctggcaatgtgatcgattccgccgatgctccggagttctgccggcgctcgattgatgcgattgctgactgtcctgatgtgttcggcgtcacgtggtggtgctctcaccgcatcccctcggcattctcggatttcccgttcttcgagcaccagcttggcctgttcgatgtggacgggactctcaccgacgttggcaaggcgttccgagacgcaatcgccacccaccgggatacggttgcaccgccacgcacgacagcgattgtcatccctgtggatgaacagggcgacccgctcatgcgagctgctcaagctccgggcggctcgctcttcgaggcatgggcgaacttgaatcgtcagggtgaaaggccatgcgttatcacctcgcttgatgctggcaatccggccaagctcgccaatcggggcatcgtccgccttgagcgcgtcgaactcgtggcgggccatgcctacaatgcggtgtccgatccagctttcgagcataaaggcgaatgatgacgcattgacgaacggtcatacgatgtagtacaaaccgttcgtcattgtccggacatccagacatcgaaataaccgaataattgttcgaagttcctcttcgaaggggccggctctcctcggcttgaacttggcggccggcctttctataacagacgatgctattccttgcaagatgttggcactcattacatttgcgcatccggcgcaccggtacgtaccggtatcggtgcgccattgttcacacacatcgcgcatccaatgggggagacgacgtatggtagatgcgacgctgttcaccggtcagccgccgaatagtgatccggcggcccgccctgaagccatcattcggggggatcggtggcgtatttcgattctgacggactctttggtgcgtttcgaatggtcggatgccggcgtcttcgtcgacgaacgaacgcaaagcgtcgtcaaccgtgatttcggagagcctgcggcatacactgttcgccgtgatgccgatggctggctcgatattgagaccgaacggttacgtatcgtttatgatggaggcccgttcactgccgagggcttggcggtaagtgtcaaggattcgctgtcacaacacaacacttggcgttacggcgacgctcagaatgccaatctgggcggcactgtgcgaaccctcgaccagattgacggtccgaccgaactcgaacccggcctgctgtcgggtgacggttggatgattcttgacgattcagacgacaatctggtagtcgaagcatctgaagtcaatggcagccccaatccatttggctcatgggtggtccgtaagccggcctcctccaccgatctgtattttttcggatacgcgcggcgtatccacgatgcactgcatgactattaccagctcaccggaccggtccctctattgcctcgctgggcgttgggcaactggtggagtcgctatcatcgttacagcgaaaccgaatatcgtacgctgatagaacgttttgaaacagagggcatccctttcaccgtcgcggtgcttgacatggactggcatgtgaccgatcccgatccgtgctatggctcagggtggaccggattcacctggaaccgcaccctgttccccgacccggaacgttttctgggatggctgcatgagcggggtctcaaaaccacgcttaacctgcatccgcgagacggcatacgtgcgttcgaggactgctacgatcgcatggctcgggcagtgggcgttgattccaagtccggcagctcgattgagttcgatgcgtcctcgccggtgttcatgtccgcttacttcgatcaaatcatccacccgatggaatctcagggcgttgatttctggtggatcgactggcaacaaggcagcgtgactcgccagccgggacttgacccgttgtggatgctcaaccacctgcacttcctggactcggcctcgcgaggtcggcggcctatcacgttctcgcgctatgccggttacggctcccatcgttacccggtcggattctccggagatacggtcgtatcgtgggaatcattgaaattccagccgtactttacgacgatggcttcgaacatcggctacggatggtggagccatgacataggcgggcatatgttcggctaccgggacgaggagctggagacccgatggtaccagctcggcacgttcagcccgatcaaccgtctgcactcgaccgactccccattcaacggcaaggagccatggaacttccactccccggctcgcgaggcgatgatagccgcacttcgtttgcgccatagactcatcccgtacctgcatacgatgaaccgtcgtgcggcttatgacgggctgccgttggttgagccaatgtactggaaccacgggggcggcaccgtgcccacggaatttgagttcggcaccgagctgatcgtttcgccagtgctcgaaccggccgatcaggccgcaggccgtgccaaagcagaggtctggctgccagtcggccaatggttcgacttcttcgacggaagacgttacgtagccgacaatccggagggccgcacgctcggtgtatggcgtactctcgaccgtatcccggtattcgccaaagccggaggcatcataccgatgcaacgtctcgacggcgctccactcaacgatgtttccaacccgtcggcattcgatgtactggtatttccgggcgcggatggcacgttcacgctatgggaggatgacggcgagtcggtcggcggagaatgggcttcgacccgtcttacgtttgattgggtgcgcggcatgttcaccgtacatgcgcttgacggcgacagttcgctggtgccgagctcacgcgcatggcgtctcatattgcgaggtgtggaacagccggacggcgatttgccggcatcggtctctatacgccatggcggtcggccaatcaacggcacagtcgactatgacccggatacgttaagcctaagcgtcgaggtcggcgctctgaatgtggacggcgacctgacgattcacgtggctggaggactttcgattgcgccgtcgccggtcgagcgagacgccttcgacatactcgccgacgccaagatgcactatttcaccaaggaacgggcctggcaatccgttcagcacgagggcatacgcgcgctcgccaccctgcacacgctggaaatgccgccgggctactacggggagccgcggtggttttcctcgcatatgccgcaaggcgtcatcgaggcgttgtcagaggtgttgctgcgcgactgaacaggcgcgcgggccccaagcccatacagatatgtcccgacgcaagaatgcggcggggagaacaggaaaggaaaccgatgaacaagacaatgacgtggcgccgggtgctggcggcctctcttgccgcgatgcttgcgatgtcgctggcggcatgctcgggaggcacctccgcgaccaagtacacgatcacaccggagaacgagaatgaggagcttgtgctgggcaaccggcccgaggcgtcctactggttcccggaagatctgctgaagtggaatgcggacaaagacccggatctagcatacaatgtgagcactgtgccgttggccaagcgtgtggccaaggccgacctcaaaccagtcaatgacacgcagaacaccgataccaaggtgatggccatatcgatcatgaactcctcgacaagcggcaacgccccgcatggcctgaacaccgcgaacgcgaacacgttctcgtattggcagtacgttgacgagcttgtgtactggggcggctcttcgggcgaaggcatcatcgtgccgccgagccccgatgtgactgacatgggccataccaacggcgtgccggtgctgggcacagtcttcttccctcagaacgtatcaggaggcaaggtcgaatggctggaccagacgcttgcccaaaagtccgatggctcgttccccgtggcggacaagctcattgaggtcgccaccacgtacggtttcgatggctggttcatcaaccaggagacagagggtgagaatgaaacctcgctgggagccgactacgcgacgaagatgcaggcgttcatcgcctacctcaagaagcaggcccccgacctgcgtgtcgtgtattacgactcgatgaccaaggacggctcaatcgattggcagaatgcccttaccgatgaaaactcgatgtacatgacggatggcgatcatccgatagccgatgagatgtttctgaacttctggtggaccgaggacaaactggccggcgacgacctgcttgccgcctccgcaaccaaagccaaagaactcggcatcgacccgtattctctgtacgccggtatcgatgtgcaggccgacggctatgacaccccggtcaaatggaacctgttcgccggcaaggatggcaagacgcatacctctctcggcctgtactgcccgagctgggcatattggtccgccggcaatccgaccacattccgcaaaaacgagagtcgtctatgggttaacgatgagggtaatccatcggtgagcactccgtatgaggacgatgagaagtggaccggcgtatccaattacgtggccgagcagtcggctgtcacctcgctgccgtttgtgaccaacttcaataacggttcgggctacagcttcttccgtgaaggcaagcagatttccaagatggattggaacaaccgttccgtcagcgatatccagccgacctatcgttggatagtcgccgatgagggcggcaataagaccaaggccgattacagcgatgccgacgcctggtacggcggatcgtcactgaagttctcgggcaaggtcgccaaggatggcaagaccatggtcaagctgtactcggcgagcgtcaagacaggggcaaagccgacgctgtcgattgccgccaaggccaatgtcgataccgatcttaaggccgtgctgaccttcgcggatggctcggtcgaaaccgtcaatggcaagaagaaggtcggcaacgattggggtgtcatcgactacgacatcgccaagttgtcgaacaagacgctcaccggcatcgacttcacctaccagtcttccgaggataagaccggctacgagctgttgctgggcaacatcacgctcaaggatggctccgaggagaccgagctcggcaaggtcaccgaagtcaaggtcgatgacagcgagttcgacgatgacgccctgtatgccggtgcccgcatttcatggaagaccgatggcaaggctccggcctacgagatctaccagatcaacgaggacaagagccgttcgttccttggcgtctcaaacgtcgagaacttctatgcaaacgcactgacacgtgtaggcgagaccaataacaccacgttcgagattgtgccggtagaccgttatggtacgcaaggcacgagcgccaaggccgatatggattggcccgacaacagcaagccgaaagccggtgccacggcttcgcgcacactgctgaatgtgggcgacgaagtgacgttcacctccgcaagctcgaagaacactgccgaggtcgcctggtctctgcccggatcaagcaaggagcatgccactggcaagtccgtcaccgtcacctacgacaaggagggcgtgtatgacgttgagatcaccgcgaagaacaagagcggcgaggccactgcgacgctgaaggggcagattgtcgtctccgcggatgtcatggaccttgtgttgctctctcaaggcgctcaggtcagcgccgacgggttcacgaacggcaacgagaagcctgagttcgcggttgatggcgacgtgaagaccaagtggtgtgtcaccggcccggctccgcatgagcttgttgtcgatctcggcgcacccaagaccgtctctcaagtcgatattttccatgctcaagccggtggagaggatgccagcatgaacacgcaggaatatgcgatcgaggtcagtgaggacggaaccgaatacacgcaggtcgcgttggtcaagggcaacactgaaggtgccacgtccaacgcctttgccccggtcaatgcccgttacgtcaagttggtggttaacaagccgacgcagggcagcgacactgcggctcgtatctatgagatgcaggtacgtggcgcagacggcgcgatcctctaggagccgctgtttgttctgacgaatacatcgcttccgggtgagccggtatatcggtgttacccggaggcggcatctcggcccgtatcgaatgcatgccgtgcgaatttccactttgtggtgaatgagggcaaagaagttctgtatcgatgtgggccatgccatatactaaactgattcatgcagtatgcatgcaatggtgagtgctatcgaagtccgttttttgaggttccccattgcagggaaccaacatatcgcgaaacgggagagtacgccgatgacgagcacggagccgacgatgaacacaaaccccctccacttggagtcaggagccgcgcatccggtcgccaaaccgcatcgggtgggcctcaaggacatcgccgacgagctgggaatctcgcagaccgcggtatcgttcgcgatcaacgatcgtcccggcgtctccgaagagaccaaaaggcgcgtcaaagaggctgcgtcgaagcttggctggagcccggtgtatgcggcgcaggcgctcggctcatcgaagaccatgacggttggcttcgccccggcacgctcctcaaacggtcttcgggacgaaggcttcatgctgcatttcatgaccggtttgcatgaatccctgagtctcaaaggttacggtctgttgtatcggccctgctcatcggtcagggaagagttgtcggtctacgaggattgggctcgacgtaagcgtgttgacggtgttatcctcgttgacctgcgtgctgacgacccgcgccccgcgctgcttgctcggctcggtgtgccggctgtgcttgcgggaggtccggatcctgagaacatcgtgccctcgctgtcgattgacgattcaggcgccatggaaacgattctccgacatttggtatcatgcggacaccggcgtatcgcatacctatcgggggaccgcacccttgactattcgcgtgatcgcgaacgaatgttccgtgaattcgcaaagcgccgcgatcttgagtcgatccgtgtcgaatacaccaacttcagcgtagacatcgcctcggcaatgacgcttgcaatgttgtgtggaagcaatccgcccaccgctttcatctacgagaatgagacattggccgcagccagtctgcatgccattaccgagtggctgctcaatacgccgtccaggaatccggacgcaccgcgatatccgcataatcttccggctatcgttagcttcgaggacagtttcttgtgcgtatcgatctatccatcgctcacgtcggtacaccgagacccgagcgtgtatggaatgaaggtcgccaaactgctgatcaaggtcatcaacggtgagacggtcagtggcaaccgccgcatcctgactcccaagctcgtgatcagggacagtaccagacttgcctgtgtctgattcgtctacggctacatcctgttggtggagcggatagaaacggcatgagacgggaataggcaaggtccgacgggagttttccgtcggaccttgcctattcgttatcacgaattgtatcgccttacgccgcgttcttcacggccgtcgcaatggacacagccgggtcgaggaacggaatcagcgtggactggaaggcatggtacaggtcggacttgcccggccagaccgtgccgatcacatgattgtcgccgtcaagctggtggaaccatgatccgccttcgtggtcgatgacgtgctcgtcgacgtagcgggcgaacgtggcgtaccagttggcgtatcgtgcctcgccggtggcagcgtgcagcgtggcggcggtgttcaacgattcggcggccgtccaatgcatgcggtcggtgaccaccggtgtgccgttccagtcggtcgtatagacgagcccctccgcgccgtccgcgttccacgcatcgtccaccgcccgcgcaaacaggtgctcggcggcgtcgatgtagggccgcgcgccgtctcggttggcgaaggagctcagcgcccactgcacgatgaggcgcgcccattcgatgccatggcccggcgtggcgccatacggtttgaactggtcgtccttcttgtcggcgttgcattcgaggtccaacgaccagtcggatttgaaatgctcggggatgcgccaccggttgtgtgccgcccattcgatgacgtggtcgatgatgcggccggcgcggacgcgataggtgttgttcccggtggcgtcggccacggccaggaacgcctcggtggtatgcatgttggcgttcaggccccgataggggtcgagtgcggtgaatgccgtgtcccaggtatcgacggccaggccgatctcgtcgtcccagaaatgctcgtcatatgtggcgagcgcctcgtcgagcagttccttggcacccggacgcccggccagcagggcggaggacgcggcgagaatcacgaaggcatgcgcatagcagaccttgcccggcgcatgggaaccgtcggcaaacacctgcggataccagccgccgtgctcgtcatcgtgcagaatgccggtcaatcccctgagcgccgcgtcgaccagctcgcccgcacccgggtatccgagcatggcgccaatcgaatacacatgggccatacggctggtgatccacgtttcgacgccgtgtgaggggtcgagggtgccgtcggcgttcagccagccggaaccgccatccggcgctgggaagcctttgccgaacttcagcagctcgtaggtttcggaagccatgaaaatgcggttggcttcggtgccgagcgtataacgtgggttattggtcataatgattgttcctttccttaatgagaacatgcggtgggtgcgcaatgagcatgcggcgggcacgtcttagtgcttcacacgaatgtcgaaatagtccatgaccagttcgcagaacatcatattcgaccagctgaaccattcgcgcgtgtacttggtcggatcatccacgtcgatgccttcgtgcatgagatgcgtaccggcgtcggtggccacgagacggtcgagaatatgcgccttgaaatccttgctgtcgctggtcatcgcctcgatggacagcgcgatgggccacacatatcgtggcggcgtatgcggcgagccgatgcccttgaggtactcgccctcgtaatagtacgggttttcgtcgctgagcagcgtgcgtcgggttgccagataggtcggatcgtccggtgcgcagtaccccaagtaaggggccgccatcaaggagggcacattgctgtcgtccatgatattgacgtgacccagaccgtcggtctcgaacgcgtagattgtctctccgttgcggttcgtcgtcttggcgtgggcttcgatgccttcggtgatggtgcggcgcagcttgccggcgcgtgcggcgatatcggcgtcatgcagaatctccccgccgaagatgcgttccagatagcccatcaccactgcggcgaacatgttcgagggcaccagatagtggtaggtgcaggcgtcgtcgctgggacggaagccggaccaggtcatgccggtgtacgccaccggcaaccccttgccgtcattgctcagcgattcggtggggatgtccgtgtcgcggatgaagaaatacggggagttctcgtgatgctgttcggtctcgaagacgtcaagaatcttcttgacgccggcaatgaattcgtcattgaaatgatcggtgttgccggtgttcgcatacagcatccaagccagctgaatggggtagcacagcgagtccacctcgtacttgcgctcccaaagccagggactggagaagtcggactgatcatccttgtcccaggaagcgccgttcggctcctcgttgaaggcgttcgcatacgggtcgatggtgatgtagcggaactgctgccgcaccagaccggcgatcaggctcgcaatgtcgtcgtcttcggtggcaagggtcagatacgggcgcaattgtgcggtcgaatcacgcagccacatggctgggatatcgccggtgagcaggaatgtggtgccgtcgtcatgccgtttgaccgtggtggtcagggtgttggcaaagcaggcgttgaagttctcggcccaggcggcgtgttcggtgccgcacaggtccgtgatgtgctgcatgaaatccgagaccgacttcggtatcgcggtggtcgtcataattcaacttctttgtttgagggatatacatatcaagggaacagcattattctaaaccgctttagttgaagacacgcgaaaggatgtgaagagcatgagtgtgagcgcaccatatgaaaaaccggtgagatttcctgttcggagaatctcaccggttgcgatcagtcgattcgtgaagtcgcacgaatggcggataaggggatgggtggattacttgccgatttcagccaggtagtcgggcatctcggccgggtactgcggccaggcaccggcctgggtgcagacgtaggcggcggtgttgacggccttgcggtgggcttcggcgagcgtgtcgcccagcaggatgcgggcggtgaaggtgccggagaaggagtcacctgcacccacggtgtcgttcacctcgacgtgcggagtgtccagcgtggagacctcgcccttgcgggagatgatggtggagtaggcggagccggcggtcagaatcacgtagtcaaggccgaattcctcgatgaaccagcgggaggcatcttcgccggaggtgccgcggatgtcgaacatgtcgcgcagcagcaggagttcctcgtcgttgatcttgaagacggtggccgccttgaggagttcctcgataagttccttggagtagtggtcgccgcgcaggttgatgtcgaagaacttcatcgcgcccggcttggtgtgcttgagcagctccgtgatggtggcgtgcgattcgggggagcgcagggccagggtgccgaagcagacggcgtcggccttggagaccacgtcgatgagctggcgggtgtacaggatgtggtcccaagccacgcccttgacgatggtgtactccgggatgccgttcttcagtgcgacctcgacggtggaggtcggccaggcattgcgctggatgacggtgttgataccggcctcgttggccttggcaatcagttcgtcgccgagttcatcctcgccgaccgcgctgatggcccagccttcggtgccgttcttcatcgcgtggtaggcgaagttgacgggggcgccgccggctcgcttgccgctcggcagcatgtcccacagcagttcaccgaggctcagaacgatcggggtagtcatggttggtttcctttcctttgtttcctttatcgggtgtttcgtatggaaaatcttgtgatgtcggcgcttggtttaggagacgtcgaagaacaccgaggggtgttcgaggaattgggtcactgccactgctgcggcaccggagaccgtcgcgtcggcggacaaggtggataggctgatggaagtggaggcattgatttcggggatggcccgttcggccaccgtggcgcgcacctcatcgagcagtatcgggccggcttcggacacgatgtcgccgatgatgatgtgctcgggattgtatccattgaagatggtgacgcatccgtagccgacgtatcgggcgacttcgcggacaatggcgattgccgcttcgtcgccgtcgccggctttggcgaacagggcgcgggcggcttcggtgtgggtcatatcggccgcgccgggaaccacggtgccatcggcgatgagcgtatcgtgaatggcgggggtggagcagtagcgttcaaggcagccgacgttgccgcaatcgcaggggcggccgttgacgtcaatggagatgtgtccgatttcggtggcggcaccgaggaagccgttgatgaggcgaccgttgtcgatgacgccgaggcccacgccttcgccgaccagataataggcgaggttgtcgtcggcgtgcaccgacgggtcgaagagataatgtgcgagggcgccggcgcgggcgtcctgttcgatgaacactggcacgcggaaagcggtggcgaattcgtcgatgaagttgattttgcgccagccctgcatgttggacaccacggcggtgcggcctacgttacgcagataggggccgggcactgccatgccgatggccacgatggatgggtcgttgtcgagcagttgttcgacgcgctggtggatggtgacgatggagtcgttgatggtgttgtcgcacaccgtgggcaggttttcaaagctcagggtgttgccgcacaggtcgaacacgccgatctgcaccagcgagcgggcgaatttgatgccgatgatgcggaagtgcgtggtgttgagcttgagtccgatggaacggcggttcttggagccttccagatcgccggtctcttcaatcatgccggcctcgataaggcgtgcggtgattttggtgatggccgcgggggtgagttccagtgccttggcgatttgcgcgcgggaactgatgccgttgtgatacaggtgcttgacgatgcgggagcggttggattcggagacactggcctgggaagtggcgtgggtggtgtttgttgccatcggtcttaagtcctccttgtctgcaccgctgcgagttgttccgctcgtctttgaatctgaacttgattaagatattaacgctgttaattgattgacgcaatcaatatgtcattcggcgtgtcgtgcatgtgagtgtcgtcttgggtgaatttgttaagatagttgtcaatagtcagatgtacactgatatcaagcgaaacgttcgatgaagaacaggggaggactgatgtccgaaaacactatgaacaatctcaaaatcggtgttgacgtgggcggaacaaaaatcgaagctgtgctggttgacgcaatgggcacggtattgggttccgcccgtattcccgccagacatggcaacgatgccgtgatcgaagacatcgtcgctgtagcgcatcaggcggcgggtgagcgttttgacgaggtgagggccatcggtgtcggtaccccgggcacggtggattcggccagcgggcatgtgggcaatatcgtgaatctcgacgtggtctcgctggatatggggccgttgatctcgcagcgttcgggcgtgccggcccatgtggaaaacgacgtcaacgccgccgccgtcggcgcggccaccgtgttgggcggtgcagatggcatggccggtaccattgcgttcctgaacttcggcaccggactggctgcgggcattgtcgaaaacggcgtgctgatgcatggctatagcggtgcggccggcgaaatcggccatatcccagtcgaacctcatcgcctcaagtgcccttgcgggcaatacggatgcttggaaaccgtctgctcgggcgcatccgtgggacgtctgtggcccaacgccgacccgccgatgcccgacctgattcgtcgcgcgaaaaagcgggaggccgaggccgtcgatgtgctggacatggtagtgcgcgccatcggcgacactatccagattttggcccaatccgttgacccgcgactgattgtcttgggtggcggcatggccaaaaccggtgaaccgttggtcgaggtgatcacggctgagctgcgccggcgcgaatcgcaatgccgattccttgaaacgctggacctgccggcccggctgcgtctggcacccgtcgatcaaccggtcggagccatcggtgccgccatggcggcatagcactggcatagtgccggggcatggaagatgaggcgtcggatttgtctccgagaccgcatcttccatgcggtcctatatcgctttatgtcgtgctgtgccgcgctgtgccgcgcttggccttgcgcgtttcgttgccggggtggccagctttatttggccaagtgttggaagaccacggcgatggcctcgccctgtacggtgatgtcgggtccgcattcgcagcgccggatcaccgtgtgtttatggaaggacgaggacgtggcggcatccagatactgctgtgccgcgtcaatgaacgtctcgttgatgatgttcggctgcccatagacgcatacgtctgccatatccaaaaggcccacaggcatggacagggcctggccgagatagcggcccgcccgagcgaggatattctgatgctgctccacgtctgccgcgctgagctgctttttcaatgcggttccggaaatcatcgtctccaggcagccgcgcttgccgcaagggcatagcggcccatcaaggtcgatggaaatatggccgatttcgccggccgcatgcagttcgccgattaccggcgtgtccgagagcagaatcgccgagccgatgcctctttcgatgcgcacgaagagcatattcggcccgccctggccgaagaaacgttcggtgagcatggctgcggtgacgtcgttgctgacgttcacctcaagtccaaaatgctcggcaatcggcgtggacaggtcgagattgttccatccgcgcatcgtggaggagcggaccacgccgttatccaccacgccgggggaggagactccgatgccgatgacctcgccgtcggacatgcccagcatcttctcgataagttcgatgatcacatccacggaaacgaatgagccggtgttcagggtgacttcggcgtggcgtagcggctggccgagcagattggtgactgcaccgtgcagcaggtgctcctgcgtcaggtcgatgctgatgatgcgcagtcgatcgatatcgatgctcagcagtgtgcctcgtttgcctttgccgccgctgggtgcctgaccggtctcgcgcagcaatccttcctccagcatctgaccgaccacatcggaaacggccacgcggctcaatccggtgcgtcggccgagctcggcgcgcgaatactggttggtggggaacagcaacctgaagatgagttggcggttcttgcggcgcacatcggcgggggaggccttggccgcatggtcgtcggtcgttgtgttgagaccgagatatgacatgtttcctcctgcctgatggtgagcgagtgaacggcgattgttgttccgtacacagcttagacggtgaagcacaatttcgtcgttgaaactgttatgaaacttcactaataaattccagtgtacctgtgtgaagcgtcaggaaacaccgtgagtgttcataaggtccaaaattgttactattattaacaaatagcgaatcaccaatcgtcactatggcgaacggtggttggaacgccgcgcggcacccggacgtgacaaggatgttgccattatccgcaagacgggcggcggtacggcgactcgcatcgggcgggccgcacggaactggaggaaaccgatgccggaaatcatcattgtcaagaacgaagccgaggccggcgagatctacggccgttgcgtggcggacctgatcaaagcaaagccggacgctgtgctgggcctggccactggttccagcccgctggccgcctatcaggcgctcgccaagatcgtcaaggacgaggccattgacgtttcgggcgtgcgtggtttcgcgcttgatgaatacatcggactgccgctgacccatcccgagtcctatcatgcgaccatccatcgcactgtggtcgaaccgctcggcctggacccggccaaggtccatgtgcccggcgacgtacttaacggcactccgcttgaagacggcgacaagatcgcgctggccggcccggcctatgatcgtgccatcgaagccgctggcggcatcgacgtgcagatcctcggcatcggcactgacggccacgtcggcttcaacgagcccggttcctcgctggcctccggcactcgcgtcaagaccttggccgaacagacccgcatcgacaacgcgcgcttcttcgacaacgacatcaaccaagtgcccacccactgcatcacgcagggtattggcacgatcatgaaggcccgtcacctcgtgctgctggcgttcggtgccggcaaggccgaagccatcgaggagacggtggaaggcggcgtgtcagcgttctgcccggcttccgcgctgcagatgcacccgcacgccacgattatcgtggatgaggaggccgcgtcccgcctgcgccacaaggactactaccgttacgcctacacccacaagccggcctggcagggcatctgagttatcgtgtgctggctcccgccagcgggagcgcatgagcggtaaggagaacaacatgtctgataggaacgagatagtctcgcgcgtgaccgcggcactggagggcaagccggctccggtggcgattcgtaacgcgcgcaaggtggatgcgcgcggcgaacggcgcggatattgggtcgtctccgatgccgccggcgtcatcgtggcggccggcacgggggagggggccttcgagcactgctgccgcacggtggggctcgacccggccgatcgcaacgcggtcatcgacgccgaaggccgtattctgacccccggctacgtggacatccacgcgcacggcgcatgggagaagagcttcgatgacgggccggacggcatcgacgtggcgcgggccggccacgccgtgcatggcaccacgcgccaggtgctctcgctgatcaccaaccccgtggacgtgatctgccgcaacatccgcaccgtccgcgccacaatggagtccggccgccccgacatcctaggctgccatctggaaggcccgttcctggccctggcccgcaagggcgcacatgacccggaatgtctcaaggatccggtgcctgacatcgtcgataagatgcttgaggcctccggtgccgaccccgcctccggcaagcttggctgcatccgccagatcaccatcgcccccgaactgccccacggcatctccgccatccgccagttcgccgctgccggcgtggtgccggccgtgggccactgcgacgccgactacgagaccgccaaagccggcttcgacgcgggcgcgggcatcatgacccacatgttcaacgcgatgaacggcctgcatcaccgcgaacccggtccgattccggccgcggtggaggacccgcgcgtcaccatcgagctcatcaacgacggattccacgtgcaggatccgatggtgagcctctccttccggttcgcgcctcaccgcacggccttcgtgaccgacgcgatggccgccaccgactgcccggacggcgcctacaagttgggcgcgctggacgtgaacgtggtcggcgggcatgcgcgcctggtctccaacggcgccatcgccggctccactctgctgctggaggtcgccgtgcgccgtgcggtgtgcgaactgggcttcagcccggtgggcgcggtcgaggcggcaactctgacgccggccaaggcgttcggcttcgaccggccgaacccggtcaccggggcgccgatcggcctcatcgcccccggcttcgccgccgatttcaaccttgcggacccggccgactggacggtcgaacaggtgtggtgcgcgggccgcaagctcaagtagcagtaggccgaccggttgacgaatggaaggcattcgtctacgaacatggtcacatggtgagatgatagtatatttgtctcaccatgtgaccgttattcacgtcgtaatacaagaatccgtaatactgctcgataccgcataaaaccggccttggtcgccacaagcgaaacataagtcgatgactatggaaacgcagaggtaacacatccgcaccatagtcaggcggtaatccacgcccgcagtgatgacgtggaaacaagttatgagagaggattcctgttgaattccaagaagattctggccgccgccgtctccgtggccgccatcgcatccctgaccgcctgcggcggtgtgaaggatgacaccaccgcaggtgccgattccggcaacgccatcaccatcggcaccaccgataagatcaccagcctggaccccgccggctcctacgacaacggttcatacgccgtgcagatccaggtgttcccgttcctgtacgcccaggattacaacacctccgaactgagcccggacatcgccgccgatgacggtacctggaacgatgacggcaccgaattcaccgtcaagctcaaggacggcctgaagtttgccaacggcaacgacctgaccgcttccgacgtcaagttctcctacgatcgcatcaagaagatcaacgacccgaacggcccgagctccctgctcgccaacgtcgaatccgtgaccgccaaggacgacaccaccgtggtgttcaaggattccgtgcccttcgacgtgaccctgaagcaggtcatgtccagccccgccggcccgatcgtcgatgaggataccttcgacgccgacaagctcgccgacgccgacaccatcgtctccaagaaggccttcgccggcccgtacacgctgacagccttcaagatcaacgagtccgccgcctacgccaagaacgactcctacaagggtctgaccccggccaagaactccgtcgtgcaggtcaagtacttcgccgacgcctccaacctgaagatggccgtccagcagggccagatcgacgtggccaaccgctccctgagcccgaccgacatcgaggacctctccaaggactccaaggtcaaggtcgtcaagggcccgggcggtgaggagcgcttcatcgccttcaacttcaagattcagccctacggcgaatcccagcccgatgccgacgccaacaaggccaaggccgtgcgccaggccgtcgccaacctcatcgaccgcgaagagctctccaccaaggtctacaagggcacctacaccccgatgtactccttcatcccggacggcctggccggtcacgatgacacgctgaagtccgcctacggcgacggcaacggcaagccgagcaccgagaaggccaagaaggtcctcgccgacgccggcgtcaccaccccggtcgacctcaagctccagtacaacaacgaccactacggctccgtctccgccgacgagtacgctgccctgaagtcccagcttgaggcaggcggcctgttcaaggtcgacatgcagtccaccgaatggacccagtacaacaaggatcgtgtggttaccgacgattccgacggtgtgtacccggtctaccagcttggatggttcccggactactccgacccggacaactacctgtccccgttcttccgcgatggtaacttcgtgaacaacggctactccaacaaggaagtcaacgacctgatcgtcaagcaggccggcgagaaggacgagtccgctcgtggagacatcctcaagcagattcagaagctcgagaccgaagacctctccaccatcccgctgctgcagggtgcccaggtcgccgtcaccggcacctccgtgaagggtgtcaccctcgacgcttccttccgcttccgctatgcctccgtcaccaagggctgatccagcatgagctcccctctttgaggggggggggagctgtctgccgacggcagactgaggggagcccaactcgtatgactcccctcagtcggcttcgccgccagctcccctcggagaggggagcctttattgctttatataccgattaccaacaccaaggagcatcgcgtgtcagacagcgccatagcgacctccagcaccactccggcgaaagccaagacgaagaagaaccgactgtcaggtagtttcttccgcttcgtgctgacgaggttccttctcattattcccaccgttttcattctggtcaccatcgtgttcttcgtgatgcgcgccaccggcgacccgatttccgccgccttgggcggccgcctgacacccgccgaactccagcagcgcatccacgcggccggctatgaccgcccgctgattgtgcaatacgtcgactatcttggtggcctgctgcacggcgacctcggcacgacgctgaccgataaccagccggtgatcagcatccttacgcactacggcgccgccacattcgaactggccttcctcgccctgatcgtggcgctgatcgtcggcatcggcctgggccgactcgccgcccgcaagcgcgaccgtgccgccgatgccggcatccgcaccttcgccatcctgtgctacgccaccccggtgttcttcctcggcctggtcctgaagctcatcttcgccgtctggctcaacatcctgcccgcctccggccgctccgacctgaactccgaaatgcagttcacccgtctggtctcgccgaccggcttctacatcatcgacgccatccagctcggcgacatgaacgtgctcgtcgacgtgctgcgccacgccgtgctgccggccgtcgccctaggcctcctgaccgccggcgtgttcatccgtctggtacgcaccaacgtcatctccacctacaattccggctacgtcgaggccgcccgctcgcgcggcgtctccgaaaagcgcctgctcaacaagcacgcctggcggccggccctgatcccgatcatcaccgtcatgggcatgcagatcgccctgatgctcgccggcgcggtcctgaccgaaaccaccttcgaatggaagggactgggcttcatgctgtcccagtacctgaaggcccgtgacttcgtggccgtgcagggcatcgtgatccttatcgccatcatcgtggccgtcgtcaacttcctcgtcgacgtcatcgccgcgcttatcgacccgagagtgaggtactgagatgaccaccgcatcccaagacaagatcaccgtccccggtgacgaccgccttaccaagctcaacgtcagcaccaagacgccgttctggaccaagatcccgatcatcaaggaactgcgcgtggcggtcggctggcagaagggcatgctgatcaccggtctcgcgatcaccgcgttcttcctgctcgtggccctcttcgccccgctgatcgccccctacggccacgcccagatcaaggccgccgacggcacgtccttcccggcgcaggccgcaccctccgccgaacacatctggggcaccaccgccgccggattcgacgtgttctcccgtgtggtgtggggcgcccgcaccgccgtcatcgccatcgtcgtggccgtgctgctctccatcttcgccggcgtgctgcttggtctggtgtccggctactacggtggctgggtggaccgcatcctggtgatgatcgccgacgccgtctactccttcccctcgctgctgctcgccattctgatggccatcatgatctcccacggccagtccggcctgtggagcggcatcctggcctccggcatctccatcaccgtggtgtacatcccgcagtatttccgcacaattcgcgccgaagtgatccgcatcaaggaatccgcgtatgtcgagtccgcgcgcgtggtcggcgcctccacctggcgcatcatgaccaagcacctgttcaagaactccacccgcacgctgccggtgatcctgacgctgaactcgtccgaagccatcctgaccctcgccggcctgggcttcctcggcttcggcatcgagccgaccgccgccgccgaatggggctacgacctgaaccgttcggtttccgacgtgaccgccggcatctggtggaccgccgtgttcccgggcatcgccatcgtgctcatcgtgctcggcatcacgctcgtgggcgaatcgctcaacgatctggccgacccgcgtctgcgcgcccgcaagtccgccggcgaagtggtcggatcgatcgaagacacgtccgtcgacccaaacgagaagccgaccgcacgcaacgaggtgatcgccgaactcgacgcgaacgtcgacccaccggccaccgtcaccgaccatgacccgaccatcgtcgcctccgaatggaccggcgaaggcaagccggaaggcaaggagtgagagatgagcgaagacaacaagaatctcgccgatatcaaggacctgtccgtctccttcatgaccgacgccggctccatcaaggccgtcgaggacgtgaacttcaccattccgcgcaagaccgtggtcggcgtggtcggcgaatccggttccggcaagtccgtgaccgcgcgctccatcatcaagctgctgccggagacggccaccacctccggtgccgtctacctgtccaagcgcgatggctccgattcgctggacgtgctctccctgagcggcgaacagctgcgcgaagtgcgtggttccgaggccgcgatggtgttccaggagcccaattcggtgctgaacccggtgtacaccatcggctggcagattgaagagggcctgcgcgcccacggcatgaaggacaagaaggaactgcgcgccaaggccatcaacatcctgaagaaggtcggcatcccggatgccgaaacccgcgtggactactacccgcaccagttctccggcggccagaagcagcgcatcgtcatcgccatggcgttggtgctgaaccccggcctgattctggccgacgagcccaccactgccctcgacgtgaccgtgcaagccgaaattctcgacctgctgcgcctcgcccgtgacgagttcgacgcctccgtgctcatcatcacccacaacatgggcgtgatcgcggacatcgccgaccaggtggtcgtcatgtaccgcggccacgtggtcgagcagggcgacgtggagcagatcttctaccatccgaaggacgactacaccaagcgactgctgggtgccgtgccgcgcatcggtcagaagctggtcgtgcgcgaccgcgagggcaaaccgatcgagcgcaaggccgattggcgcgaacagccgatcgccgtcgaggccaagaacctgaccatcacgtacccgggccatctcatgcagcccgacttcaaggccgtggacggcgcgaacttcaccatccaccgctccgaagtgctgggcctggtgggcgagtccggttccggcaagtccaccaccggccgtgccatcgccggcctgcagaaggtgtccggcggctccctgaacgtgctcggcatcgagatgaacggcgtcaaggagcgtgacttcaagcccaagcgcgcggacattggtttcgtgttccaggatccgggctcctcgttcaacccgctgatgaccatcgcggagaatgtggccgagccgctgctcgtgcaccacaagtacggttccgtggccgatgccaagaactatgtgggcgatctgctggagatggtccagctgccgcgcgcctacatgaaccgtttcccgcatgagctgtccggcggccagcgccagagggcgtctttggcgcgtggtttggcgttgaagccgtcgctgctgatcgccgatgagccgacttctgcattggacgtgtcggtgcaggccaaggtgttggagctgttcaagcgactgcaggcggaaatcggcttcgcgtgcctgttcatcacccatgatttggcggtggtcgatatgcttgccgaccgcatcatggtgatgcataagggccagattgtggagcacggcgatgccgaccagattatgcagcacccggagaacccgtacaccaagaagctgctggcctccctgcccgtgcccgacccgcgcgaacagcagcaacaccgcgcccacctccacgagctcctagcccaagaggcgtaatcgcatagcattggagctccctcgtcagagggagctaactttatatccgctagtactgctgcccatcgaactggaacagggcgtgggcgtcgccgtgttttttgttctcgatgtaagtatggaacagctccagccgctcgctcgtgctggccgccaggggagtgggcaggtcatccagatcgaaccagccgacgctcaggctttcctcgtcgcctacgaacggctcggcattgccgccgggcttcagggcgcacaggaacgaatgatccatgtacatggtgttgtcgccattggcgtaggtcagtaccttgtttgacgaggtgacggccaccaaatcggtgacgatggcatcgatgcccgtctcctccttgatttcgcgcaccaccgtgtccgccggctgttcgcccggctcgttgatgccgtagaccatcgcccattcgcccgtgtccgaacgacggcccaacagcagttgaccatgttcgttcagtacacaaccggtcacgccattgagccacaacagatcatggccgatcttcttacgcaattccaacacaaattccggagtggacacattgcctccttagtagaaaaaaggagctccctctgatgagggagcttaagggttacttggcttgggcagcctgcttaatatggtgcgcttcgcgcatgatttcattttcctcgcgcttgtcagcgttcggcgtcgcctacaatcagtccaccggactgattgctttacggctccgcatccacgcttcgacgtcgtcgatctgcttcgggatgccggcggaaatccattcggggccgttctcggtcatgagcacgtcgtcctcgatacggatgccgatgccgcggtattccggcggaatcagcagatcatcctcgcggaagtacagaccgggctcgatggtgaagatcatgccgggcgtgatcttcgcgccctgataggactcatagcgggcctgcgcgcaatcatgcacatcaagacctaggtggtgggccacgccgcaggcgagccaacggcggtgctgctggccttgcggggacagtgactcctcgacgctcaccggcagcagaccccaatcgtgcagacgctcggcgatcacacgcatgcaggcgtggtggatgtcggaataggtggcacccggcttggcggcttcgaaaccggcctgctgcgagtccagcacggcctggtacagacgcttctggaagtcggtgaacttgccgttggtcgggaaggtgcgggtgatgtcggccgtgtacagggaatcgacctcaacgccggcatccaccagcagcatgtcgccggtcttcaccacaccggtattgcgcatccagtgcagaatcggggcgtgggggccggaggccacgatggagtcgtaaccgatggcgttgcccagctcacgggacacggtgttgaacgcgccttcgaggatacgctcggaacgcggcttgtcgagcgcggccggcagtgcggagagcagacggtcgaagccatgcttggtggcgtccacggccttgcgcatttcgttgatttcgtagccgtccttgaccatgcgtgcctcggcggcgaactcgtgcagcttgtcgtcggatgcggagttcttgtccggatcggcgaaaccgttggcctcgcggatggattcaaccatcgaagtgatttgcgggtcggtttcgctgaccacgcgcacgcgtacggcgccggcttcggcacccacgtccttggacagggcgtcggccagctgggcgatgtcgtgggtttcgatgccggtcatcgcctgcatctccttgagaccggcacgcgggccaacccagtattcgccgtagtgggcggacatgaagaagtcctcggtggagttgtcggcgcgcggcgccacgaacagttccggagtgtgcgtcttgccggcggcggcttcgggggagtcggggtcgaccgggttcaggaccagcacggcgccggcctcgtaatcggaacccagaccggtgtagtaggcgaacgtggtgtccgggcggaacatgtaatcgcaatcattgttgcgcaccttcggctggccggccggaatgaccagacgttcgcccgggaaggccttgcccagcgcctcaaggcgggctggcgtgaacttggaggattcgagaggcttgatctccggatcatcgtcggcccagccggacttcatgaactccttgaatgcggccgactgcgggcgcagcgagcggttgttcacgcggtcgctcatcgactggttcgcgcccggtgccgtagcgcgctcttcggcctcatattccttgtccttggcggtgatcacttcacccattgccactctcctgtatgtagttgttgtcgaatcatcgattcccacctcatactagtcggctttatgcgatgtgccacgattgacggctgacggtaaaaccaagtacggaatttggacggtcttccggacatgcccatatggcgagtgcggcgggctggaatgcgggcccgtttattgttctcggtagggaaggagaggggcatgggcttgggctggagcttgccgattgatattgacatattctgtgggctgaatccatgtgaacccatgcgatgaaggtttatcgcgtcgcgggactcactgctatgcggaggtctccacctgaggcaccccggctttgatcagttttacccgcagcggagtacgttcgatgacgtcggcgtatgtgaaatggacgatttcggtggcaccggctcgtttcagtccctcgtcgcgtgcgcgttccttggccaccacctcctgaatgctgcggttatcggtcatggctgggtccacgtatttttgtgtgccgtcgtattcggccactatcacgcgcccgtcatcgagcttccatacgaaatcaacgcggtactcggtattcgtctgtgggtcggtcaccgttacctgaatacgcggcgtgaggaagcgatcttcgatgatggtgcctcgcgcgagggattctccaccattctcgctcctttcgtttgcatagcgcagcaggcggaatactcgggcataatcgattctccattgaacgcagtcggcggctatctcttccttggttattcccttggcaagggccgagtcaaagatcggtaacgcaaaccgaaaatcaaggtctatagcggcctcgaccaaggttctagccggtgatatcagggataggccggaggcctcgtaatgtgtcttcggattgttcatatcgggcatatagacatgtcgtaagcgctgatggcattgacgagatccatgatcggaagtcacgatggttatgcagtcatcatgcaaatgccattgatgttcgaatccataggcacttactgccaccaagccgccaaaaacccactgaggatgctcttgcgcaagagcgcgggctatatgcaacgttcgctccggcggcgtcaaaccatcccagtatgcagtatttgcataaagactgggaatgccgtcatacactttcaacaactcaccactctgggcacggcggcgtagagcggtctgttccgcttcatttcttgaatagacgcatctcagctcattctgcgcggctgatatgagcgaggccactgctttgtgtgtcttcatgacgtcgagcgtagccggaacgaagcagcgtaagtatgaatttcagccattgtggttctagcctcggagcttggctgtcttggagcgagatactcccgataatttcaaggtattaggccgctaattcggaatagtggataacacacaaaacttatccaccatcagtaatgtcattcgaacaacgtgctttggggattcgaacaagatatcatcggcgaaggcggatgtagctggtagagggcggcgaattgacggttaacggtgcttatgctttgtacgccgtcggtgctggttcagatattggctggcttctgtctgagtgtggaatctagcgtcggcgtgagtccaatggttgtatcggggccgacgatttgctgcaatttattggcggcatagatccagggcttggacggctgccgacggtgagagcagtcataacagtgaatgagcctctgcgagttcaaaagatgatgtagaggacgtttgtgagagtcgtttccggggcaagacatggtcgattgacgacattgaaatttctcaacgacggcagaatggcatgccttggcgaggagacgacactgagaggcgatggagtcgggattaatccaggttttggccagccaccgactcgcaagagcatcatagcgtcggtgtaccgccagaagctggcactgtaccgacgctgaatagcatcagcgtcgccggacatacaagttttggattgcagccgactaagaatgagatgccgacggcaagagccgcattgcaactatatgagacggcttcactgtgcgtggctgcaggtagagactgcccgcgcggcggcgacatatgagacggtttcactgtgcgcgcacgataaaccaccccggcggctaggatagagggaattgagggagtgcggctccacgcgtgaaggcaagaatcccgaatcatgcagagcaaacctgtgcaaggggagcttcctgcgcatgcggaagcggaaaatatgcgggcatgcgtagacatgacgagaatggcgcgaacacgtaagtggcatacgcactccgaacggcgcaacagcaacacgagcagaggttagaagaggatatgtcattcgagcatccgaatcggaacaatgagagcatgcgggacgtcgaactggacatcatgagccgcccgccggagcataacaccaccaatctggatctcgaccggatgaacctgatgctcgacatcctgggccacccggagcagtcgttccgcgtgattcatatcaccggcaccaacggcaaaggctccaccgcacgcatggccgaggccatctgccgtgcctacggtatgcgcaccggcctgtacacgtcgccgcatctggagaagatcaacgagcgtatcgccatcgacggccagcagctgtccgatgacgatttcatcgacatctgggaccagaccaaggatctcgtggccctggtggacgccaagatggaggagcaaggcaagccgaagatgagcttcttcgaggtgctcaccgccatggccatctggaagttcgccgacacgcccgtggacgtggccatcgtcgaggtcggcatgggaggcctgtgggacgccaccaacgtgctcaacgcggatgcggccatcatcggcccggtggacatggaccacatgcagtggctgggcgacaccgtcgaacagatcgccaccgagaaggccggcatcatcaagccgaactgcaccgccatcatcggcccgcagccgcatgaggaagccgtcatgccgattctcgccgaagccgccgaacgcaaccacgccatgctcgtgcgcgacggctacgaaatgaccgcgtccgaccgtatggccgcagtcggcggccaagtcgccaccctgaccacgcccaacggcacttacgagggcgtgccgatcgccaagttcggcgagcatcaggcccacaacgcgcttgccgcgctcgccgcctccgaagtggtgattccggtcaacggcccgctggacggcgacttggtggccgaggcgttgagctcggtcaagattcccggacgcatcgaacagatccgcacctcaccgaccatcattctggatggcggacacaacgtgaatgccgccgaagccctgcgcaaggccatcgaggaaagctacgacttcaagcagctggtcggtgtggtcgccatgatgcgcgacaagcaggtcgaggaatatctgggtgttctggagccgatcctgagctccgtggtggtcaccgagaactcgtggcgcgagcgcgtgatgccggccgacgagcttgagaagattgccgtggacgtgttcggccgtgaccgtgtgatcaaggaagcgaacctgcctgacgcgattcagaccgccgtcaatatggtcgatgccgaggacgagctgggcgtgggctacggccacggcgtgcttatctgcggcagcttcgtcaccgccggcgacgcacgcctgatgcttgaggaacacgccagccccacgatgaggcaggctatggccgttcatcagccggcggttgacccggacgattcggatcagccggcagacaaggccgaggatgaggccgccgacaacctcgaggattcggtaagcccggacgacttcgacgtgttcgacgtcctcggcctcggtaaggaacaggccggtgacgccggcaccggcacggccagtgccgacaccgacagcactgacacagccagcgccgacaccgacgattccgccgacgcccggtaacccgcatccaaggcatatcggatacccggacacccggcatacggaaaacagtctcacgccatgtatctcaaggaactcaccctccgcggattcaaatccttcgcctccgtcaccacgctgcgcttcgagcccggcatcacggcggtcgtcggccccaacggttcgggcaagtcgaacatcgtcgacgccctgatctgggtaatgggtgagcagggcgccaaaaacctgcgcggcacttcgatggaggacgtgattttcgcaggcacgtcctcccgcccgccattaggccgtgcacaggtgagcctgaccatcgataattccgatcacacgctcgatatcgattacacggaagtcaccatctcccgcaccatcttccgcaacggaggctccgaatacgcgatcaacggctcgcaatgccgcctgctcgacattcaggaactcctctccgatactggtcttggccagcagatgcacgtgatcgtaggccagggacgattggatgcgattctgaaggccgacccgtccggccaccgtgcgttcatcgaagaggccgccggcatcctgaagcaccgcaagcgcaaggaacgcgcgttgcgcaagctggccaataccgaaacgaacctgagccgactcgacgatttgctgggggagattcaccgtcagctcggccccctcggacgccaggcacgcatctcccggcgcgccgacgcgattcagatatccgtacgcgacgcccaagcccgcctgtacgccgaagacgctcaacgctcgatgagccgtcgcgacacggtacgtcaagaacttggcgctgtgcgcaaccagctggccgtcgcccaacgtgaactcgcccaagtcaaagtacgcatcgaacaggtcgaggcgttgagctccgaatccagtccggccatcgccaaggccaaccaatactggcatgaattctcgcagacccgcgaacgactgaacgcgctcgcccagttggccgaagagcgcagccggtcactcaccggccagatcgtcaccaacttcggtgaggatcccggcatgctcgtcaaacgagccgaggaactggaatctcaggccgcggcacaaaccaaggccgtggccgatgcgcgcatcgcactcgacaaggccaccgaggaacgcgccgacgacgagaaaaagcttgcctcagtccgccagaccttgacggaactgcgcaaaaccgcacaggaacgcgatgcgcaaatcgcccgactgcgcgaactcatcgcccgcgaggaatccgccgtacaactggcgaccagccgcgccaaggattacgcctcccaacgcgactcgctgacttcccagcgcgacgatgcccagcaacagctggacgcattgcgcagcgaagcggactccattgccgacgatgacggtgccgcattggacgccgcacgtgcaacgctcgccgaatgccgcgaccgactgaatgaacgcgccgataagcagcgcgagatacagtccaagatcatctcgctcaaatccaaggccgatgcgcttgccgacacgctagacagccgcaatgcctccggatcgttggagcgcgatacggacgtggcctcgcttggccgactcaccgacttcatccatgtggccgaaggctgggaagaagccgtggcccacgcgctcgaccagtatgccagcgccatcgtggtacccgcggcaggcaacatgttgcacgccctcgaacgcgctcgggaagataagctcggcaaagccgtggtgctgaccgcgagcattgccggcgatcccgccacagagccgggcacggagtcggaggagagtagcgccgagaacgcgggggccgccccgcaatcgggcaacgcgctggcagcactcgtcaccgcgaacccggatgccgagaacccggcacaggccgaagcggtcgtgcgcaccgtgcgtctcctgctggctgatgtagccgcggccggcaccgccgacgaagcacagcacatcgtggcatccggcgaagccatgcgggccgtcaccaagaacggcgagaccttcacacacggcgtggcggcggtcggcggctcttccatctctcaatcggacctgtctttggccgcacgccgagacaaggcattggcacaggtcaaacagttggccgcccaagacggcggaatggctgagcaagtggccgaggccaaagccaaacgcgatgaagcggcccgactcgtcgaccaggaatccgccaaacgcaccgaagcccggctcaaagcccaacaggcggagaaatctctgaaatccgccacagaccgcgtcgcatcgttcacccgtcagcttgagcagctggataggaaaatcaccgagacccaagagaatcgcaacgagcatcagctcaagctcgacgatctcaatcgcgctttggcatcggcccggcaatccacagcggaacatgccgatttcgacgaacttgatgaacgtgaacgcacgctggagcgcggactgaacctgactcgcgagcatgaggtcgccgcgaaaatcgcgtggaccgaggcaagccgcaaaggggagtcactgagccgacaggccgggctgctgcgggacaacgccagagaagccgccgaacgccgcgcccgcatcgaggcgttgaacgatcgcagacgcgagcaggccgcacacctgcaaggcgtggccgatgacgcgcgagcagtggccgccatggtggaacatacgctgcatgacgtggccgccaaacgagacgagctgcaggccgccgcctccagccatgacgaggaactcaaggccctgcgcgcgcagcgcaaccagatcgagcccaaggtcaccgatctgaccgggcgcgaacatgccttggatgtaaaccgcgaacggttggccgccgaatccgggcagctcatgcaaaaagtgtccgacgaactcggtctcactttggaggaattggttagtggttacggccccgaacagccggtgcccgtgctggatgatgagggcaaccctgtgccgttggatgagacggaagctgaggctgggaccgaagagggagaaaccgggggagagaccggcaccaacggcgattccgccctctttaagaccgtgccgtataaccgtcaggagcagaagaagcgtctcgataaggctcgccgcgatctggccgcactcggtaagatcaaccctttggccaccgaggaattcgaagcgcttgaggagcggaacaagtatctcaatgatcagcgcaacgatgtggtcaaatcacgtgacgatttgatgcagctcatcaaggatctcgattccacgatggtccaggtgttcaaatccgcgttcgacgataccgccgaggcattcgagcagatgttcgccacgctgttcccaggcggcaccggacgactgcgcctggaaaacccggaagacatgctcaccaccggcgtactggtcgaggccagcccggccggcaagcgcgtcaaacagctgagcctcctgtccggcggcgaacgttcgctgaccgcgctggcgctgctgttcgcgattttcaccgcccgccccagcccgttctatgtgatggacgaggtcgaggccgcgttggacgacgtgaacctgacccgtttgattaatgcgttcaatgagctacgcgcccatgcgcagctcatcatcattacgcaccagcaacgcaccatgtcgattgccgacgcgctttacggcgtaaccatgagagccgatggcgtaacagccgtggtgagtcaaaaactcgaacgataaacgaatggttcccgctggtaggaactggtgccacaggtgacagagggcggtccatatcgaaagaccgccctctgtctcgcttcgttcgacagctcccaccagcgggagcggggaggtattagcgcaatgccttgcgcacgccctgtacagtctgcagcgtcttgtagaagaccttcttgatgggtacgtcgcgggcgggggccaccggggtgatttcctcggtgaacttgcacttgaactcgttaaggcccttgagagacggcgcgaagtcggagccaatgcccatgagatcgtattcagtaataccctgcgagcccaggatgcagcattcggaatacagcagcttgtcggtcacatgcagacgcataacctcgttgcgcatgccggcatagtagcgcaccgcatgcgtgccgttcacggtgacaatcgaccatgccaccacacggtcttcaatacgtgcggcgaacacacggcaatgatcggcacccaacgcgccgatcatatcggaatagtcgctcatcggagcaggcgtgaatccatcgcgctggccggtctcgaccatcacatcgtaatattcggagaaatcggccagcgccttatccgtctcatcggcaacctcggccgggcactcgcgcagagacttgcgcacgtcacggcgtccacgacgcttcatccgagccagaatctcatcatcgccaccagtgacgtcgatgaccacggtctggtcgtacggcactgtggacagcaccttctccgtaccatcggcgaaccaggtgtcgatacgcaggaacgcgatgttcttgtcggccttcttgacggtgtccacgatggcgtcgacgacctcgcgctcctcagcttcggtgggcttggcagcccacgccggcccatgcatcgagcgcagataatgataaccgtgcgtctcaaaatcgataaaggagatcacggcgaccaattcaccatcacgcttgatcagataatcgccccatggcgtgcgtccgtcgatatccgcctgaaaaccagaccaaaccttggtctgttcgataggcaacgtgatgccggccttctcggcttcggcttccagtgtggctccgtcaactttctccaacgtgatcattacgattcagctatcctttttcgttcgtatccgtatgtcgtgtttctggtttggtcgtattgcgcgtgatctgatgtgggccaatcggaatccgatcaggatctgattggccggaatcccgtcacaagccaaacatgcgttcgaccacgtgatcgtcgccgtcgaacggcacatgcttgtgatggtccttgatccaacgctcgttgcccttgccgatgatcagcaggatgttgaatcggtcggcgtgcgcacgggcatcgtaaatggcgttggtgatggccgtcggacggtcggaaatcaccgtggagaccacatccttgttcgtgatgtagccttgcatttccatgcagatgtcgatgaacggctcggtgtccgtatcttcggcggtgaaaatgaagttcgcgatacggttctcggcagcctcgacgatttccttacgacgatcgtaggccttgttgccggccgatccggtcaccagcgtgatacgcgggttttcctcgccccaacgctcgtagacgaagtcaagcagcgcggtgacggatgcgtagttgtgcgcataatcgacgatggcgagcgtgttcgactgcggatcgcggaactgttccatacggccggcgatacgtacggattcgatggcgtgcagtgcgccggcgtcatcgagcgatacgccagccgcatgggcgatggcgatggccgccgccgcgttgaggtagttgaagtcgccatcgatggacagatggtagtcgccaagggtctgatctccgtcggcgatgtggaaggaggcgtgcgccgtgtcggcgggccaggcgacgacgtccgcactggtgccggcattatccgcgtcatgcagggcgaaggtggttgcgccgatgccggctgccgccgcgtcctcccgcaacagatcggcgtgcagactgtccgcgccgagtaccagcgacttcgcgttggcgatgatctggcgcttgcaatacaggtaatcctcgaacgtggggtgttcgatcgggctgatgtggtcgggggagatgttcaggaacgcggccacatcgaaagtcaggccatagacgcggtccaccttgtacgcctgggaggagacctccatcaccagatactccatgccgttatcggccgcctcgcgcatcatgcggaaggcgtccatcgattcgggcgtggtcagatcggactcgacgtaggtgtggccgtcaaggcaattatcgaccgaggagaacaatgcggccttgccgccggagacggcgttgataagcgcctgcgtgaagtacgaggtggtcgtcttgcccttggtgccggtgacgccgatgaccgtgagttcgttctgcggatatccgtagaacgcggcggacagcaggctcatcgccttgcgtgcgtcgttgacgatcaggccgggggcggcggttgcggctgagtactcggtttcggccacgtatgcggccaggccggcttcgtcgatgccgttcagatactcggccttgaatcggcccttgcagcacagcagggtgccctgcgtgaccttgcgggtgtcgtaggtgatgccggcgaacggttcatccgccgaagcgatacgggccgggtcgtcggtccagacatccccttggatgatttcacgcagcagatggtgttccttgagcaggtcagcggccgaagccaaagtcaaagccataattgtttctccctattatctagccgatacgccattctacaggtggggtgcagcgtgttgtggctcacacgtcatcgaccacgatatgggcacatgatttgattagaatggtgaaccgtgacgacaagcgaagcaactacgcaatccgggcagtcagccggatcgggcgagtccatggcagccaagcgcgccagattcgagcagctcgccatgcccgccgtcaatgcactgtaccggcaggcgatgaggctgaccaacaatcccgatgacgcgcaggatctggtccaggacaccttcgaacgcgggttcaaggccttcgactcatttcagccgggctccaacttcgaggcgtggatgaccaccatcgagcgcaatgcctacttcaaccagtatgccaaggccaagcggcgcccgcagcgtgccaacgactccactggcgaatacgacgattgggacatttacgatgccgccgaacatacgtcggacgggctcaagtccgctgaagaggaatatttggacgccttcgcgcccgaggaaatcatggccgcgctcgccaaactctcgccggaacgccggcaggtgttcatcgacgccgccatcgacggcaagtcctaccagcaggtggccgatgagcagggcgtgaaaatcggcacggtgatgagccgcctgaatcgcgcccgcacgcaactcaagcgtgagctcgcttcgtatgcgaaagagcgcgggtacgtgactggttcgtcggctggttcaccatccgcgaagttgggcgaaaacgttggtcgaatcgccgattccggccataatggaagtagtgaacaaactgttggtagcaatggcgacacgcaagccgtagtgagacatagtcatgcgactggcgcccgcacgccacaacagtcaagcaagctttcgggaaaggagatctgatgaacgatcagccggtagagcgtactcgccatatctccataacccgtacgggggccgatggcatggtcagccagaccgaagtgcatatcacggcggtgcatcatcgttcagtggataccggctcggcctctgcgtcggtccaggcggacgtgcatatcgttacggagggcgactgttttgaccctcgtacctgctgcgacgagcgtgaacaggcgttgattgccgcgttgcgtgcctacttgcgcccggatgtggcacccgaatgtctgatggcccggctcaaggccacgcttgatcactgctgcggcgaagataagtaacgacatatacaacaaggcccgtctgatgtatcatcagacgggccttgagcgttctataagaaacgcgaagaatcaggcgttaggacgcttgccgtggttggcggccttcttacgacgatccttgcgcttacgtccgcgcatgcccatgatggactcctttgctgcagtaaaaaaataagccttcggaattatgccacataagtacgacgtgatgcaacacgggtgtccatgtggcgatgatcgtcaggcttggttattcggtttttcagatttgttcggcgtggaaggtgaccacggtggtgtagtcatcgcccggctcgagcacaaccagatccttgccggtgcggaaggcgtcggcgtaggcggtcatcggttcgacggccacgccggcctgacgaaccttctcgccgatttcgttgccggtgcacacctgccaggagttgatggtcttgtcgccggtcagcgtgaccttgatgccgtcggggcgggtgaacacggcggaagtgctgccgtcttcaccgcggttggtgatatcggtccaggcatcatcgaagccacgtccctccagcgtggggttatcgcgcaggtcgaagatgccggaaaccggctcttcaccggtgggcagcaggtgttcgtctacggtcacgtgagtatcgcagtgcagctcaagacggcagagctcgttgtcggcggtaatggcctgaccggtggcgtgcttgccgttggccagccacgggtggatgccaaatgcccacggtgccttcacgctgtcgttgttgtgcacggtgaaggtttccgtgagaccgttctcgtcaagtgcataagtggcggtgatggtgatatcaaacgggtagccggcgatgtcgggggaacgccaggagagcgtcacatgcgattcctgcaggtcctcaagctcccacatataacggtaggcatagccgtgcagggaggattgacggtcaaattcgtcgatcggcatctgatagtcttcaccgtcgaaggagtactgaccgttggtcacacggtttgggtacggtgccagcacccagccgttgcagcagggaatgaccttgttcgggtcaaagggaacgatgaggtcttcgccgcgccacttcagctcgcgcaggctggcgcccagttcggtgacgacggcactccattcgccggacgagatgacatattggttaccagtgcgaggcttcaaagccatagtgcacactcctttgtggaacaaattgttatcgctcacaatcgtatcgcataagtcccaagacgcggcggcacataaggataaaaaaattggctcccctctggaggggagccagcgtaacagaactacttctggactgcttcgtagcggaccacagtggtgtagtcgccgttgggggcgagcgacaccaagtggtcaccagtgcggaaggcattggccggggcggtcatcggctcgacggcgatgccatacggatgctcggcgaacggtgcgccagtggcggtgtagcactgccaagcattaatcgtctcatcgccaatgattttcacttcgataccgtccgggcgggtgaatgtggtggtggtcgcaccatcggcggcacgctccacgtcaacccaggcatcatcaaaggcgcggccttcgagcgtcgggccatcgttcaggtcgtagatgccggtaaccggttcggtgccggtgggaatcagcgcctcgttcaccgtcacatgactggcggccttaatctgcaggtggcaggcggcggagtcggcatcgcgttcggcggcagttgcgccctgcttgccgttggccagccacggatgcaggccgagagcccacggtgccggctcgtcgccatcattgcgggcattgacggtcgcggtcatgccgttgtcgccgagttcgtatgtgacggtcacggtcacatcgaacgggtatccgtccaggttggggaagcgcagcgaaagcgtcacggcgctatcggtcaacgattcaagcttccacatgtagtggtaggcgtatccgtggttcgcattgttgcgcggtgcgggatgatattcgttaaccggcgcgcagtaatgcttgccattgaaatcgtattcgccgttttcgatgcggtttggccacggggccagcacataaccgttacaggtgggggtcaggtcgttgacgccgaacgggcagaaaatttccttgccttgataatcgaatcggcgaatcttggcgccgagttcgcagatgacggcggaataatcgccatagtgaatcgaatactgatttccggtgcgtggtgttttactcgtcatggaatcactcccgtagtgaggttggtgggccggtagctcctgctatcgctggccccagtctagcgcgtctcctctatcgaggcggggattggcgatatgcggcatataataaacaattcgtataaacacggtagcaatacgtggagtgacgagtctcacaccatcatgcgagaagcacgtggattccttggaaaccggtgatttgtgggagacgcggaaaagttgtgacggcagattcctgtaatccctgccttacactggaaaacactattgacgttcaggaggttccgatgaccaaaagcgttgtgctcgctgatccgcgaggcttctgcgcgggtgtggaccgtgcgattcttaccgtacagaccattctcaaagccgcggaggcttccggaaagcggacgcgcgaggatgggctgcccccggtatatgtgcgccggcagatcgtgcacaacaagcatgtggtcgaggacttggccgggcaaggcgcggtgttcgtccaggaattggcggagattccggatgctgctgcccaagcgggtattccggtggtgttttccgcccatggcgtatctccggtagtgaaggcggaagccgaacgtcgtggcatgcatatggtggatgccacctgccctctggtgggtaaggtgcaccgtgaggtgctgcgtttcgtgcgcgaggggtatgaaattgtctatatcgggcataaaggtcacgatgaagcggtcggtgtagtgggggagagccccgaacatgtgcacttgatcgagcatgaatcggatgtcgattcgctggattttgcgcccgacaccaagctggtgctgctctcgcagaccacgttgagcgtggacgagaccgccgataccattgccgcgctgaaggccaaattcccttggattcaagagccgccgagttcggatatctgctatgccacgtcgaatcgtcaggctgcggtcaaactggtggcccagcagtccgattgcgtggtgattgtcggatcggccaactcctcgaattccgtgcgactgatggaggtggcgcaggagggcttgggggagcgcggcaaagcgtatcgcgtggatgatgccagcgagcttgacccggcatggttcaagggtctggaatccgtaggtatctcctcgggtgcctccgtaccggacgaactggtgtccggtgtgattgacgctctgcaaaacttgggcttcaccggtatgaagtccgtcgaaaccatcaaagaaaacatgcactttgtgctgccggcggagttgcgcaggaagaagtagtcattcttggctcccctccgtgaggggagccaagaacggtcaccacgtgccgattggtgcggcaacggcgttcaagaccttgagcaggtcctgtggattcacgcccacagacaggcctcgcttgccgccggagaccagaatttggtcgaattgcagggcgctttcatccaacacagtcttatgacgtgtcttctggcctaacggcgagatgccgccaaccacataaccggattcacgcatcgccaccttgggatcggccatagaggccttcttggcacctacggctgcagccaaggctttcaaatccatatgaccgctcaccggtaccacgcccaccacgcgttcggcaccggtgtccgccatcaacgtcttgaacacctgatgctcgtcgaagccgagcttggtggccgcctccacgccgtagccgtcatccatatggtcgttggagtgctcgtattcgtatacgtggaattccacgcccgccttctccagttggactgtcgccggagtggaacccgcgcccttatcatgcttgcttttctttgccatgattaccgttctactacgaagagacccccgcacaaggcgggggtctcacagcttagttctcaaacgaaccgtagcggcctagaccgcaatggttcactcggagatctcagcgaagtacagcagggtacggatcatgttggaggtgaagccgtactcgttgtcgtagaaggacacggtgcgagccagggtcacgccatcaatggtgttgacgtcggtctgggtcgggtcgaacacgccaccgtgggtgtcgccgaggatgtcggaggagacgatgccctcatcgttgtagccgtagtaatcggtgtcggagaaggcagccttgaaggcggcgttgatctcgtcggcggtggtctcggtgttcagaacggtggtcagctcggtgacggagccgtccggaacctggacgcgctgggcgtggccctgcagcttgccgttcacggacggaacgaccttgccgatggccttggcagcgccggtggagtgggcgatggtgttgatggcggcggcgcgcaggttgcggccggtcttggtgccacgcgggccatcgagcagcatctgggtgccggtgtaggcgtggatggtggtcatgaagccggccttgatgccgaacttctcgtccagcagcttgaccatggcggccatggagttggtggtgcaggaaccggcggagacgatcacgtcggaagccttgaggatgtcgtggttcacgccgaacacaacggtcggggtggtgtcatccttggccggggcggagatcaggaccttcttggcgccagcgttgatgtgagcctgggacttctcggcggaggtgtagaagccggtgcactcgagcacgtactcaacaccgtcgttcttgacccacggaatgttgttggcgtccttctcggcgtagaccttgtattccttgccgtcgacgatgatggagtcttcggtggccttgacgtcaaccggagtgccatcgtcatgacggaaggtgccgtgggtgctgtcgtacttcagcaggtaagccagggtagccggggtggtcagatcgttgatggcggcaacttcaatgtcaccagcctggccgccgcgagcctgcagctcgaagatgcgacggaaggcgagacgaccaatgcgaccgaagccgttgataccaatcttaactgtcatgtaattctcccttgtagggtggccttggcgcgctttggcacaccgggccattgtttaccaacagttgctactgtaatgccgactctgtacacatggcaacgtttcagcgtgcgttttgggcaaaaatgccgtattttctgtgagcgctcacaattcggattgcccgcaaccgacatgtgatttttcctctcctttggaggaatgtctcgaatcatcatgagcaagcgcgcggcatgcaagtcagcgaaccagcagcttggacactgcggtgtccagctcgccgatatcgccgccaaattcgtggaatcgactcacctgaggcaacgccacctcgatggggaaggtgacgatcagtgtgccgtgctccacgctgatggccgcgtccacgccgtcgcggaactcgttgctgaccccctgcaccaccgtattggtcagcgtgccgtctttaagctcatatttcagccccggctcgttcacgccaagcgaaacatcggagtgggagaacgcagacaccatgcggccgtcctcgggcaccggatgcgcggggaacgaaagcctaccatcggtgatggccgtgacgatgagcccatcaccatacagatacccgcttgccccatgccgggccaataatgccatcagttgaatgccggaaatcgtatggtcaatgcggccgcccaaaccgccatagacatggaattcgcggcaacccgccgaccaaccgaccttcagcgcggagagcatgtccggatcgtccttcagcgcgggcagcgcgatggtgcgcacatcggtgcggggcggccggccctccagcgaatcgaagtcgcccaccaccacatcgggcacgatacccaactggcgcgtatggtcgagcccgccatcggccgcaatcacatacgcgctggccggcaccacgggcgtgcccgcatagtattcgcccgcaccaaaaatcacgcatacctgagtcatgatgcctactgtagccggtatccacccatcggccgggaaaatgctgataggctacgcatcagaacagtagtcgataggcgcacaggcaggggagcggagcgatggcacagatcaccgaggcaagcgaacggccgattctcaaatcaaagatattcctctacatcaccgaattcttctccggcatgtccgctgatctacttcatctcgatcaaggccaagcgcatcgcctgcgtggtcagcgccgtgatcttcgtggccacgtcctgcgtctcgcccctgaccggcttcgcgttctgggaaaccaacctggcctatgagggcgagtccatctacaactacctgcaggtcaagaacctctccgaccgcacgatcctgtccaccaacgtgctgttcggcgtgcagtccgtcacgatgaaagacaaaggactgacaggtatgtactacgacacggccctggctgcgccggcgctcgccgacaatgccaattccgcgctgatcctcggcatgggcaccggcacctacgcccgccagctgaagcagtattatccgaaaatgaacatcaccggcgtggagattgaccagaagatcaccgatctggccggcgaatacttcgatgagcccgccgacatccccgtgaccacgtatgacggccgagcctggctcgccgcctcgcatgacaagtacgacgtgatcatggtcgatgcgtatcaggacatcaccattcccttccagatgagctccaccgagttcttcaccatggtcagagagcacctgaaccccggcggcgtgatggtggtgaacatgaacatgatctcggacggccaaggttcgatcaacgaggcgttgagcgataccatcgccagcgtgttcggcaatgggaacacactgacggccgacgtgccgaacaccacgaaccgtgaactgttcgccaagaagccgggttccggctccgaagagaactccatgcagcaggcctccaaggcgctcaacctgcgtgagaccacctacgagcgcaccggcagcgaagatctcgaatggtatatggaagaggtcgcctctcgattccggaaggtgaacgaaccggactcagcgtcgactattctcaccgacgacaaggcgccggtcgaagtactcggcatacatgccatcgatcaaatcatcgccgatgaggccggcccatatcggcagattctcaaagacgaaggcttcggcggtctgctgcgcgccgtgcagtaggttcgacacacggaccgcgaatgtccgggcgtatggtagactttctatttggcttgagaaatcaagaaagcggggcaaccccacctggaagcctttcaaggcctcgggttcaaggcaaacagcctagcgattgcgatatacaacgcgtaatcaggaatgacgcaaagaactgatatgcgtctgcagaagctgagcgcatattggcgcgggctttggcttgccatgaacccaaagcattgaacaggactccagcaaaggccctcgccacggaattgaagtagaggattggagtcatcatcagcgacgaaccacgtattaacgacgagattcgcgtcccgcaggtacgcctgatcggcccgaagggcgagcaggtgggcgtcatcgcgacttccgtcgcgctgaacctggccaaggaggcaaacctcgatctcgtcgaggtggccccgaacgcgaagcctccggtcgccaagctcattgattacggcaagttcaagtacaacgagaagatcaaggctcgtgaagctcgccgcaaccagagcaccgcggaaatcaaggagattcgtttccgcctgaagattgacgaccacgatttcgacgtgaagaagggccatgtgacccgcttccttaacggaggcgacaaggtcaaggtcaccatcatgttgcgcggtcgtgagatctcccgcccgattggtggcgtggaactgctgcagcgtctggccgacgatgtcgaggaatacggcaccgtcgagtccaagccgaagcaggagggccgcaacatcatcatgacccttgcgccgaagggcaagaaggtgcacacccagtccgagcagcgtcgtcgtggcgccgagtcccgcgccgagcgtcaggctcgccaggcggctcgtctcgcggccaagcaggagtctcaggctcaggccgcggccgacgcgcagtccgcgatttctcagaagacttccgacaagaagcaaaccagcaaggagggcagcaatgccgaagatgaaaactaattccgccgcttccaagcgcgccaagatcaccggcaccggcaaggtgaagcatgtcggttccgccatgcgccacaacctcgagcacaagtccgctcgcaagcgccgtgaactgtccgccgacgatgtgctgcgcggcggccaggccaagaagctgcaccagcttctgcagaagtgagcatagggcttacccggaaataacaagactttagaaagctgaggaatagattatggcacgtgtcaagcgcgcagtgaacgcccacaagaagcgtcgcgttgttctcgagagggcttccggctaccgtggccagcgctcccgcctgtaccgcaaggccaaggaacagctgctgcactcctttaactacaacttccgtgaccgcaaggctcgcaagggcgacttccgcaagctgtggatccagcgcatcaatgctgccgtccgcgctgagggcatcacctacaaccgcttcatccagggcctgcgtctcgccggcatcgagctggatcgtcgcgctctggctgagatcgccgtctccgacccggacaccttcaagaccatcgtggacgccgccaaggccgccctgcctgaggacgtcaatgctccggttgaggcctgattgcttgaagtcgtgacttcacactagaaaccccgcttccgagcggggtttctttgtaccatgggcactatgaccaacggattcaccagactcaccgagcagttcctcgtccacatcggcgtggagcgagggctcgccacggccaccgtcaccgcctacgaatccgacatcgccaaatacattgattggctcgaaacccgcggcatccacgaaccggacgccataaccaaacaagacgtcgaagactacatcgccgcccttgaccaggcgggggagtccgcccgctccaaagcccgaagactggcctcgatccacgaattccaccgtttcgcgctcggtcagcacgcggtgacggcggatgtttcggccgcagtcaaggcgcccaaaggcgccagcaccctgcccgacgtactcaccgtggacgaggtaacccgtctgctcgacgcggcggcagtcggcggctcaaccgatccggtggtattacgggacaaggccctgctcgaattcatgtacgccaccggctgccgcgtctcggaagccaccggtgcgaatctggacgacatcgacctggacaagcacatcgcgcgactcatgggcaagggctccaagcagcggcttgtgccattgggcagttacgcatgccgggccatcaccgcatacctcaatgcggggcgtggcgagttggaacagcgctccagcgccaagattcccgagaggcgcgcactgtttctcaacaaacgcggcaagcgcatctcgcggcaatcggtatgggaaatcgtcaaagcaaccggggagcgggccggcatcaccaaaccactccatccgcacaccttgcgccattcctttgccacgcacctgatccaaggcggcgcggacgtgcgcaccgtgcaggaactgctcgggcacgccagcgtgaccaccacgcagatctacacgcacgtaagccctgaaaccctgatcgaaacgtatctgacctcacatcccagagcgcggtgagacacaccattttgcgacgcgtccgcccatagcggaatcgcggcgggggagcaccaaagtcggccggaaattcaaggcgtgacaatacagtacataacagcgaaccgtcagccaggaagaggtattcatgctgcagatcaaatcgatctcgaagcgctataaaaccggtgatttcgttcagcaggcgcttgacaaagtcagcctgaacctacgcgacagcgaattcgtcgcgattctgggtccctcgggttccggcaagaccaccttgctcaacatcatcggcggcctcgaccggtatgacgacggcgatttggtgatcaacggcatctcgacgcgccaatacaaggatcgcgattgggattcgtaccgcaaccacaccatcggcttcgtgttccagagctacaatctgatccctcaccagacgattctgtcgaatgtcgaactcgcgctgacgatttccggcatcggcaaggccgaccgtcgcgaacgtgcgcgcaaggcgctggagaaggtcggactcggcgaacacatcaacaagaagccaaaccagctgtccggcggccagatgcagcgcgtggcgatcgcccgcgcactggtcaacgacccggacatcgtcctggccgacgagccgaccggcgcgctcgattcggacacgtccgtgcagatcatgaacctgctcaaggacgtggccaaagaccgcctcgtggtcatggtcacccacaaccccgaacttgcggaacaatatgccacgcgcatcgtcagcctgcgcgacggcgtgatccgctccgactccgacccgttcgtcgtggacgagacggccgaacagccggccgtgtacaagacgatgggccgcgcgtcgatgtcgttcgccacgtcgctggcgttgagcttcaacaatctgaaaaccaagaaggcgcgcaccctgctgacctcgttcgccggctcgatcggcatcatcggcatcgcgctgattctatcggtgtcgactggcgtgaacacatacatcagtgacatccagcgtgacacgatgaccgcctacccgatcaccgtcgactcccagaccttcgacctgagcagcatgatgggcggacagatgggcggcgatgacggatacggtggtaagacgcacaaaaccgacggcatctacccggacgaccgcagcgtcaagcaggcgtccagcctgaccagttcgattaccgaaaacaatctgacccgcttcaagaaatacctggataattccaagagcgagattcaccagtatgtgggttccaccggcatccagtacacgtatgacgtgaaattctccgtgttcgaccacgaccccgatggcacgctggtcaatgcggacggcgtgacgatcggtgccagcgattccacttcaatggcctcgcagatggcgtccacaagctcgtccggcatgtccggcacctcgtcgatcacctcgcagcagatgtcgatgctgaccggcaaaaccgatgagaacgccgcgcccgactcgttcaacgagatcatgccgggagcggacgacagcaagctcgtaggcaaggtcatcaccgacaactaccaggtggtcaacggttcatggccgaagtccaaggacgaggtggtgctggtgcttgacgacaacaacagcgtgccgctgaccacgctgtacgagctcggcctgctgcccgcctccgattaccacgagatgatgtccaagcttaacgccggcgacaaggtcagcactccacaagacaagatcgactatgctaaggccctcgatcagacgctgtacatgattccggcatccgaccagtacgtcaagggcgatgacggccactaccgtttcatcggcaacgacaaggacgaaatcgaacagcgcctcgaaacggccaccaaactcaaggtggtgggcgtcgtcaaggcgaagaaggatgcttcggccacgccgttggccgctggtgtggggtacacgcgcgctctgaccaatgatttgatcgaccgtgcggcctccagcgccatcgttaccgatcagaaggccaacccgaacacgaacgtgctcaacggcatgacgttctcgccctcggacgatgccaccaaggtggccgacgcgcgcacctacgtggcttcgctgggcgtgacgcagaaggcgaacatggccaagtcgatgatgagcgccgggcagcagtccggcacgggcgcatcggacgccgctggtgctggtgctgcaggtgtcgctggcgcggcgggtgccggcgatcaggccgccgccatggccgcgatgagcgaacagcagctcgccgacagtttcgacgcgtatatcgccacggcttcgaacgacgtgcttgtcgcgatctacgaccagtacgtgtcgaccggcacctacgacgacaacctcgccgcattcggtgtggtgagtcgtgacgcgcccagctcgatcaacatctacgccgacagcttcgaagacaaggaccacatcgccgacgcgatcaccgactacaacaacaccgtctcgaagaaagacaagatcacctacacggattacgttgggctcatgatgagttcggtgaccaccatcgtcaacgtgatttcctacgtgcttatcgcgttcgtgtccgtctcgctgatcgtctcctcgatcatgatcggcatcatcacctacatttcggtgctggagcgcaccaaggaaatcggcatcctacgcgcaatgggtgcctcgaagcacaacgtatcccaggtgttcaatgcggagaccggcatcatcggcctatgctccggcctgttgggtgtgggcttgaccgtgctgctcaatattccgatcaacgccgtgctacaccacttcatcggcaatgcggacgtcaatgccgccctgccggtgaccggtggcgtggtgctggtgatcctaagcgtggtgctcacgctgatcggcggcctgattccctcgcgtaaggcagccaagcaagacccggccaccgcactgcgcaccgagtaagcgcatcgacatagtacgagacgagatccataaacctcggaacactggaataccagcggcaaaacggtgttccgaggcgagcccggcgagtacattaggatgggcgagcaggtattcccgacaaagggggcgagggcaacgatggacgactggcgagatacccgcgataaagacagcgcattccgtcaaggaacgctgcctatgacaggaacgtatgtcgttgcacccccagcgaacccggatgttgataaggtagacagtatgcctaccgatttgcttggacgtgaatacgaaaccttccccgcacccgaaccgctgcaacagcacggtccggcgcgtgtcattgccatgtgcaaccagaagggtggcgtaggtaagaccaccagctccatcaatattgccggtgcgttggcccagtatggccgccgcgtgcttatcgtcgatttcgatccgcagggtgccgccactgtgggactgggcgtcaacgcgaataccgtggagaacacgatttacaccgcgctgttcgatatttccgtggacccacatgatgtggtgcagcacaccgcattcgagaacatcgatgtgattccggcgaacatcgatttgtccgccgccgaggtccagctggtcaccgaagtgggccgagagcagatcctgaacagcgtgctgcgcaagctcaagtcggaatacgatctcatcatcgtcgactgccagccatcgctcggcctgctcaccgtgaacgcgcttgccgcagctgatggcgtgatcattcccgtggccgccgaattcttcgccttgcgcggtgtggccctgcttatgcagtccatcgaaaaagtgcagtcccgcatcaatcccgcattggaagtggatggcgtgctcatcaccatgtacaccaagacactgcactgcgaagaggtctgccagcgcgtttacgaggcgttcagcgaaaaggtgttccacacgttcatctcccgctccatcaaactgcccgattccacggttgccgccgcgcccgtggtggtctatgcccctgagcacaagacatcaaaggaataccgtgaggtggcacgtgagctcattgctcgcggcatcgtggcgtaacgattgtttcgataaacgatgaatgagacttccctttctcggctcccctctctgagggaagctggctcgcgtagcgaggctgaggggagctccgcggaagccgaaatcagcacggaggaatccgccacttccggcttccgggtcaacctcgaagtctattccggtccgtttgatgccttgctcggcatgatcgccaacaacagactcgagctgaccgaagtttccctctcctcgatcaccgaggaattcctgacatacgtgcgcgggctcgatttcacaaaaaacatggatgaggccagcgcctttctcgatatcgcctctattctggtcgaggccaaaagcgtggcgattctgcccggcggcgaagacagccagcacgacgagcagagccttgaagcgctgcgcgaacgcgatttgctgttcgcccggctcctccaataccgcgcctacaagcaggccgccggtgatttccgggcgcgtatcgccgccaactccggccgattcccgcacccggcggccatggacgagggtgttgccgccatgctgcctgagctggtatggacgctgactccgctcgaactcgcccgactggccgcccaggtcatcgccaacgcgcccgcctccgaagtgtcgatccatcagctgcacgtaccgttggtcgatcttcgggcccaatcgctggtggtgcgcgaccggctgatcgcggcattggaatcccagggcgaccagtcgatgtcgttcagcgaattgacccgggactgcgcttctcgtattgaggtggtggctcggttcatggccgtgctcgtgttcttcaaacaaggtgtgctgcagtatcagcaagatggtccgtttgccgaactgcacctgaggtggatacccggcgtagccgaaacgatgagcgacgtgaacatttccgaaggtgattttgcgtaaggacggcgattggtgactgaacagattgacgcaacgaatacaaccgaacacatggcggatgccgaatcgacggctgaatccgcaaaggccgcggtgaggggagtggaggagacgcgccccgaatacgtggatttcgcggtagacgattttcccggcgggctgcccgcctgtctggaagcgattctgatggtcgccgaccagccgcagaccgccaccgagctggcccgtattttggcattggatcgcaacacagtcgaagaggcattgcgagccctgcacgatgactatgagggcgatgaatcccgtggcatccgcccgcgcggcttcgaactgcgccgcaccgctcgtggctggcagttcgccagtcgcgccgcgttcgagccggtcgtctcatcattcgtcactgacggccagactgcgagactcagtcaggccgcactggaggcgcttgccatcgtggcctatcgccaacccgtcacccgagcccaagtggccgcgatccgcggtgtcaactccgatggcgtgattcgctcgctcacggtacgtggccttatcaaggaagacggcgtggaccccgaatcccgcgcggccctcttggtcacctccgaattcttcctcgaccaaatgggtctgaagagtctcgacgaactaccctccctagcgccattcctcccgtccgtcgccgaaatgacacagtcgaaatcggaagatacggacgtgatttcgtagcgattggggcccgctgcctgaccaatattcgtgcgctagaccatccgatatgtgatttatggtcattgtgactataagtagtgctatgctctcaatgcagggagaacaaccggtatggaaagaggcatggcatgggattcggcaatgtgtccgagcgctgcagcgcaccgccacaggtcggcgtgtcagtggtgattctggcactcggcccggaaggcgataccggcaacagtgccgccgattccggcaacgccgcgaactcggcccattcccgtctctggttgcccctggtcaagcgcgtccgtcagccgttcctgggctgctgggcgttgcccggcggtgacctgcgctccgaccggtcgttggaacagtctgcctacgcggccctcgaatcgaccacagacctgcacccgcgatacctcgaacagctgtacacctttggaggcccgacccggtcccatggcggattgcccatggtatccgtcgtgtactgggcgctcgtcggccagaccgaggccgcgggcttcgaggacggtgacaacgtacgatggttccccgaagacgaactgcccgagctggcgttcgaccatcgccagatcatcgactacgcgctgctccgcctgcgctccaaaatcgaatactccgacgtggccacccgactgctcggccccacgttcaccctgcgccaactgcacggcgtctatgaggcgattggcggcgaacccctcgacttggcgaacttccgccgcaaaatgcttgcctcgggcgaccttgaagacaccggggagaagatgcgtgaaggccgccaacgaccggccaccgtctaccgctacatccccaaacgacctgtcgagaacggtacgccccacgaatccgatggcgacgacatcatggaactgtccagacaaggcgagcgtgaagacgctctcgacgcgctgatcccatccgcgcgcatctgatttttcccgccgacccgattcgggccggcatcacagacgtatataggaaaggaaccactatgactgcactattcactgcgccgtccgttgacgagatcatcgccaagctgggcgcgcaaagcacctgcgatgcaggactgacccaggacccatggcacttcgacaccaccacacccagctacggtcccggtgcctcgatgctcgaccgtctgcccgccaacgcgccgcgccagcaggtgctgccggacgaataccgcaaggcctccgacgaggaactgcagcagcgcatctccgacgccaagcagcgtctcggctccaaactgttgattctgggccacttctaccagcgtgacgagatcatcaagcacgccgatttcgtgggcgactccttccagctggccaagaacgccaccgaacgcccggacgccgaccacatcgtgttctgcggcgtgcacttcatggccgaaaccgccgacatcctctccacgcccgaacagagcgtgaccctgcccaacctgtctgccggctgctcgatggccgacatggccaatatcgaccaggtccaggaatgctgggaccagctcggcgagatctgcggcacccagccggactccgatggcttgcagcagatcatcccggtcacctacatgaactcatccgccgcactgaaggcgttctgcggacgcaacggcggcatcgtatgcacctcttccaatgcgcacgccgtgctggaatgggcgttcgcccgcggcaagcgcgtgctgttcttcccggaccagcacctgggccgcaataccgcccgcgccatgggcattccgctgagcgagatgccgctgtgggatccgttcaaggcacagggcggcgccgccgatccggccgattacgcccgcgccaagatgattctgtggaagggcttctgctccgtgcaccagcgtttcaccgtcgaacaggtcgaacgtgcccgcaaggcatacccgggcgtcaaggtgatcgtgcaccccgaatgctcgatgcaggtggtcgatgccgccgacggtactggctccaccgcgtacatcgtcaaggagatcgccaacgcgcccgccggatccgccattgcggtgggcaccgaaatcaatttggtgaaccgtctggccgcgcagtacccggacaagaccgtgttctgcttggaccccgtggtctgcccgtgctccacgatgtaccgcatccacccggcctacctggcttgggctttggagaacctcgaagccggcaacgtggtcaatcgcatcaccgtggacgaagacaccgcccgcgaagccaaggtggcactggagcgcatgctgcgcgttcacccgtgattcgtccctggcgctcctcgtacatgaggggagctgtccgcgtagcggactgaggggagcagatgacgcaaaaacagaggaaagcaacacaatgagcaacactgaaatcgtcgtcgtgggcgcaggcgtcgccggactgtccgcggcactggccgtggccggtaccggacacgacgtgaccttggtaaccaaggccgaactggtggaatcaaacacctatcatgcgcagggcggcatcgccgcggccatcttctccgacgacgacccgaagctgcacgccgccgacaccatggccgcgggccacggcctgtgcgacccgaaggccgtggacatcctcacccgtgagggtgcggagcgcgtccgcgagttcgccgcggccggcgtccacttcgaccgcgacgcgcatggacacatgctgcgcggcctggaagcggctcattcgcgcgcccgcgtggtgcatgccgggggagacgccaccggcaaagtgtttgaactggacgtctccgccatggtgcgcaagaacccgcgcatccacatcatcgagaacgccttcctcaaagatctcatcgtgcggggcggccacatcgccggcgtccacctgctgatcgacgggcaggacaaggatctggccgccgaccgggtgatcttggccgccggtggagcaggccgtatgtacccgtacaccaccaatccgccggtcgccaccgcggacggcctcgccgtcgcatggcgtgccggtgcccaggtcgccgatctggagttctaccagttccatcccaccgccatggccgtgggcgagcacttcctcgtctccgaagccgtgcgcggcgaaggtgcggtgctgctggatgagcatggccacaggtatatgaaggacatcgatccgcgcgccgaactcgcgccgcgtgacgtcgtggcccgcgagaacttccgcgtgatgcaggcgcaaggcggcaagcccgtgatgctcgacgtctcgccgatggcccgcgagaaccccgacctggccagcttcttggcccaccgattcccgaccatcgacgcctatacgcgttcgcttggcttcgactggagcaaggagccgattccggtggcgcccgccgcgcactactacatgggaggcattcgcaccgatctgaacgcccggacctccattcccggcctgtatgcggccggcgaatgcgctcgtaccggtgtcatgggctccaaccgtcttgcctccaactcgctgctcgaggggctcgtctacggacgccgcgccggtctggccgccgtcgcggacggtgacgacgcggtctgggcacccgaaccgttcctgaactccgccaccggtgccgtgttcgaccatgcgccgatcgcgctggccgcccctgccgctacggctgctgctgacgataccgccgccgacaaggtgtggaatcgtacccgcatccagaacaccatgtggcatggcgtcggcgtgctgcgcgacgaggccggactgaaaaccgccatcgccgaactcggccaaggcctcgccgccgcaaacgcccaggctgatgtaaacgccgatggtgctgcaagcagcgttgaggctttggagaaccgcaacatgctcaccgtaggctatgtggccgccaccgccgcgctcgcccgcaccgagtcgagaggcgcccacgcccgcaccgaccacagcgagccagtcgacaactgggcccactccgtcgcctacatcaaggactgacccatgctcacatcacacatcatccgcgtcgccgtcgaagcggcgctcgccgaagacgcgccctacggcgacatcacctgcgagaccaccatccccgcggacgaaaccggctcggcccacctcaccgcgcgcgaaaacggcgtgatgagcggcatcgacgtgttcgccgcagccttcgccgcacagaacccggccgtcaccgtcaccgccgccatcaaggacggcgagcgattccagcgcggccagatactcgccaccgtgaaaggcccggtacgcgacctgctcaccgccgagcgcatcgccctcaacttcactcagcgcatgagcggcatcgccaccatgaccgccgccttcgtggacgcggtgaacgccatctacggcgatgattatgacggacccgtcacccggccgcgccgctacgagcgcacccgcatcgtcgatacgcgcaaaaccacgcccggcctgcgcccgttcgagaaatacgccgtggtctgcggcggcggccacaaccatcgttacggactgtccgacgcggtcatgatgaaggacaaccatctggcggcgctcgccgcgcgcggcatcgacctggccggcgcgatccgccacgtgcgcgaacaggtgggccacaccacgcatatcgaagtggaagtcgaccgccttgaccagattcccgccgtgctcgccggcggagcggacaccatcatgctggacaatttctcgctcgacgacacccgtcgcggcgtggagctcatcgacggtaaggccatcgtggaagccagcggcaacatgagcctggagcgagtgccagccgtggccgtcaccggcgtggacgtgatctccgtgggcgcgctcacccactctgtgcgcagcatcgacctcggattggattggaactagtcatggccgatacccccaacgcatccggtgaacccggcgaactgtacctggacgccgccgccaccgaatcagtgagcccggcagtcatcgaggccatgaccccgttcctgactgaggcctacgccaatccggccagcgtgcaccagcccggcaaaaccgcggcccgcgcgctggacgcggctcgcgcatcatttgccgcggcattgggcgcccggccggatgacgtgatcttcacctcaggcggcaccgaatcggacaatctggccatcaaaggcatcgccatggcgcgcatgcgcaaactgggcttgcggccggtctgcggattcgccgaagccgatggcaaacagccggcaaattgtcgcccgcgcattatcatttccgctatcgagcacccggccgtggcccaatcggcggcatggctgcacgaatggttcggtttcgaagtcgtgcgcattcccgtggatgcgcaagcacatctcgatctcgacgcacttgaacgcgagctcgacggcgaggccagtgaacgtaccacgatggtctccaccatgctggccaacaacgaggtcggcaccgtggaacccgtggaggaactggtccgcatcgcccacgcgcacggcgtgcccatccatgtagacgccgtacaggccgccgggcagattccgattcgttttcgtgactgggatgtggacgccctgtccgtatccggacacaaattcggcacccccaaaggtctgggagcgctgctggtacgcggccgcacacccatcgaaccggtgctgtccggcggcgggcaggaacgcggcctgcgctctggcacgcagaacgtggccggtgccgtggcgctcgccatcggactcaacgaatcgaatgcgcgcatgcaggcgcagtaccgtgagttggtcgcgtcccgagacatgctcatcgacgcggttcgccgggtcgcgcctcgcgccgacctgaccggcgaccccgaacgccgtctgcccggtcacgcctccttcatcttccccggcgtcaccggggaagcgctgctcgtcgacctggacgcgcgcggcatcgctgcctcatccggctcggcctgcgccatcgggcgccacgagattcccgccacgttgctggcgatgggcctcgaaccgtccatcgccaaatcggcattacgcatgaccttccgcaagccgctgacccgcgaacaagtcgaacgcatcagcttggccatcgaagagtcctacaccgacctgacccgccattaaatctgacgccacttaccagaaaggaaacgacgtgagcaccaccacttcagcgcaacccgcgcagctcacccgcaacgagcgcctcgaccggctgcccttcaacaaggcgcaccgcaaactcctcgtcgcctccggcatcggctgggcattcgacgccatggacgtcggcctcgtctccttcgtagtcgccgccatcgccgccgacccgcacttcaacctcaccccgaccgaaaagtcatgggtgctgtccatcggcttcgtcggcatggccatcggcgcggcagtgggcggcttcatcgccgaccgcgtgggccgcaaaaccgtgttcaccgccacactgattatcttcggcatcgccaacggtgccatggccctatcttggtcactcggcatgctgctcggcgcccgactgatcatcggactgggcttgggcgcggaactgccggtcgcctccacgctggcctccgagttttcgccgaccaaacagcgcggccgcatgactgtgctgctggaatcgttctgggccgtcggctggatcgtcgccgccatgatcggctacttcgtgatcccgaacaccggcgactggggctggcgctgggcgctggccatcggcgcgctgccactgctctacgcaatcgtcacccgcgtgcacatcccagaatccgtgcgattcctcgaagccaagggtcgcgaagacgaagccgaaaaggccgtgcgctacttcgaggaagccgggggagtagccccggtaacctctcccaagggcaagccgctgccgaagatcaagacgcgcgaactgttcggctccaagtacctggcccgcaccatcgccatctgggccacgtggttcttcgtgaacttctcctactacggcgcgttcacatggatgccgtcgctgctcgccgaccagttcggctccctgaccaagtcattcggctacacgctcgccatctccatcgcccagctgcccggttacttcctagccgcctggctggtggaggtctggggccgccgcaagacgctgagcatcttcctggccgtctccgccgtggccgccttcgcgttctcgcaggccggatctgtggccctcgtgctcgtgttcggcatgctgctgtccgcctccaacctcggtgcgtggggcgtgctgtacgccgtgaccccggaaatctacccgacccgcctgcgtggcgcggccgccggtgccgccgcagcggtgggccgcatcgccgccatcatcgcgccgctcctcatgccgtggttcctgaccctgtccggcggcaacaaggccgtggccttcatcatcttcgccgccgccttcatcctcgcctgcatagcagccctctgcttgcccgagcgcaaaggcctcaatctcgaagactgattacacttcagccttcgctactaaagtggcccacaccaatgtgtgggccactttttgtcttatagctcccgaatgacacggcaagggttgccgtatgtcactgatcaatcgagggaacgacgggtgagattgcgcggtggttttgtgaccagccacgccaccagcagtccggttaccactacgccgaatgccagcgccgcctgcaatccccagatcggcacggtttccagccaatgaccgtccacaccgatcctgcggttccatgccacatgcagccatcccaacgccacgccggataccacgcccactggcgcgccggccagcagaatcaccgcagcctgcgtcaggccgtaacgtctgaggaatcggggtggcgcgcccacggcgaccatcgtggccatgtcgcgctgggcctgcgtgcgggccagcagcagtgaaacgagcgtggccatcagtgccagcaatgccaacaggccaatgggcaccaatgccatattgtcaccccacggcaggcgattcccgtcagtgctcgtggatgccagcggcagattttcgattgcataagctgaggccttctttacggtaacgggggagttgccaccggcgaagtctagatactcacccagatactgcaattgtttgatgccgagcgcctgtgctgttgccgggctcatcaccagcgggtacgcgccgcgcacgtagatggccttgcgcttctcgatatgtgtggcctgagattcgtttgcaattgccggattcggcgaaatggccacacgcaccatacctcccgcgtcgattgtgccggcatcgccgaccaccacaccgcccgcgtcaagcacctgtgccgcctcatccgcgttcgggaagccggacaaacgcatcgcattgccatccataatgagattcacgccgcggaaactcggcagtatattcgaatacgttggctgatgggatcggtctatcggcacacaacgtatcggaacgtttggatacagggccgaagcggcatcctggcccacccatgtggacgtgtccggttgctcttggatcgttgggttatcacaagtgtgaccggccgggagcaatgcagcggcatacatgtagccgtgttcggcgttcaacttgtcggaatcgacttcggtcgtatcattgagctttgaccatcgcttgacatcctcggtgtacaccgggtaatgagcgcgtatcggcgtctctttgccaagccggcgtatcgcatccgacaccacagcacggtcgaactcattgctgacatgcacgtcggccccaatggccatccccgacggtccatacgtcatcgtcatcgtggaatttcgctggtccgccaccatggagccggtgattaccagtgtgtacgaggcgatgcacatggtaatcagcaccgcgcatgccgccggaacgaaccgtcgatgatgctcggctgcatccctgagtgccaggcgtgcgccgatgttcagttgggaactcgctttgccgcaccaccgtgcaaaagtgcgaatcgacaacgcaagccctatgacagccaacaaaatcgtggcaacaagcagagccatatgcgcttcggttccggccggaaccgcgcccggattgtgatcggccagcgtgggcaatggcaatgtcagactgagcgcggcgcatacgatggcggccaagaccagaatcggaccaaccgcaacacggagcagtctcaaaggattacggcgaagcttcgtatccacgccattcgcggattcaccgtagccgatttcctctcttgtcgggcgatccttcaacgcatcgactggatgcatacgcgccacatgccgagccggcgcaatcgtcgcggcaaatccaatgatgattgccgtggcaatacccatcggcagcgagctccacgagaatccgtgcaggatctccagcggcgtggatccacgcaatgcgcctatcgcagggccggccgccaaggtaagcgcgaatcccaatgccgagcccagcacgccaccgatggcgccgataacgagaccttgcgaggaaatgattcgactgaggtcacgtggtgcagcaccggatgcggccgcgagcccaagcacacgacgtgactgatctgccgacaccgtaaacgcgggcgtgactagaaacagtaccagcaacatacccaccagcatgatgatgaccacagtgaccatgtggttcaacatggtagccgcatcgatctgcatcgggtagagctgcgatgcgggcggatagccgtcagtcagcacatggcgggaaatgacgatggcctgcaacaggttcatgctgcgggtgtgcgcccacgtgaccggctctggaccgaccaccaaataatggccatccacgccgacgccatcagattccaatatggctgacatccagccttccaagccccatgccgcggcttcggattcatcggtcagcccgctgactgtccaagcacgctgagtgtcggccaccgcctcgccgatgcgcccgtccaggctcatccagccatcgaacggcggagcgacgaacgtcaccgtgctaccgagagaagcgccgagattatccgccaatgtgcggctgatgacaatctgcgtattattctgcggcgccgaacccttgaccagcttcggcaacattcgttgcaatgcctcaggtgaagcctcggtcatggtcgcggtggaggccgcgttcagatcaatgtcattcccgcttttcacgtcgatcccagccttggtctgttcgccgggttgcaacgcggtgccggtgatggcgatgagttcgggcgactgccaatacgggagcagccgatcctgttgcggcagaatcttcgcaagctcggcggccgaggccggctgctgggagggatcgtcctgccacgtgccgccgctttcgggtgactgccggaacggttggccggtgcggggcctggcggtggcggtgatgaccgcctgcgtatcagccgggattgtcgccagcgcacgcgatctggtgggcggtatggtggtggtcataccgatggaggccaccattgcggcgattggcagcattaccagcagcaaggacagtagggtgcgggccttgtgccgtagtgcgtcgcgccagccgagtcgcagcgcggcccgataccggttgcaacgtgcgccaaggcttggcctagcggcatggggaatttgggcagagcggccggcggtggcattggcaagattattgagggctgcgcgtgccatcatgctcccctttcctcaaggttgagcaaatcatccatattgctggagccggtttcatcgatgatacagccgtccttcaaaaacaccgtgcggtcggcccaggcggcgaagcgaggctcatgagtgaccagcagtacggccgcgccgcgatctgcgcgggtgcgcaacacttcgagaatcgtcatgccggcattggaatccagagctccggtcggctcgtcggccagtagtagacggcgtgggccgaccagtgcgcgggcaatcgccacacgttgcgcctggccgccggacatgtcttcaggtcggcgatcagccatatcggctactcccacttcattgagggattgcatcgcggcctcacgtgccttgcggggattccagccatccaattccaaggggaacgacacgttctcggctgcgctcagggaaggcagcagattgaaatcctgaaacacgtaacctatcgatttgcggcggatggccgcgcgttcggccactgacagtgtggccagatcgcggccttcgaccagcacgtgcccctgcgtgggcacatcgagcccgcccgcaagattgagcaaagtggatttgccggaaccactggggcccatgatggccacgaattcacccgggcgaagcgtgagattggcgtgactgagcgcggtgacacgacgtgcatctttgccgtgaacgcgagtgacgtcgtgtaattccagcgcgcatggggaagattgcgggagagaagaaagaacgggagaagtcatgatgtgctcctatgcactattgaatggtggcggtgagtgcggctgagcttgccgtgagaggtgccgaaacggggtgctgcgccagttgtgctcgcagctgggtctcatccacggtatcgagccagcgcaattccgcttcagtgatgaaaatgtggtggtcgagtactagacgtgtggcgagttcggtgggcggtgtttgccggcgcagtcgggtgatgtcgtgcagcagttgctgcaaagcgtggcgttggtgttggatgagttcggaaacatcgaggccgggtatttccacggcgacggccagcttcatcaccagttcgtcgcgtccgcgttgttccggggtaatgggggagcgccaccatcggtcaagctcttgggcgccggaattggtcaatcgccataatggtgcggccgctgcggtgccgacatcattggatccgctagtagtcggcgcggtctcttcaatcagtccgtcgcggttcaaccgctgcagcgtagtggaaacttgccccatattgagcggccaagtcagaccgatggtgcggtcgaagtccttcttaagctgataggcgctggccgggcctcgctccaacagtgctaatagcgcttctctgattgccataccgcatcccctttgcatagacggtttgccttgggcgaaggttactgagtaactatcgttggatatcaggttactcagtaactacccatgacggtgctgtactcagggatgattcaggggagattcaggggatacacttggcgcccctcagttgcccacggcgacagctcccctcagggaggggagtcgagagtgtggaatacaaaaagtctcgcaagccagatgacatgtgactaattctcagaaagccgggcccgttgtgtgtcaaggtgtgccagtaacatcgtgacggtttgtgtgtaggtacaggttgatatccaagagcaagtactcgagaacgcaagtaccgaacgattacgcaaaagaatcagtattaagagaggtttcgatggcggttcgtggagatatccgtaatgtggcgattgtggctcacgtcgatcacggcaagaccaccctggtcaatgccatgcttcagcagtcgcacgtgttttccgagcgtgaggaagtgccggatcgtgtaatggattccaacgatctggaacgcgagaagggcatcaccatcctcgccaagaacacggccgtggaatacaccggtccgctggccgccaagtacggccacccggagggcatcaccctcaacatcatcgatacccccggccacgccgacttcggcggcgaggtcgagcgcggcatctccatggtcgacggcgtcgtgctgctcgtggacgcctccgaaggcccgctgccgcagacccgattcgtgctgcgcaaggccctggaggccaagctgccggtcatcctgtgcgtgaacaaggtcgaccgccccgacgcccgtatcgaagaggtcgtcggcgaaacctccgacctgctgctcggcctggccgacgacgtgcagcacgagggcatcgacctgaacctcgaccagctgctggagatgccggtcatctactgcgccgccaaggccggctacgcctccgtgaaccagcccgccgacggtggcctgccggacaacgacaacctcgagccgctgttcgaggccatcatctccaccatcccggcccccgaatacgaggaaggcgccccgctgcaggctcacgtggccaacatcgactcctccgacttcctcggccgactcggtttggtccgtatctacaacggcacccttgagaagggcaagacctacggcctgtcccgtgtggacggctccctcgagaacttccgcgtctccgaactgctgcgcacgcagggcctcgagcgcaccccggtcgagtccgcgggccccggcgacatcgtggccgtcgccggcgtcaacgacatcatgatcggcgagaccatcgtcgaccccaacgacccgaagccgctgccgctcatccacgtggacgatccggccatctccatgaccttcggcaccaacgactccccgctggccggcaccgagggcaaggaccacaagctcaccgcccgcatgatcaaggaccgtctggaccgcgagctcatcggcaacgtctccatcaaggtgttgcccaccgaccgccccgacgcctgggaggtccagggccgtggcgagctggcgctggccgtgctcgccgagcagatgcgtcgcgaaggctacgagctgaccgtcggccgcccgcaggtggtcaccaagaagatcgacggtgtggtcaacgagccgatggaaaataccaccatcgacgtgccggaagagtacatgggtaccgtcacccagctcatggccgaccgtaagggccgtatggacggcatgaccaaccacggctccggttgggtccgcctgcagttcaccgtgccgtcccgtggtctgatcggcttccgcactgctctgctgtccgccactcgcggcaccggcatttcctcctccatctccgctggctatgctccgtgggctggtgccatcaccattcgtcagaacggttccatggtttccgatcgtcagggtgtggccactccgtatgccatgcagcgtctgcaggcccgtggcaacttcttcgtcgaaccgcagtccccggtgtacgagggtcaggtcgtgggcgtgaacaacaagcccgacgagctggatgtgaacatcacgctggccaagcacatgaccaacatgcgttcctccaccgctgacgtgctcgaaaccctgaccccgccgatcaagatgagccttgaggagtccctggacttcgccaacgaggacgagtgcgtggaagtcaccccggagtccatccgcgtgcgcaagatcatcctcggccgtgaggactggtacaagtggcgcgccaagcagcgccgccagaacgccgcccagcagggtaagtgatctggtgcgactgtagccgaccattctctctggctcccctctctgaggggagccaagtttattcctcgccaagtcatatccccacctatactgaaacgcatgactgtgaagagcactactgaactgcgtccgtggtcgtatcgccagaacgcgctggtcaaatcgttgatcacgattgcggcgggcgtggcttccgcctttgtgggcacgttcgcccaccgtatgggtgcagaactgagtattccgtatggtctggtgctggcatttctgctgatcggcctatcgacatggtgcgcccgttcgcgcatgggcgcggtcggactggccctgcacctcatcgcctcctcgctgaccgcatggggcatggcactgaccaccacatccggcaaggcggtcatcgtcgccggattccaaggcgacatgccgttcttctcccagcatgccggctacatctggctgtacggcctgatactggtccaagtcgtcctgctcattcttcccgcccgctggttcgttattcccactcattctgaatcgcgcgcgtaactatatatggcggcacatttccgcgaatgcgtcgcgtatcggcgggcgtaggggattacggccgctaccatagaaccttatggcacgcatgaaactgttttacttgggcccggaaggcaccttcacccatcaggcggcaatgacggccgccgaccagttcgccacactcggcgacttcgacctcaccgccctgcccgacgtgcccgcgatcatgcaggccgtacagtcgcgccaaggctggggcgtcatcgcatgggaaaacaacgtcgaaggctatgtggtcccgaatctcgatgcgctgatcgacgcccccgacgcggccggcttcgcccggatcagtgtggacgtggccttcaacgccttcaccgtgcgcggccacagcatctgcgactgcaccggcaaccccgtcagcgcccacccgcacggcctggcccaatgcacccggttcatcaccgaacaccatttgcagcccgaacccgcatcctccaacgccgccgcctgccgcgacctgaagcccggccgcgtggcgctcggccccagcctctgcggcgaactctacgatctcgacaccctcgccgaacatgtgcaggatttcgatggcgcgcacaccgaattccttgtcatcgccccgcgtgaggtggtccaggagctcaacgcccgcgcccacagcaatgacgccggcgacttcgaaaccatcatcaccttcatcccgctggtcaccggccccggcgtactcgccgacctgctggacgtcctgcgcgatgcgggactgaacatgaccagcttcatctcgcgcccgatcaaaggccacgacggaacctacagcttcatcgccacccttgacgccgccccctgggagccgagattccgcaccgcgctggaagagatcgccggacacggcgactgggcaaaaaccctggccgtctacccacgccgcgaacgcccgaacccgccggtcgacgcctggatgctgcccgagggcggcgtccacatcaccaatcgcgcgccggaaggctggcagtacaccgaggaagcaaggaaggaactgctgtggtagatacagtcggaatcgtcggactcggattgatcggcggctcgctcgcacgccgcctgaccgagcgcggcgtgcgcgtcgtcgcgtggaaccatcgcccgcacccctacgcccaggccgaagccgatggcattttctgcaagagcacgctctccgaactcatggatgccgagccggatgtggtcgtgctgtgcaatccgctcaaggcgatgcccgcaatcctcgccgccctggccccgctcatgggcgaccatccgaacaccacgctcaccgacgtgggctcggtcaagggcatggtccgcgatcaggtcaaggctgccgggctggggaagtgctacgtcggcgcccatccgatggccggcaacgaactgtccggctggcaggccgccgacccgcatctgtacgacggtgccctatgggccatcaccgtggacgagtccacggactaccgccgcttcctcgacgtcgccgcgatgatcaccaaggacgtcggcaaccgcgtcatcgtcgtggacgacgaaacgcatgacaaggccgcggcgatgatctcccacatgccgcatgtggtgtccaccgcgctgatcaacgaactggtcgccaacccggaccgcaacatcgccgccgcgctggccgccggctgctggagggacatgacccgcgtgtccctgaccgacccggaccgcacgcgcgcgatggtcgaggaagactcgctgaacgtcgaagcgctgctgcgccgcatggcggcacgtctgaccgatatggccgaccaactgcacgctggtgccgccggcgagcaggatgtgatgggattcttcgccgaaggcgaccccttccgccggtacaaggccgccgtgacacatgccggcatcaccgctgcacaagacggtacggccaccgctgcgccgcaagccggcacaactgccgccggattcccggaacgcgagctcgccgtccccgaagccggctggcagcagaccctgctgttctccgcacgccgaggagaagccatcaccggcttcgcccatccacgtcaggccatcatccaactgcgccccgccatgtaactgcgtaccgccatgtaggcccgtgcgcaggttcccctcgccgcctgtcacgaagaaggccgcgcgagggggatgaagttcccgcttgttttcgtgagaagaccgtgtggctccgctgttcgaaaggctcaaaggagtaaggtagtctgtaccgtttttcgggaaacgcatcgaagttgatgcggcgaatggttaagggggatgatgacgtatgacgttaccaaggcagattccggccggtgcccgcgtggtggtgcgcatcaccgacggcattgacccggtcgaccaccgtatgaagttccgcgactatgtgggtcacgtggtttcctgggacggatacacgttggagatggtgcgtgacgccgccgccaatggttcgcgcccggcccagaacgtgaccatccatcaggaacagattgccacattgaaacccgtgccggagcggcgcaacacgccaccccggccgtaacccaaggccataaagaattcggaggagaacgagagtgtcatctacgcagttcgacggcgatatcgactccttcgtctcctatctgaagtccaaccgcggcctgtcagcgaatacgctcaaagcgtatcgcgcggatctcacggcatgtctgcacctgttcgagctgcgcggcgtgaccgatctgaacgagatcacgctggatgatctgcgtagctggatggcggtggaatcgcgcgatcacgcccgcagcagcatggcccgcaaaaccgtggccgtgcgcgggttcttcgcgtgggcctatgagcatggggtgaccaacaccgacccggccgccacactgatgactccctcgattcccagcacgctgcccgcggtgctcaccgaatctcaagctgagcagttattggatgtcgccgaacaggccgttgcaacaaaccagtacaagggcgatgggggagcggcagccgcgtccggcagtggcagcggcaaggcagtcggcaagacagctgataagtcagccgacaccgtaaaccgcaacgaggcacccgcccgtgcagacaagcgcgacagcgcccgagtcgtcgccgaatcgcagcgcaacgccgcgattctcgaactactgtatgccaccggcatccgtgtcgccgaactggtgtcgatggatatcgttgacgtcgacttctccaatcgcaccatcaaagtcaccggcaaaggcaacaagcaacgcgtggtgccgttcggactgcccgcccagcgtgcgctggagacttggcttgaacaagggcggcctgtactggcccgtacggcaacggatgcagccaagtcccgtgctaccaacgccctgttcctcggcgcacgaggcggccgtatcgaccaacgcatagcccgtgacatcgtacacagagcggcccgagaggccggcgtaccggacatcagcccccatgcgttgcgccattcggcggccacgcacatgctggacggcggtgccgatctgagggaggtgcaggagatgctcgggcattcctccttgaaaactacacaacgctatacgcacgtctccatcgagcagctcaagaaccgttacggacaggcctttccccgggcatgaccactatgtgggcattggttaacaaacttagcaaagactgaacctagccggtaaaagcccccgaattttacatgggtgtaacaaaaatacgctgcttgtctcccaagtgcgcaaaaatgacaggtaacagcaacggggttgggtgtccgaagcggcgggaagcgtaagtgtcccgacgatgaggaaatccgaccccgttcgcatgaggcgaggctgaaacgcttcgcaacctaatgaataggagaaatcatatgaagaagaaagctcttgctttcgctgccatggcttgctccgtggccatgctgctgagcgcctgcggcggctccaacagtaacgctgcctccggtgacaccgctggctccaacatcatcactgcgtacaactccgaaccgcagaacccgctgatcccgggcaacaccaacgagaccggtggcggcaagccgggtgacctgctgttctcccgtctggtctccttcgacaaggatggcaaggcttccaacgaagtggccgagtccatcaccccgaacgatgacgccacccagtacaccatcaagatcaagtccggctggaagttcaccgacggcaccccggtgaccgccgagtccttcaccaaggcctggtcctacgtggccaacgtcaagaacgcccagaagtgctcctccttcttctccaccatcaagggctacgatgagctccaggctgatggtctgaagggtgacgagcagctctccggcctcaaggtcgtggacgacaccaccttcaccgttgacctgaaccagtccgactccgtgttcccgatcaaggtcggctacctggcctttgccccgctgcctgagtccttctacaaggatccgaaggccttcggcgagaagcctgtctccaatggcccgtacaagctggaccactgggaccacaacaaggaaatcgccctcgtcaagaaccctgactacaagggtaacgagcagcccaagaacgacggtgtgaccttcaaggtctacaccgacgactccgccgcctaccgcgacattcagggcggcaacctcgacgtgatggattccgtcccggccgccttcaccaagaccttcaagactgacaagaaggtccaggcttactccgaggccggctccgttatccagaccttcaccatcccgtcctcccttgaccacttcaagaacgacgaggaaggccagctgcgtcgtcaggccatctccatggccatcaaccgtgaccagctcatcgacaaggtgctcaacggcaacgccaccgccgccaccgagttcacctccccgaagaccccgggctactctgactccctcaagggtgccgacaacctgaagttcaacgcctccaaggccaaggaactgtgggccaaggctgacgccatctccaagtacgacggccagctcaccttctcctacaacgccgatggtggtgccaagccgatttacgatgctgtcgtgaaccagctcaagaagaacctgggcatcgacgcggccaccaacccgatcccgaccttccaggaattccgtgacgccgtcaccaaccgtcagatgaagggcgccttccgtaccggctggcagcctgactacccgtccgccgagaactacctgtggcagctgtactccaccgctgctgctgatggcaacggctccaacgatggtgactacaagagcccggccttcgatgacctgtgcaagcaggccgctgccgcttccagcactgatgacgccaacaagctgtaccagcaggctgaggagatcctcctcaacgaccttccggccatcccgctgtactactccaacgcctccggtgtggcttccctcaacgtgaagtccggctacgccttcgattggcagaacctcccgacctacgccgagatgtccaagaagtgagtctgactcactgaacggataccgttaggtagttcggaaataaagggcgaggaccgcaagatccccgccctttttgttgtgtgagggtgcttgctcccgccagcgggaaccaagttaaagtatccactatccgaccgcaaccatggacatatccaccggcattgcttactctcaaccttgcgttagcgcaaatttacatatcacagtccgggcatgcggtagaatgtcggagtatttatcgaccggcgggggcgtgctatgccctttctggccggtctaggaaataaggagcaaccgtatgggtaagtatcttctgcgacgcatcctgcagatgatccccgtggttctcggtacgacacttctggtctatgcccttgtcttcgccctgccgggcgaccccgtcaaggccatgttcggagacaagcctgtcaatgaggccgtcgcagcccagatccgcgcagaataccatctcgaccagccgttcatcgttcagtactttatctacctgaagaatgcactgaccctgaacttcggcgataccttcgccgggcagcctgttctcgacgaaatcgcccgcgccttcccggtcaccatccggctcggcctgatggcgttcgtgttcgaggcgatcttcggcgtggtcttcggcatcatctcgggcctcaagaagggcaagtggtacgacaccgtcatcctgatcgtctccctgctgctcatttccgtgccgaccttcgtcaccggcttcgtcatgcaatatgtctttggtattcagtgggcgatattgccggtgacggcaggcgcagacccgggcttcatcgacctgctcatgccggccatggtgctcggatcggtgtcgatggcctacatcattcgattgactcgctccgaaatctcctccaacatcgccgaggattacgtgcgcaccgcacgtgccaaaggtatgtcgaacggtcaggtcatgctgcgccacgtgctgcgcaactccctgattccggtcgtcacctaccttggtcaggacatcggcgccctgatgggtggtgccatgatcaccgagcagatcttcaacatccacggcatcggcttcctcacctaccagtccattctgaagggcgaggcaaacctggtggtgtccatcgtcacgttgctcatgctgatcttcgtggtatgcaacctcgtcgtcgacctgctgtacgcggccctcgatccgcgtatccgttacgcgtgatagggaggagtgagtcacatggcaaacgaaaccactgaaaacgagctcaaccagaccggcgagtcggaaaccgaatacttcatggaaaccctgcccggtcaggaccgttatgtagcccccctcgaggagaccccgctgcaggacgtcgattccgtcgatgaatccgcaccggccaccagcatgtgggctgacgcatggcgaaccctgcgccgcaacccgctgttcatcatctccggcttgctgatcctgttcatcatcgtggtggccatcgcccccggtctgttcaccaagcaggatccgaacgcctgcgatctgggcaactccctgagcccctccaccgccggtcaccccttcggcttcgacctgcaaggctgcgatgtgtacacccgcgtggtctacggcacccgtacctcactgtccgtcggcgtgctctccacgctgctggtcgtgatcgtcggtaccctgatcggtgccgtcgccggcttcttcggcggctggatcgacgcagtgctgagccgtatcaccgacatcttcttcgccctgcctatgctgcttggcgccatcgtggtgctccagatgtttaagacctccaagtccatctggaagatcgtgctggtgttgacgctcttcggctgggtcggcgtatgccgtatcgcccgaagcgccgtgctgaaatcgaagaacctcgaattcaacaccgcctccacggccctcggctccacgcctgccaggaatctgttccgccatatcctgccgaactccctggccccgatcatcgtcatcgccaccacttcgctggcctcctacatcgtggccgaagcaaccctaagcttccttggcgtcggcctgccgaccaccacggtgagctggggtggcgacatctccagcgcacagaccaacctgcagaccgatccgatggtgctgttctacccgtccgccgcactggccatcaccgtgcttgcgttcatcatgatgggcgacgccgtcaaggacgccctcgatccgaagagccgtacggcctgagcgaggggagtggagaaacattatgactgacaacaccaacgccaagatgctggctatgcagaaagagcatggtccgctgctcgaggtcaaggatctggccatcgacttcaccactgacaccggcaagccggtgcacgcggtgcgcgatgccaacttcaccgtctaccccggccagtgggtggccatcgtgggcgaatccggctccggcaagtccacctccgccatggccgtgctgggtctgctgcccggcaccggtcacgtggtcaacggctccatcaagctcgacggcgaggaaatcgccggcgccaagcagagcgagttcgacaagctgcgcggcaccaagatgggtctcgtgcctcaggacccgatgagcaacctcaacccggtgtggcgtatcggcacccaggtcaaggaagcactgaaggccaacaacatggacgtggctcacgaaaagcgctccgcccttgccaaggctctggccggcgacgaggtcgaagtcaagggcaacgacgacgagaccttcctcggcgccaaggaactgcccgagctcatgaccgaggccaagaaggctttgactgaagccggcgtgtccggcgaggccttcgacaaggccgtcgcccgcttcaccaacgaatgggttccgggctccgaaacccgttggcgcgtggccgacgacctcatcaaggccggcgtggccgacgaccaggcctggtatctggctaagaagtacgtcaccggctccacaatggatgaccgtatcgcgggtctgctgtccgaggccggtctgcccgacgccgctacccgtgcccgtcagttcccgcacgagttctccggtggtatgcgccagcgcgcgctcatcgccatcggcttggcctgccgccccgatctgctgatcgccgacgagccgacctccgccctcgacgtgaccgtgcagaagcgcatcctcgaccacctgcacatgctcaccgactcgttgggcaccgccgtgctgttcatcacccacgatctgggccttgccgctgagcgcgcccagcacattgtcgtgatgtacaagggtcaggtcgtcgaatccggcccatcccttgaagtgctccagcacccgcagcacccgtacaccaagcgactggtggccgctgccccgtcgctggcctcccagcgcatcatctccgccaaggagcgcggtgagaacgcggacgccctgctcgatcaccacatcgccggcgaaagcacgcttgagaagagcgagcacatcatcaccgtcgaccacttgaccaaggaattcaagctgccccgcaagaaggagatgttcaaggccgtcgacgacgtgtccttctccgtcaagcgcggcaccaccctggccatcgtgggcgaatccggttccggcaagtccaccgtggcgaacatggtgcttcacctcctgaagcccacctccggcaaagtgttctatgaaggtcgcgacacctccacgttcaagtccaaggaccttctgggcttccgccgccacgtgcagccggtgttccagaacccctacggttcgctcgacccgatgtactccatcttccgttccattgaggagccgctgcgcatccacaagatcggcgacaagaagtggcgtgccaaccgtgtcaaggaactgctggacatggtcgagatgccggcttccgtgatgggccgttacccgaacgagctctctggtggccagcgccagcgcatcgccatcgcacgagccatggctctggacccggacgtcatcgtgtgcgatgaggccgtgtccgctttggacgtgctggtgcaggaccaggtgttgcgcctgctcaacgatctgcaggccgaaaagggcctgagctacctgttcatcacccacgatctggccgtggttcgtcagatcgccgacgaggttgtggtgatgcagcacggcaagctcgtggagcatgccaccaccgacgaggtcttcgaccacccgcagaagcagtacacccgagacctgctcgacgccatccccggcggcaagctccaactcggtctggactgataatctgcgtttgagcgcattgtattgggttctttccatccgtggaaagaacccaatattcgtatgcgcaggtttgcatgatggttcgcgtgggacgaaaggcaaaaattggtgttttcccgatgttgtcccacaaattgtgggacaacatcaacatcaatcgatggacatgaatgttgtcccacagcagatttctcacgaagtccggaattacgccattcttagtgtggtcgataattactcatgctgtggggtgtgggacggcccgcgaaaatcgtcgattttcggatgttgtcccacggaatacgtcatacctcgtatgtgatcgtgagtggggcgtgatcggaccagcgtttgtcatacgtgggagccttgtcgatgacgaatccgcgtgcggtctccgccaactcgggcgtggcgaactggtagtcgattctccagccgacattgttgtcgaaagcgcgccctcgctggctccaccaggtgtatggcccctgaatgtcgccggccaacgaacgcatcacatccacgaactcgtattcgtccagccatttgtccacgtaggcacgttcttcgggcagaaatccggcgtgcttctcattggccttggcgttcttgatatcaagcggcgtgtgcgcgatgttgaaatcgccgcagagcacggcctgtttgccgccatgcgcagcctcgtcccgcaacgcgcccatgcgcttcagcatcgtgtccagaaaacggtacttctgttccattttggtcggataatcggtgttgccagcatgcacatatacggatgccacggtgatcgcgtagccctcaggcgttttgacatcggtttcgatccaacgccctgaatccacatcctcgctcagacctggcagcccatatcgcttgtcaagcacttccaagtcggtgagcagtccgactcccgcgcggcctttcacccggcagacctcgttcatggcatggaggttggccggtgcctcgatcttgccggcggtggcgtattcgaaaccaaattcatcgaaaatagaatcgacatcgtcctgaggcgcgcgaacctcctgtatgcaccagacatccggcgcatgcttgccggcccaatcctcgatgcccttgcgcttggccgcacgaatgccgttgacgttagacgtggtaatggtgatggtcatgcggccatactattgtggcctccctacgaatcgaaccggacaccggcggccgcgatgctcagctttctctaagcctgagtgctagtgttagcaaggttgcaaccgttacatgaaacgaggaattatgggactgttcggattcggcaagaagaagagcaagaaggaagccgagccggccgttgagcctgtcgatgaggacaaggtggccgccgaggccgcaaacgccgcagcaaaggcggaaagcgctgaaaccgtattggcggaaccatccagcgaataccagggccgcggagaagagcgaggcccgtgggacgtcaatgatgaggacgtgcccgattatgacgattatctggatctgggcgcctactacctgcccttcctccggggcatccaactgcgtatcaaggccaaccgcgccacccagcaagtgcttggttccaccatcaccttcggctcctccagcctggagatcgaagcctttgccgcacccaagaccctgggactgtgggatgacgttcgcggtgacctgcttgaagccaacaaggccgcttctgaagtggacggtgtgttcggcaccgaactgaagctgccggtcaatgtcaagggcggcaagaccgtgaacacgcgcatcgttggtgtggacggcccgcgctggatgctgcgtggcatcttctccggcaaggctgctatcgatccggacagcccggagaccgaggcgctgaacaagttcttcgccggcatcgtcgtcgagcgtggcgaggagcctttggcgccgcgcgatctgatcccgatgcatccgccggtcgcccccgctgagcgtaaggccgccaaggccgcggccgaagccggcgaggcgaacggcaaggaacacttcaaggacattccggacaacaagccgaagggcccgttgagccaggaccagcagaccgaagtgaagaccacgctgtctcgcggcccgatgttctccgaagttcgctgatttataggaagagacttggcagacaacaaacgcaccggcctgtccgctctagccgacgccggcaatgaaggcgaggatttctccgtcatcgacgccatcggtggcccgcgtggcgtcatcgaatccatgctgcctggcgtggtgttcgtcgtactgttcgtggccacgagcaatctgaatctcaccattgcggtttcggccgtgttggcggtattgcaggttattgtgcgactgattcagcgccagtcggtaatgggcgcggtctctggtctggtggcggtaggcatctgcctgatttgggcatggcagactcatgaggcccgcaattactacatcttcggattcattaccaatgctggctatgccgcgttgcttgccgtgtcgctgattgcgcgcgtgcccggactgggtttggtcgtcgaattcatccgtagcctgcccaccgagcatttcaaggcatggttccatgactggatggacgacaaggccctgaaacgcgcctatatgattgtcaccggcctgtgggtcggtctgttcctgctgcggctggtggtgcaggtgccgctgtatctgaccaaccatgtagctgcactcggcgtgacccgcctgctcatgggcattccgttctgggcattggcgatttgggtgagttacctcattattgccacgccgatgcaccggcataaggtcgcggctaggaagatacagactgaagtcgctgttgatgccgaactcgaaccgagcgcaaccggaaaggacgatgatgcaagctgaagttcgtatcgaacgatacgccgaccaaggccgctgcgtggcccatatcgacggtcgtgtggtgttcgtccgcttcgccttgcccgacgaactcgtgcgagtcgaacttgacgagccccacgaccgggacgaccggttctggaccggcgaagtcgtcgaggttctcgagccgtccgaagaccgagtcaccccggcatggccacttgccggtcccttggcgatgggcgggggagtgggcggcgcggatctcgtgcacgtctctttgcccggccagctcaagtggaaggccatcaccgtctccgaacagatgagccgactcggccatatcgacgtggccgttcccatcgagcgcatgcccggcgacaaggcagccggcggcctcaattggcgtacccgcatcgaaatgattgccgacgacaacggcatgccatccatgcgccggcgcggcacacacaaccgcgtggccatcgacaccatgccgcttgccacgcgcacgctgctggacgtcgccaagcgcgaacacgtgtgggaaggcggctttgaacccggctcccagattcgtctttccgtgcccgaaccgcgcggcgagatcgtcgataccgcggcagcagacgacaattacgccgtacttgtggacggcgaactgcgcgccggctcccagctgctcaccgaacaggtgaccatcaacggcacgaccttcgactatcaggttgacgccaacggtttctggcaagtgcatcgccaagcgccgatcgccctcggtacgcacgtgatcaacctggtcaacgggcagctgcagtcagcggcggacgccgtaatctgggatttgtattccggttccggcctgttcaccctgccgctggccacaatgaccggtgaacgcacccgcatgctcagcgttgaaggcgcgcgtgtggccgtcaagaacgcccagcgcaatctgcgcgccatgaacctgaacgacgtggacgcccgcgcgggtgacgtctcgcgcacgctggaccatgtgccggcgcatctggccaagccgaatgtcgtagtgcttgatccgccgcgtgccggtgctcgtgccaaggtctgccgccagattgccgcggccggcgcatccagcgtggtctacatcgcctgtgatcccaccagcctcgcacgcgacaccgcgacactcatcggcgaaggctacgagctcaaagacatccgtgccttcgatatctacccgatgacccaccatgttgagacggtggccctgtttacccgctgacaggtgagcatatgacacgacgaattctcggattgctggcctgcatggcggctgtgttgtccctggccgcctgcacgccggccggtagggcggtcggcgatacccaagacagcatgccggaagtcgcccacgattccacacatcccacggatgtcacagtcggctttgtggggtcgactgacaccgccgcagacgagttcgtcatcaatgcgctgtctgatgacaaactcaatgtctactatgcctcgctcgaaacatccgcaagctcggcaaacgcaactgatggtgtatccggtgaaaccgaatcttctgacgccggcactaccagcgaaaacggtgccgatagtatggatgctcatactggcgtcgacaagaatgcggtcaccgcacagcagggtgttgccgatttcgtggctcgcgcggtcaaaatcgtggttatcagcggcatcgacgttaccgacgccaaccgggagagctggaaccagacgttgaccaatgcgcgtgaagccggtattccagtcgctctcattgatccaaagcatgcgcccgaagatgaactgctgtacgccgtcatccttcacctcaacaccaacagtgccgattctggcgacactgccgataccaagccaatgactattactgacgccgtgctcaccatcacgcgcgacgaaccccacgaacgcgagatcaaagtcaccgtttcctgagccgaatcaggcccttgaagctgagaaagcaccctgaatcatccctgagccttagcggattgcgaaacaagacgcggtaggctggagaatatgagtgcaacaacagccgtggaaatgcctgagatcggagcgaccggtcttacccccaaagaagtggtgcagcgtatcgaaagtggccaatcgaatgcggtgaaaacatccacctcgcgttcggttcaagatatcgtgcgagccaacgtattcacgctgttcaacggcatcatcttcgccgcgatggtactggtgctgatcaccggttcctggagggacgcggtgttcggtttcgtcatcatcatcaacacgggcatcggcatcgtcaccgaactcagggccaagcgcacgctggacaggctttccatccttgtggcctccgaattcctcgtgcatcgtgacggcagggacgtggaggtgccccacaacgagatcgtgctcgacgacctgctgtggatccgtgccggcgaacaggtgccggccgacgggcagatcatccagacctggggactggagcttgacgagtccatgctcaccggcgaatcgcgtaccgtgcgccacaaggtgggggagcaggtgtattccggcgccaccgcggtctccggcatggcattggtcaaggtcaatgcggtcggcagccattcctacgccgccacgctcaccgcgcaggccaaggtatacaagaaaaccgtgtccgacctgaacaagggcatcaacacgattctgaaattcatgaccttcctcgtggtaccgctgtgcattctgctgattctttcgcagattcatacggtcggcggttggggcacggcactctccaccggcgaatggcggcaagccgtggtttccgcggtcgccggcgtagtaggcatgattcccgaaggcttggtgctgctgacttcgctgaacttcgcggtggccgccatgcgtctcgcccgtcacaatacgctggtgcaggagcttgaatccgtggagacactggctcgcgtggacgcgctgaacctcgataaaaccggcacgatcaccgatggcggtatcgccttcaaccggctcgtgatgctcgattccgccaatgcggctgcggaacaggcagccacgcaggccctctacgactgctgcaacgaagagcagcccaacggcaccggccaagccgtactcgccgggctcaaggcccaaggatatggggcaggtgcggttgagtctcgtgtcccgttctcttcggcgcgcaaatggagtgcggtgcgtaaatccggcgagacctggtacatgggagcgccggaggtgattatttctgcgcttgagggtgactattcgtcggtgttgcagcaggttaacgagtatgccaatgacggcaaccgtgtgttgctggttgcgcggtctacagctcccctctccgaggggagctgtcgccaaaagcgactgaggggagcagttgagggagccaatgtctcggacggccggcaactggatgtgcaggctgagccggtggcgttggtgttgtgctctgagaagattcgcgaggacgccgagcggacgctcgcttggttccgtgagcagggtgtgcgctgtcgtgtgatttccggtgacaatccagtgaccgtgggtgccatcgcccgcagagtgaaactgacaggcgaccatgagccggtggcgatggacgcgcgcgaactgcccgaggacgtgaacgaactggcccgcgtgctcgaaaacgtcgatgtgctcggccgcgtgctgcctgaccagaagaaggccatcgtgcaggcgttgcacacgcagaaccacgtggttgccatgaccggcgacggcgtcaacgacgcgctcgccatcaaggaggcggacctcggcatcgccatgggcaatgcggcgcccgccaccaaggccgtggcccaggtggtgctggtggattcgaagttctcgcacctgccggacgtcgtggcgcggggccgtcaggtcatggccaatatggagcgcgtggccagcctgttcctcgtcaaaaccgtgtactccgcgctgatctcgctcggcgtagtgctgacgcaaatcccatacccatacctgccgcgccatatcacgtatatcggcgctctcaccatcggcatgcccgcgttcattctggcgctcgcgccgaacacgcgccgctatattccgggattcctcaagcgcgtggtcacgttcgcgctgccgggcggcatcgccaccgcgctgtcggtgctgctggccgcttgggtgctgccgccggtcatgggctggaacgtgaccggcgatgccgcggacctgtccgccctgcgcgccaccagcgccatcatcctgttcgcgatgggcgtgttcgtgctggcccgcgtggccagaccactcaacggttggcgtggcgtgctggtggcggtgttcgcggcggcgggcgtaatcggcgcgttcgtcccgttcgtggcgaacttcttcgccctgattctgccgaccggcgccacgatggtggccacgctgatcgcgttggccggttccgcgctgatcttcgcgctgtgcctgtggctggcgccgctcgtgcgcggactgacgggcaagctctcgcgtcggcattgagacggcggcgcgtttgtctcatacttcaagccgacacgccagagcctcggtaacgtgcccgtaccatgtgtagcggataatcagcggcatcataagccgattcatgatttcggaggaagcatgtccttacgcgacgaccagctggctaccctcaaggcagccggcaaggacttcgattactacaacatcgccaatctcgacggcatcgatcatctgccgtactcgctgaaggtactggtcgagaatctggtgcgcaacatcgacggtgccaacatcaccgacgagcacgtcaagaccctgctcgactgggatccgaacgccgaacccagccacgaaatccagttcacgccgtcccgcgtgatcatgcaggacttcaccggcgtgccctgcatcgtggacctcgccaccatgcgtgacgcggtcaaggacctcggcggcgacccggaggtcatcaacccgcaggtccagtccgacatggtcatcgaccactccgtgcagatcgacaagtacggcatcgccgacgcggtccagcaaaacatggacatcgagtaccagcgcaacggcgaacgctaccagttcctgcgctggggtcagcaggcattcaagaacttccgcgtggtgccgccgggaaccggcattatccaccaggtcaacatcgaatacttggccaaggtggtcatgagcaaggccgaggccaacggcaacgcgctcgcctacctcgactcctgcgtgggcaccgactcgcacaccaccaccgaaaacggtctgggcgtgctcggctggggcgtcggcggcatcgaggccgaggccgccatgctcggccagccgatctccatgctcgtgccgcgcgtggtcggcttcaagctcaccggctccatcccggagggcgttaccgccaccgatgtggtcctgaccatcaccgacatgctccgcaagcacggcgtggtcggtaagttcgtggaattctacggcgaaggcatcgcctccgtgccgctggccaaccgcgccaccatcggcaacatgggccccgagttcggctccacctgcggcatcttcccgattgacaatgtcacgctcgactacctgcgcctgaccggccgctccgaagagcaggtcgcgttggtcgaagcctacgccaaggccaacaagctgtggggcgacgcttccgacccggattacgtggaaccgcagtactccgaatacgaggaactcgacctcggtaccgtggtgccgtccatcgctggcccgaagcgcccgcaggaccgcattctgctgtccgaagccaagagcatgttcgagaagaccgcccccgcctacgagaccgagaagaccgtcaaggatccggtggccgtgtccaccgacttccgtggcgatttcgacatcgaaaacggcgacgtggccatcgcctcgatcacctcatgcaccaacacctccaacccgtccgtgatgatcgccgccggcctgatcgcccgcaacgcacatgccaagggccttaagcccaagccctgggtcaagacctcgctggctcccggctcgcaggtcgtggccgactacctcaaggccgcggggctgcaggacgacctcgatgcactcggctaccagctcgtcggcttcggctgcgccacctgcatcggcaactccggcccgctgctgcccgagatttccgaggcgatcaacgccaacgacctgaccgtcaccgccgtgctttccggcaaccgcaacttcgaaggccgcatcagcccggacgtcaagatgaactacctggtctccccgccgctggtcatcgcctacgcgctcgccggcacgatggacttcgacttcgagacccagccgctcggcaccgacgcggacggcaacgacgtgtacttgaaggacatctggcccaccaatgccgaggtcgccgccgtggtcgacggcagcgtgagccgcgagatgttcctcaaggactacgcctccgtgttcgacggcgaccaccgctggaagggcctcgacgtgccggaaggcgagctgttcgcgtggaacgacaagtccacctatgtgcgcaagcaaaccttcttcgacggcatgaaggccacgccggacccggtcgccgatatccacggcgcccgtgtgctggccctcctgggcgactcggtcaccaccgaccacatctccccggcaggcgcgttcaaggcctccagcccggccggcaagtatctgaccgagcgcggcgtggagccgaagaacttcaactcttacggttctcgccgaggcaaccacgagatcatggtgcgcggcacgttcggcaacatccgtctgcgcaaccagctgctcgcctccgtgggcgaggaggtgacgcctggcggcttcacctacgacttcctcgccaagaagccgaccacgatcttcgaagcctcccgcgactacatcgacaacaaggtgccgctcgtggtgctcgccggcaaggaatacggcaccggctcctcgcgcgactgggccgccaagggcacggtgatgctcggcgtcaaggccgtgatcaccgaaagcttcgagcgcatccaccgctccaacctgatcggcatgggcgtgctgccgctgcagttcccggcaggcgaatcctatgagtccctgggcctcaacggcaccgagacctacgatatcgccggcgtcgagaagcttaacgagggcgtgacccccaagacggtccacgtcaccgccacccacgaggacggctccaagaccgagttcgacgcggtggtccgcatcgacacgcccggtgaggccgactactaccgtaacggcggcatcctccagtacgtgctgcgcaacctcatgaagtaaccaccttcttggctcccctctcttgaggggagctgtcagcgaagctgactgaggagagcaaggccggtatccgccaacggataccggccttttccacgcatgccaaaatgctatactgtatagcatcttcgaaatggaggttgccatgaccatggtccaaatgaacgttcgcattgatgcgaaactgaagaacgaggtcgaagaagtcctcaagggcaaaggcgtatcggtgagtgacgtaatccggtcgctgtggttgtacatcgccgaccgcaaggaagtgccggcattggaaacgaccgccgaagagcaagcccgcgaggaggaaaagcagcgcaagctgaaactgattcgagaaggtgccggatacgtacacaaggaactggtcaaggccggactgatctcagaagacaccgacctcatggaaggccttacctacaagcagttccgcgacaaaatgtacgacgagcaacttgatgcgtattacaacatgaagagggccgattgatgaccgacgtttccatgcagcgtattttgctcgataccaacgtactgttggactatttgctccatcgcgatgatcacgccaagatggcggaagcggttatggaacttggcgcgaagaacaacattacgttgttgtgcgcgtcattgtcgctgaaggatatcgcatacctatcatcatcggcgattcgtagggaattcaaaccgaatgaatcggaagtggagaatttcactcgcggctttctgtcgtcacgggtgccatggcgttgtatcgagcaggtgaaggagatgtgtgacatcgtcgctgtcgatgagtcgacatgtgataaggctttttccctgcaaaaacggcatcgggattttgaagatgatctgatcatcgttgccgcgcaacaatccggtgccaactgtgtggtcacatcggatgccgaattaatcagtcattttcccgaatattgcaaaacaccggctgaaatcgtggcggcgctggaataaatgagcgtgtggctcccctcacggagggggagccaccaatgacgtgccggcttactgtagcctactgcgcctgcagacggaactgcttccagatgtcactgagcttctggccgttacgcgtgcgcttccacacgtccagaccgccgccgcgacgtcctccggcggcggcacgggccgcggcggtcggagtcggatattcggagccgtcatccagacggagacgaccgttttcggtgaccgtggcaaaccagcgctcgcccttgcgcggccgctcccacaccagacgttcgcccggcaccagaagacccgcgtcaatcacctgccggatcgtgacgcgccgcgaactatgagacggccgtggagaagtcttcgacaactcatcgacattctgcttggtcagatcgcgggcgtccttgtcataccggatgccccagtattccacgatgagtcggaccgcctcttcctgccgcgcttccagcaatgcgggtgtgcagtcagcgaaatccttcaactgattggtcagcgggaaacgacgcgaatccgcgcgcagcagcatgcggtcgcgacgtgccggatattcactcaacctgtccaactgatcctcagggccctgcaccagcgccatattgccgagtcggtacatccagaaatcatgctgatcctgcggccagtccgcaaacgatttcgaccgttcgatatccaacggcataatcggcagcgcactgaaccggcgtggtcgatccaactgcatgccggccttctgctcgttggcgcgaatcagcagcagacggaccaaatcgccgtcaccctgcatctcgccatgcaaacggaccaatgcgccttcacggtcgccgtccgagacatgcaacccgttcacgcgctggaccaaatagcccttgtcaagatcacggatggcggcgttcgcataaccgcgccgctccaacgctccagtgcgattcagcgtgcggatgccggtcacctgttccaatgcggtcagaatttccagcagccgacgctcgtcatgggcacccaacgattccagcgtggccgtggttctggcgatacgcgaggcacgaaccacaaacggcgacaaatcggcgtcgcccagcccgcgatacgaattgaccaacgcccacatggccacgggcttccactcgtggctgcggtaatcatccaatccctcaagccggctacgcacctcggcgggcagtacggtatcgctggggcgtgcgatgatccgccacgccatcgcgtagggtgccagcacctggttgatgaacgtgggcaccgtgcctttgtcgatgtacggttgcagcacgtcggccaggaaatcctcgatgagcttgtcggtggccggcttgtgcgtgagcacgagatgcagataggcgaagaattcctcacagtcatgcggatcgtcgccaatcgggtcaatgatgtcatcccaacgggcggcgtacacgtcaagttcggcggtcgacaggccggccgtggcgcgcgccttgaacacgtcggacgaggtgagcggcaggccgcgcatgttcatcacgtcgaagatgcgatgcgcgccgtcgagatcgtcggtggtcacgatgaccagcgtcacctcgttgaccagatactgcgcgaattgctggcgttcggcatccgaccaattggaaatctcgtcgtacgtcttacggatgttggctacgatattgcgttgcgctgcggtcgccagatcatcgtcgttcatatcgaacacggattcgagattgtcttcctgcacgtgttcgcggaagaacgctgcgtcgcgctcgcgcaacgtgaggcgaggctcggtgacgatgccgcgcagcttgtcgccgggctccaccagcagcgcatcgagttggcgcatgaggtccgggtcgcgctccagatcgcgcaacacggcgatgatgatcgacagggataccagccgctgctgcccgtcgattacgtcgtaacggttatcgccctcgcgcaccagaattagcgagccgaggaagtacggagtaccgggcgacttgcaggcgtcatccaagtcgcttaccagttgcaggatgttctcggtcttccagatgtaggcccgctggaatgaggggatcgtgaaccggaaatccggggtgaacactttcccgagtggtagttccttcgcactgattgccatgtcagccccttcgtcgccggcctgtggacggtatgccggcataccaacttgtgctcaagcctaccagtgtttgcccgacggcgggcacatcacgccggctcgggcaccgacccctcatacaagtagaacgaagacgggttttctcccggcacggatgcgggcagtgactgctcgcacacctgcgtcaggccgcgatgtacatagaatccgacatcgcacgtggtatccgtgaataggaagtattgacgtatgccggctgcgtggaatgcgctcatcatcgtctcgaacatgcgccggcccagaccgtgaccgcgcgccgccggatcaagtacgaacagcaccacttcagccgaatactcatggccaatgttcgccgcctgcttacgcagttgcctatcgacatgaagagtcccgagaatctcgctcgcagctgccatgccgtcgtgggcaaacgccagttgcaatagcttgcgcaacgaatgacgccggtgcatgttcagcgggctgcgatggtcgagctcgtcgatacgccccacaatcaatgcgacgggtttatcttccagctccgcgacaaaggccgtggtcacacgtgccagacagttctcccaatcggcctcggctgccagcaagccggtccgctcatcatattcggcgtaccaagtgcggcgcaccaggtcgatcagcgccggataatcgtctttacgtaacgttcgaataatcgcttcactcatgttctccattatgactgatatggctcgataaccggacgtgttacagtcgtgccggcaaatcggcccgctccaccagcctcgccatctgtacgcggcccatattgagcttgtccgccgcggaggagagatgcgccttggccgtacgctccgagataaacatacgggaggcgatttcggtgttgggctatgtgctgcaagacgattcgccgattacggtgtatgccacgcgcatggtggaaacgcccgttacgctttgagatgagcagaacgagccgatcgatcatattcatggaatgttcagctttgttcctctaagattggtactggaacaaacgctaaaggagcgattatgacattcggtcagcagccccagaacaacgggcaatacaacccgcaatacaacacgcctgattacaacgccgcccaacagtctggatatggccagcaatacgcacagtccggttacggccagaactactatgcccagccgcagggcgctcccacctaccaatacgtgccgcagggtactggtgccggtgcgggtgcggccaccatcaacacgacgatgacctacaactatgaggaagcccgccgagtctcagtgaccaaggtgtacggcgagatgaccatcggcatcctcgtcaccgccgtggtcgccgtgctcggccagatcactggagcctactacagcttcctcatggccaccggcatggtgggcctcatcggcctgtgcgtggtgcagattgccctggccgtggtgctcggcatgcgcgtcaccaagatgaagtcggccaccgcgcgcgtcatgttctatgtgtacgccgcattgatgggcttcaccttgagctcgatcttcatggtctacgacctcggctcgatcggcgtggcactcggtgtcaccgccgcgttcttctttgcgctgaccatgttcggcatgactaccaagttcaacatgctcaaggccggcccgatcctgatgatcggcctgattgtgctcatcatctcgcagatcgtgctcgccttcgtgcaggtcgacggcatgaccaagatcgtctgcgccatcggcctgatcctgttcgccggcatgaccatctacgacgcgcagtccacgcgcgcgctgctgaccgaatacgaggcccagggcccggaaatggtcaagaagatctccatcctgtgcgccctgaacctgtacctcgacttcgtgaacatgttcctgtacatcctgcagctgctcggcaacagggactagcctcgacagccgattggcgagcggcatgtagcctgcccgtcaaacgtcacagcccgaccacattgtggccgggctttttcatgtctgtcacattcgcacgttaggctggctccccgtgaaaagacaagaactcgtaggcatgctgagcctgttgttgaccgcgctgatctggggttttgcgttcgtggcgcaggtccagggcatggattcgatgtcgccgatgttcttcaacgccgcgcgcttcacgctgggagcactgtctttggtgccgattctgctgtggatgcgtggccgggggagcgcggataagggcgatacagccggggccgatgtcgttgggaccgaggcatccgtggccgtctccacagatgccgcatcgaacggtgcatccgacgtcgttaccatcaccggtgccaagctgaatgcgaacaagcccgattcggccgtggcgcgattgctcgccaacccggtggtcatttccgtgatctgcggcatcgtgctgttcaccgccagcaccctgcagcagtatggcattctgtacggcaaatcggccggccgtgcgggattcctgaccgccatgtacatcgtgatggtgccgttgctggccttcgtgttcctgcgccggcgcatcggcatgctggtgttcgtggccgtggcgctgtccatcgccggcttctatctgctgtgcatcaccgatggtttcggttcgatcggcctggcggatatcctgctcgtgttcacggccgtgctgttcgccgtgcatattctggtgatcgatactttgggcggcaccgtggacgccatcaagctttcattcggccagttctgcaccaccgccgtgctgagctgggcgggttcgctgatcgaaggctcggtcgactgggccggcgctgctcattcctggattccgattctgtacgccggcatcggctcggtgggcatcgcgtacaccttgcaggtggtcggccagcaatgggtgccaccgacgcgagccagcctgctgatgagcctcgaatcgttcttctcggcggtaggcggtgcgttgcttctcggtgaggtgatgaccccgcgcggctacctcggctgcgccctcatcttcctcggcaccctactggcccaagcgccggccaggctgccgaagtggccgcaacggtgaatgaatcggccacaggccgattccatagcacctcagtccgaggtcttaggcgcttcgcccacttgcggcgcgccgttgatgtcgcggtggatgttctgcatctgtacctcgatgttctgcaatgagcgcgcgcagtcgagcagcgtctgggaatgctcggcgagcttgttgtccggcaaatcggtcttgtagcgcagcgcatgctccagcgacgcccaataatccatggcgatggtgcggaactgcacctccaccggcgtgtaatgcgcgcccgaggagaggaacacgggcaccgcgtagattacgtgcaatgaacgatacccgttctgtttcgggttcttgatgtaatccttgacgcgcagcacctgaatatcggactgcgacgacagatagttggacacggaatacacgtcgtcgcggtaattacagatcacgcggatgccggccacatcgaacagattgtccttaatcgaattgacgccgatcggcagacccttgcgctccagtttgccgatgatcgagctcaccgacttcagacggcgttccatatgatgtatcgggtcatggctgaaccgcacctggaactcgtcgtcgagaatctccagtttggtgctgatctcgtacatcgcgccttcatacacctgcatgaggtcaacgaattcaacgacctgttcgggagtgaaggtgcctcccggaagatccaacgctttgagacgggcttgcagatcggaggttttgagtcggctatgtcggtcaagtatcacgtccaccaatatactcggcggattccagccaatctggacgttcgcggggaatctttccaagaacccataatttgacatcgtgacaaccaatggcatacgtgaccggagcatgacgaaccccgtcgatagaatcggtcgttatgaatgaagacatgatgaccgaggcggagcgcgcctcgattgcagccgatggaaccgatggtttgctggggaaacgcggcaagggcgtgttccatatccatacgctcggctgccagatgaacgtgcacgattccgagcgcatcgccggcgtgctggaggccaatggctacgtgcctgcaaccgaggaccagatcaatgacaatgacctcgatttgctggtgctcaatacctgtgcggtacgcgagaacgcagccgaacgcatgtatggcaccattggccgattcaatcgcgtcaaactggttcggccgaacctgcagatcgccgttggcggctgcatggcccagcttgaccgcaagaagatcgcggatactgcgccatgggtttccgcggtgttcggtaccaagaacatcgaagatctgcccaagctgttggatcagaatcgtgcgaccggcaaggcgcaggtccaggtcactgaacaattgcggcagttcccgagccagcttcccgccgcccgcgcctcccgcatcagctcgtgggtggcgatttccgtgggctgcaataacacctgcacgttctgtattgtgcccaccacgcgaggcaaggaaaaggaccgccgccccggtgacattcttgatgagattcgccaatgtgtggccgatggtgccaaggaggttacgcttctcggccagaacgtgaattcgttcggttatggtattggcgatcgatacgctttcagcaagctgttgcgcgcctgcggcaccatcgacggtctcgaacgcgtgcgcttcacctcgccgcacccggccgccttcaccgacgacgtcatcgccgcgatggccgaaacgccgaacatcatgcaccagctgcacttcccgctgcagtccggctccgaccgcatcctgcgcgcgatgcgccgctcctaccgctccgccaagttcctcgacatactgggccgcatccgcgccgccatgcccgacgcgcagatctccaccgacatcatcgtcggcttccccggcgaaaccgaagaggacttccagcagaccatggacgtggtgcgccaggcgcgcttctcctcggcgttcacgttcatctactcgccacgccccggcacgccggccgccgcaatggaacagattccgcgcgacgtggtgcaggaccggttcgaccgtctggtggcgttgcaggagcagatcaccgaagagaacctcgccacattcgagggccgcgacgtcgaagtgatgatcaccggcaaactcggcaagaaggacaccgacacccaccgtgtcaccggccgcgagaaaaccggcgtgctggtgcacatcggcgtgcctgaaggcgaaccggtacctgaaatcggcgatttcgtcacggccaccgtcacacacgccggccgccataatctgcttgccgaccccgacgtggccgccggccagacctattccgtgcggcactgagggggcgtatatgacgcaacgagtcgtctccatcgtcggtcccaccgcgtccggcaagacggggttgggcatcgccatcgcccggcgtctggccgaagcgggggagcgggccgaaatcgtgaacgcggacgcctaccagatgtaccgcggcatggatatcggcaccgccaaacccaccgccgaggaacaggcggccgtgccgcaccatctcatcgacatcatcgaccccgaagacacgatgagcgtggcccgcttccaacagcttgcgcgcgagaccatcgccgacctgcaatcacgtggcatccggccgattctcgtcggcggctccggcttgtacgccagagcggccatcgatgacatcacctttcccggcaccgatcccgacgtgcgcacacgtcttgaggaacgcgagaaaaccgagggtgccggtgctttgttcgacgagctgcgggccaaagaccccgaggccgccgcgcgcatggacccacgcaatccacgccgcaccatccgtgcgctggaggtcatcgagcttaccggtaaaccgtattcggccagtctgccgcgctaccggtacgtgattccgtccgtgcagatcggactcgacctggaccgcccggatttggatcatcgcatcgatttgcgcaccaagcagatgtatgacgatgggttcatcgaagaagtcgaacggttgcgcccgcatctgggtgccaccgccgtacgtgcgctcggctatcagcagatcatcgacctgctggacggcatctgggatgtgaacgacgccttcgcggacatcgcacagaaaaccaagcgactcgcccgcaaacagatgggatggttcggccgtgacccgcgcatccactggctgcaggccctgaacccgaaactggtcgacaacgtgatggccattatcgcgcacgccgacgccggcgactacgacccgatcgacgcccgagccgacgaatacacccagcatcatctgggggatatcacggcgtaggaatcagccaaaggccgatgcaatcacccgcaatcagtgtgcaggcccctgattccagccggcgatcaagaacacgcgcgtcggattcgccgggcgtagtatagcgtcgaacatcgtctccagtgcagacgtgtcgccccgatatgccgagtgcttggcggagcgatactcctcgcgcgtcactgagccccagtcgagatcccagccggcgtcatgcgccaagcgtgaaccgaatatacgcagcaccatcgcattgccgccacggaacggatgcagataaccgagctcatcataaatagaagcgaacgcgtgaacgaacacgtcgcgatccaacgcatgcaggttgcgtttgtccgccaactccatcgcgatgttgtgtgtgccggtctcaatgagcccagccgggaagaacgcctcaggattcgcggctcgagcccggtcgttcgtcacctcgcgtgtggtgtttgaggtacgcaacttgcccgcatcctcgaacacgccttcgaacagccccttatgaatggcggtcagctcatccaagtcgccagacggattccatcgacgttccgccaacaacacggtacgtgcgaacaccgcatccgcccgatccgtggcatgatcatccagactgccggcagccagacgatcctttccggcagggtcggcggcggcgcgcagacgcatggcggtctgttcgtccgccacgtcgatgagatgggtcacgggcttcaagccgcgttcgtaggcagccgcggcgcgcatcgttgcctcgcccggcgtcatcgcttccagtgcgcagttcttgagtgcaaatgcgactgcgctcgcacgctctgcgggtgtcatgcaacccatgataaggcatattcgcgccccagcggggaatcgactcagacgaacgcggcgaatcggctgtcgggattcgtcaatcgaccatatcgtcacggtgtcgtcaccaaccatgcacccccgtactagtagaatcagacccgatatggcacgaacagcatcctccaacagcaccaaaccccgtaaatccaaagacaacgggtctacccatgatggcgaaaccaaggtccagcccgagcttgacctcgaacctgagccgttgtggaagaagatcctgctcgcgattccgcgcgcgttcggctccggcgtacgcgccgtcaccggcgtcggcgaatacgatccagcctaccgtcgtgacggtttgtgcttcctgctgctcgtgctcgccgtactgttctgcgcgtccgaatggttccgcgtcagcggtccattcggccagctgcttcacgccatcgcggccggtgtgcttggtctgatgagcgtcgtgctgccggtgttgctcgccgccgtggccttccgactcatgcgcaattccggtaaagggtccaataacccgcgtgtggtcaccggttgggtgctgctcatgtggtcgatttgttcgatcatcgacgtggcgatcgccgccgaccacaccggattcgacatcacgattctgcaatccgccggcggcctgttcggcttcttcctcggctcaccgctcgcctggggcctttccaacgtgttcgccatcatcattttcgtggtcgtcggcctgttctccttgctgatgattaccggcacccacgtcaccgatttgccggaggatgcgcgcaaaatcgccgctaaaatccagcgcaaaccgtatgtgccgatgggccaggagacggatgggagcgccagccagttccccaacgaggtccgtgtgggagataccactctcgcctttgccgacggtgttccctcgcatgacggcgacgatgacggcaacgacgacgatcaggccggcgatgcacggcccagcctgttcgcacgactgttcggccgcaaatccaagaccgaagacgacaaaactcttgacaagtatgctgccgacgatccgttcgaccgtgccgccagccagcatggtgccaccgccgaaaccccggtggtcgatccgatgaccggcgagattaccggtgcgcgaaccattgcatcgtcttcgtacgacggccgtccgcacctatccagccctgcgcctgctgccgatgcggatgatggcgacgcttcccgaacccgcgtcatcaccagtggccagaccgtcgccatgcccggtgggggagcggtagacgatccgtgggcacccagtgttgcccaggccggtactgtcgcgctcgcaggggcagccggtgcgatgggagcggccggagccgccggtgccgcggctgcggcagccgcgaccggagcctacgcgggtgccgatgcggacggcagcggagtcggccagggcgtgcccaatacgggcggccagccgaatgccaccgccggcaacgatacagacgacgacgccaataggccgtatcagttgcccgacctgaacctgctgaccaaaggccagccccatgcgatgcgcaccccggccaacgatcgcgtgatccgggcgctgacttccaccttcgaacagttcaacgtggatgccaaagtcgtcggcttcctgcgtggcccctcggtcacccaatatgaggtcgagcttggccccggcgtcaaggtggagaaagtcaccaacctgcagcgcaacatcgcctacgcggtggccagttcggatgtgcgtatcctttcaccgattcccggcaagtccgccatcggcatcgaaatcccgaacgaggatcgcgaaatcgtgcacttgggcgacgtactgcgctccgacaaggccgtgggcgatccgaacccgatgctctccggcatcggcaaggacgtcgaaggccacttcgtgaccgccgacctgaccaagatgccgcacctgctggtggccggtgccaccggttccggtaagtcgagttttatcaactcgatgctcacttcgatcatcatgcgtgccacgcccgaacaggtgcgtctgatcatggtggatcccaagcgcgtggaactgtccgcctacgcaggcatcccgcacctgctgaccccgatcatcaccgatccgaagaaagccgcacaggccctcgaatgggtggtcaaagagatggatgcacgctactccgacctcgaattcttcggattccgccacgtcaaggacttcaacgaggccgtgcgcgccggcaaggtacatgcgcccgccggctcccagcgcaaggtggccccctatccgtacatcctcgtggtggtcgacgagatggccgaccttatgatggtggccaagaacgatgtggaaagctccatccagcgcatcacccagctggcacgagccgccggtgtgcatctggtgctcgccacccagcgtccgtccgtggacgtggtcaccggtctgatcaaggccaacattccatcccgactggcgttcgccacctcgtccgccaccgattcgcgagtcattcttgacacggtcggtgccgagaccctgattggtcagggcgatgcgttgttcctgccgatgggttccgccaagccgattcgtgtgcagggctcgtgggtgtccgaatccgagattcgcaaggccgtggagttcgtgcgcacccagcgcaagccgaaataccgcgaagacatcgaacagatggccaaggaagccgaaaagaaagacagcatggagcccgacgaggagatcggcgacgacatggacgtgctgctgcaggccgccgaactcgtggtcaccagccaattcggctccacctcgatgctgcagcgcaagctcagggtcggcttcgccaaggccggccgactcatggacctgctcgaatcgcgtggcgtggtcgggccgtccgaaggctcgaaggcccgcgaagtgctcgtccagccgcaggacctgccgcaggtgctcgccttcatccgaggcgaaaccagctcgctcgaagccaccgccccgcaacagcccgaactcggcgaataattcacccatcgaccttcctctgatgagggaggtgccccgaaggggcggagagagaagcgcggccacgcggccatcagcacgcaacctgattcccgaataatggcagtcaatatccagccaatactcactcaaggtagaagtgtgggggtaacgtgaacactatggatgagaacacaatggacaagcagtcatcgcccaaatcatcgctgttcgacggatggaacgcgccgccgaacctagtcacctactcgcgcatcgtactcgtggtgattttcctgacactcgacattctcgccggtgcctggggtgagaacaacctgaccatgcgctgggtcgccgcggtgctgttcatcatcgccgcgtccaccgataaaatcgacggttggatggcccgcaaatacaatcaggtcaccgaaatgggcaagctcatggatccgatcgcggataagctgctcacttgcggcgcaatgattgtatgctccgcgttcggcgagctcagctggtgggtaaccatcctgttcctgattcgcgaaattggtatcaccgttatgcgtttcttcgttatggagcgtccgggcggcaaagtcatcgccgccgcatggcccggcaagctcaagaccgtattccagtgcgtgggtctgtccatgctgctgctgccgttctggtctctgggtaacggacaagccacgccgttctggatgaccgcttactacttcctgacctacgccatcatctacgtggcattggtcctgtgcctctactcgggtgccgtgtacctgtataacacgttcgtcgccccgaagcggaagtgacggatattccaatgcgggaattgtgcgacagtctcgcggccggcatcctcaagatttgcgaggcgaacaatacgaaaatcgcctgcgctgaatccctgaccggtggcctgcttgccgatgcgttcgtgcgtattcccggcgcctccaacgtgttgttgggctccgctgtcacctacgacatcaatgccaaggcctcgatcctgcacgtggacaaggccctattggatcgagaaggtgccgtacaccccgaagtcgcccggcagatggccatcggtaccgctcgcctatacagccagccggaatacggcgaccgaatcatcggcctttccaccaccggcgtggccggccccggtccggacggtgacaagccggccggactggtgtatgtgggcctgcgcatccccgcaagcctcaccgcggaccatgccgaagtgctcaaagccgtcgaactccatcttgatggcatgcgcgaagaggttcgtcgcctcaccgtattccacgttctgcaaaacttgagtctattcacagcaagttttaaggaataaaaccgttgggttgtcgtgttgtacatagtggaaacactgaaccgacctgggaaggggcgatggcgatggaaacgatgacccgagtgaacgaacagatggatgtggccgccaagaagccgatggctgtgcagccgggtgtcgcccgtatgcgtgaactgactccggcccagcgccgtgcggtgatgttcgcccagcagcaggtgctcaaggcacaggccgccaagaaggccaaggatcagcgtcaagccgttcgtgaacgtatgtgggatgaggattcgccgtcgtacaagccgactgccgccgccgagcccgtggtggctgaggaggagcctcgcgagttttcgctgcgtggtgctatcggtcatgtgctgcgcgagctgcgcacgcgcgatcgccgcacgttgcgtgaagtctccgagaaggcaggcgtttcgctaggctacctttccgaagtcgaacgtggacagaaggaagccagctccgaactgctgagctccatcgccgatgcgctcggagtctccacttcgcgcatgctgcgcatggtggctgattatctcgactcggtcgagggctgatcggttggcggtgtgaagccgcgtcccgtaatctatgtctagctgtgaacccgtatcgcttgtggcgatgcgggtttttgctgtcctgcggttggtggcacactggcgtgtatgcgtgaacgggaattctgggaattacttgaagaggtgttcggtcggacctacggtcgttcgctgtcgcgtgatcaacggatgcccaaactggcgaatatgaccgtggtcgaggcgctggacgcgggggaggagccacgcgtggtctggaatgtgctctgcgaccaaatggaggttccggactccaagcgttggggccacgatcataacgctccgcccatgcccgccgtctgacactgcgggattacggagtcgctgaatcgtgaaattggcgatttcggcgtgttgcacgccaaattcgaacaaatgttcgtgtgtgtggttatagttatccacagtgacaagaagccgcatacgtgtgcacagggtgcttgccatctgccataatccttaccgcagtagggcttaaggaggccaggtggccaagctcgggcaagctggaaccacaatggttggtttggattgcctcacatggcatgtccgtcatacggtggaggcatccgattcgcacacgacttcgacaaggagaagatcatggcacttgagaccaagccggccaaggacccggcagctgaggacaagcacgagctcgatcccaagcgcaaggcggcgctggacaccgcgctggcgcaggtcgagaagagttttggcaaaggttccgcaatgcgactgggcgaccagcccgagcagaacgtcgaggtgattcccaccggttcgttggctctcgatatggcgctcggcatcggcggcctacccaagggccgcatcgtggagatctacggccccgaatcatccggtaagaccacgctcgcattgcatgtggtggccaatgcccagaagaagggcggtgtggcggcctacatcgatgccgaacacgcgctcgacccggcctacgcccgcaagctcggcgtggacaccgactcactcatcgtctcccagccggataacggcgagcaggccctcgaaatcgctgacatgctgattcgctccggtgcgcttgacgtcatcgtcatcgactcggtcgccgctttggtgccgaaggccgaaatcgaaggcgaaatgggagacagccatgttggtttgcaggcccgactcatgagtcaggcgctgcgcaagatgaccggcgcgttggctcaggccggcaccaccgccatcttcatcaaccagctgcgtgagaagatcggcgtgttcttcggcaaccctgaaaccaccaccggtggtaaagctctgaagttctacgcctccgtgcgtctcgacatccgccgcatccagaccttgaagaacggcgacgaagcggtgggcaaccgcacgcgcgtcaaggtggtcaagaacaagatggccccgcctttcaagtccgccgaattcgacatgctctacggtgaaggcatttcccgtgagggctcggtgatcgacatggcccagcaggttggtgtggtcaagaagtccggttcgtggttcacctatgagggtgatcagctcggtcagggacgagagaaggtccgtcagttccttaaggacaacccggccatcaccgaggagattgagaacaaggtcaaggccgagttcggtctgatcggttccgccgatcagttcgcggaagatggcgaagccgcagcagcggccgccgtcagcgaggctgctgcggccgacgtggccaaggacagcaaggccgcagcggcgcctgctgccaaaacgacccgtgccaaggccggcacagctaaggcctgaacatgattagtgccgaagcgttcttgcggcgcaatcctgttgcgtcgcaagacatgcccattgccgagcagcatgttcagtcgaaaccgtcgggacgtttttctcgatgggggagagacgctgccgttgtcgaagatcccaatgatttggacgcttgccgcgaggctgcattgcgtttgctggacgcggccccgcgtgcatccggtgcgttacgcgaacgattgcttgccaaagggtacggcgaggcgatcgtggacgaggtcatcgaacggctgattcgcgtgcaactgattgacgacagcgcttatgccgaatcggccgtacgctattgtgccggtcgcatgatgggccgtcgtggtacggtcatggaacttgctcgcaaaggtgtggaccgcaagctggctgaacaggtgtgtgacgaagctgagcaaaatggcatctttgaagatgccgcatgggaattgggccgccaaatagcccgcaaaacccatggcctcgatcgtcgggtccgtcagcgtcggctttggtccgccggcggccgcaaaggccacagccccgaaaccctccgtcgagtcgccgccgaattgttggtgtagccaagaaaaaaatgagacctcttataccccgggttctgtcgtgccgtgcgcgaacgcacggcacggatggccatccatctcgacctgacgttaccgccaggctctagcagcctacccgatgacacgggcgagcagcccttaccgccatctgcttggccttgctcccgatgaggcttgccatgcgacctactgttaccagaggcccggtggtctcttacaccgccgtttcacccttacccgtcgaggacgggcggtctgttctctgttgcgctatctctcaggtcaccctgggcggacgttatccgccatcgtgctctatggagcccggaagttcctcagccgatcccaatgaagatcacggccgcggccatcaagaggtctcaagcttgcaattatacataaggtgcggaaaaggcggcatcccgccctgcggtgaggccatgacgttgcccggttatcctgttttctccatggttgggcatagttgggcgattcgtgaacgacgcgccgaatatcggatggggcgtgtcgggcgtgttgtggcgtgtcgtatggagacgaatcaaatctgtaagagcttggtatgtgcgagaaagagcaagaaaacgctgcctatccattgcagtatttaccatgatgaacaaacgagccggcctgataaaccggtatcaaatcttcttataggagacttctgccaaagccccagtgtatacatcgtttcattgcagagaaaagcccgggaacaaacatatattctctgggcgagtttccggccgttcacccattgttcgtctacaatgaaacatacccggtcggtgatgatgccgttcggaacacatatagcgggttacaccgcttgagttagaggaggtcaacatggaaatcgtcgttaccggacgccacacgcaggtcaagcaaaggttccgtgatgtggtcgagaccaagatgaatcgtgtgaccgctatcgccccggatgctcagcgcgcgcagattgtgctgacccatgagggcaacccgcgtcaggccgataccgccaagcgcgtggaaatcaccgttatcgccggacgtaccgtggtgcgtgcggaggcttccagcaccgatgaattcagcgcgctggacatggcgctggataagttgacgctgcgtctgcgtcgtactcgtgaccgtcgcaaggatcaccgtcgtggttacgcgaacccggtcccggtggatctgggtgttatcgccccggaacccgagacggaggagctggaggaagagccgaacaacagcccacaggctgcggtcgcctccgatcttggccctggcgaatccgtggaggtccaggttggggatacgccgattgtcatccgtcgcaagctgcacatcgccgagcctatgagcatcgacgaggcgctgtacgagatggaactgatcggacacgacttcttcctgttcgtgaacaaggagaccggacgcccgtccgtcgtctaccaccgtcacggttggagctacggcgtgttcgaaatcgatactccggagaacgtcaagaaggcctgaaggtaaggcctgctgacacgatcagctgataccgcatggaccgcttccaatatggaggcggtccatttttttcgtaagaaggtcgaaaaattcgactgctgacggtgcgaggcgctattctggtacgcggacaccaccacttatcagtcaagggagaacccagtggtcgatattgttgacaaagccctgcgaatgggtgaaggccaccagctcaagaagctggagaacgtggccaaggccgtgaacgctcttgaggacgagatctccgccctctctgacgaggatctgaaggcccaaaccccgaagttcaagcaggaaatcgaaaacggcaagagcctggacgagatcatgcccgaggcgttcgccaccgtgcgcgaggtctccaagcgcacccttggccagcgtcacttcgacgtgcagctcatgggcggtgctgccctgcactggggcaacatcgccgaaatgaagaccggtgaaggcaagaccctggtcgccaccctgcccacctatctgaacgctctcgaaggcaagggcgtgcacgtggtcaccgtcaacgactacctcgccagctaccagagcgagctgatgggccgtatctaccgtttcctcggcatgaacgtcggctgcatcatcaccgagcagaagccgccggagcgccgcaagcagtacaacgctgacatcacctacggcaccaacaacgagttcggcttcgactacctgcgtgacaacatggcatgggagaaggccgacctcgtgcagcgcggtcaccactacgccatcgtcgatgaggtcgattccatcctcatcgatgaggcccgtaccccgcttatcatctccggcccggccgaaggcgacgtgacccgctggtaccgtcagttcgccaagctggtgctgaagctcacccgcgacgaggactacgacgtcgacgagaagaagaaggtcgtcggcatcctggacccgggcatcaccaaggtcgaggacttcctcggcatcgacaacctgtatgagccggccaacaccgccctgatcggctacctcaacaacgccatcaaggccaaggaactgttcctgcgtgacaaggactacgtcgtcacccagggcgaggtgctcatcgtcgacgagcacaccggccgtatcctgccgggccgccgctacaacgagggtctgcaccaggccatcgaggccaaggaaggcgtggaggtcaaggccgagaaccagaccttcgccaccatcaccctgcagaactacttccgtatgtacgacaagctcgcgggcatgaccggtacggccgaaaccgaggccgccgagttcatgaacacctacaagctgggcgtgctgccgatcaagaccaacaagccgatgatccgcaaggaccaggacgacctcatctaccgcaccaagaaggagaagctggccgccatcgtcaaggacgtggccaagcgtcacgccaagggccagccggtgctgctcggtaccgcttccgtggaaagctccgaagtggtctccaccctgctcgacgtggccaagatccctcaccaggtcctgaacgccaagcagcatgagaaggaagccgccgtggtcgccgtcgccggccgcaagggagccgtcaccgtggccaccaacatggccggccgtggtaccgacatcatgctcggcggtaacgtcgagttccttgccgacgccaagctgaagtccgagggctactctccggaggacaccccggaagagtatgagaagcgttggccgggcaccctgaacgagatcaaggcccaggtcaaggacgagcatgaggaggtcaaggagctgggcggcctgtacgtgctcggcaccgagcgccacgagtcccgtcgaatcgacaaccagctgcgcggtcgttccggccgtcagggcgatccaggcgagtcccgcttctacctgtcgctggaagacgatctgatgcgtctgttcaacacccagctggtggcccaggtcatggccaagggcatggaggaaggccagccgatcgaggccaagtccgtgaccaagggcgtgcgcaccgcacagaaggccgtcgaatcccgcaactacgagattcgtaagaacgtgctgaagtacgacgacgtgatgaacaagcagcgtaccgtcatctactccgagcgtcaggccgtgctcaagggcgaagacatccacaaggacatcctgcgtttcatttccgacaccgtcgagtcctacatcaagggtgccaacaagggatccgagaaaccgaaggactgggattgggagggcctgttcaaggcgctcaacaccgtgatccccaccaaggtcgacgaagacgaggtcaggaagatcgtcggcggcctcaagggtgcgaaggccgtcgaggccgtgcgcgacctgatcgtcgaggacgccaggcagcagtacggcgaaatggaggagaccatcggcgagaccggcttgcgtgatctcgaacgccgcgtggtgctcgccgtgctcgaccgcaagtggcgcgagcacctttacgagatggattacctcaaggacggcatcggcctgcgtggcatgggccagcgcgacccgctggtcgaataccagcgcgaaggctaccagatgtacaactccatgatcgaggccattaaggaggagaccgtccagctgctgttccacatcgacatcaagcaggtcgccaccaccgacgaggccgttgacgaggtcgaggagaccgccgaaagcgccgacaccatcgccgtggcctccggccccgacgagaacggcgaatccgtggtcgaggccgccgagggcgaagtcgaggaagaggacgaggatacggacgccaagcaggcgatcgccgaatccgcagccgcctccggggccggcgagtccacgctgcctgttgccggaccggctccgatcagccacgccgaaggcaaggtcccggtttccaagcgtccgaagagcgaagagctcaagacgccgtgggccgacggccgcaccttccctggcactggcaagaacgccccgtgcccgtgcggttccggccgcaagtacaagatgtgccacggccagaacgagaagtgacgcatcgctagttagtaactagctcatggctccccacacggggagccattttctatgcggttcatcagcatgtattcgtgcggtgccgtacgcgcgggacggcacgagtgtcaatcgattgactagcgtggcgtcccgcagtacgaattacggaatcgttgaaattccgccattctcggtgttatggtgtcacggtccgcaaagggtgatgtgggacggcacggctcaaacggcgaaaatgagctgccgtcccgcagttttacgggatagcacaaaaaagaggcttctgctgttttcgtgggttgtcgggcgcgccgctcgtccaactgacgatgtggaacccgtcgggcgcgcgttcggcgttcgggcaccactcatgcacgcatgagtcgatccaccgggccccgtccccggcgacgaccctgatggaggcgcgctgttcgggcgtcaacgtttggaagaacaggccgaacacgtccctgccgtacccgtcgtgcgcccatatcgcccgatgccgttcgtggtcgacgaccacggtgatgcacgtgtggcctttgcggtagccggtctcgtccacgccgatcgacgtgaggccgccgaacggagacggcatcgacgctttcaaccgttcagcgaccctatgggcggcgtcttccggcggcgcgccacgcgacgtgcggaaaaccgcttacggtcttctggttcgcgacgctcatcggccacgcgcgttccgattcgaaatcgcgtgtggaccggctgcccggctcggcccacggcacggaagcgaccacgacgccgcacgccgccgccctggtcatgcccgcggcacctccttccgcatcgggagcatcggagcatacccgcacgtggacgcacccggatctcgagcacgggttcggaacgcggcggcgaatccgtgatccgcgcatcctctgcaaccgtgcctttgacgttcggcaatccggtgaatgggcttttgcccaggcgttcttcgtgattcatttctttggtcggaaaacagaatacgcgggaacgcccctcacgtttacgaaaccaacggctcgacgacgaaccgacatccacgaaaacagcaatagcgccatattttgcaatatggaagattcagggccttgaaatgacgaaccattacaatgagcggcgaacatacatcacacggcgtaggaaacgccaaggagggcatcatggccgagatcacatggaagtcgattctcaccaagctggtcgggggagaccaccttactgctgaggaatcggagtggttcgtggacgacctgatgcaaggtaacgccaatccggccgccgtgggtgccgcgctcgctatgcagcagcagctgggactgaccgccgacgaggtgcgtggtgccgccaaggccatggtctcccacgccgtgccgctgaacgtttccggtgggaccaccgacatcgtgggcaccggtggtgacggcttcgccaccgtgaacctgtccaccatgggctccgtggccgccgctgcagccggcgtgaagatcgtcaagcacggcaaccgcgctgcatcctcgaagtgcggtgccgccgatgtgctcgaagacctcggcctgccgctggatttgaagccggaggccgtcggcgaagtgggcgacgaggtgggcatcaccttcgcgttcgcccgcaccttccacccggccatgcgcttcgtgggcccgattcgtgccgcgctcggcattccgtgcgtcttcaacatcctgggaccgttgaccaaccccgccaacccggcacacgtggccatcggctgcgccaaccgcaaggtgagcccgatcatggctgccgtctacgccagccgtggtcagtccggcttggtctacacttcgcatgagggcatggatgagctcgcccccaccggcccggtttccgtctgggagattcgcgacggcaaggtcaccgaaaccgagttcgacccgaccgtggatctgggtctcgccaagattaccgtcgaccagctcaagggcggcgtgccggacgtcaacgccaacgcattcaaggacttcctggccggcaaggacattacgtcccgcaccaccgcgctgctcaacgctgcctccgccatcgtggctgacggcaatctggtcggcaacggcacactggccgagcgcttcgccgaggcctacaagctggccgaggatgctgtcgactccggcaaggctgaagccctgttcaacaagtggatcgaaaccgccaagtccaaggcgtgatatggaatgggtttgctcgaatatatttacctttccttcattatcaactatttcgagttgcaggagtccatcgacttcaattcgtgacctatcttggctcggccgcaattacggacgagctacgcctgtgatacattggttcgctatcgctcacacctcgcctacaaacagcccactgggctgtttgcttaacggctcggcctcagagaggggagccaaggactacacaacctacgcgaactacaccctcgcgccgtcgtcgtattagccaccctgatcaccggggcggtctttgcggttgaggattttggccaccaatccgcccagacccaaaatgacgcccagcccgaagagaatattgagcagcgcgcctaagagaggaatcgcgttcaagccgggaacgaatatcatcaccgtttcgcctgcgagaccgatgatgagcaacgccgtcagcagtaccgtagatgctttgaccggaccaagatcagggttcgggggagtgaagccgccatcatcataggcgtccatcacattatcggtatccagccagctagagccggtgaaatcacgggggcctggctgcttgccttttttgccgccacggctcgggcgagcatcatcggtgaacgagccgatatccaagtcatctacggaaagcagtgcttccttctcgcgtttcttggcctgcttctcgaactttttggcctgcctggaggaagccacgtcatgcaagtcggcctgatgctcggcttcgaacgcggcccacgccgcatccaaatcgttcatgtcatgcgattgcggtgtatcggcaccattcgtggccggtccggcggcaccgggagtcgacgacttggacgaagtatcggaatcctgtccgttgcccggcgtgggggttggccgctctccgtcggcattgctattctggttctcagtcataactgtcactctaatcaggcgaccggccaatggctagttcgtctgcgggaggaatgccaagtgctctactggttcttcgtcaaaggtctcggccctattgctcatcatcgtttgagccctgctgtcagcggactgaataacgtgcctcgagagggtggcgcgattatcgcagccaaccatctggcggtgattgacgatgctttgattccgattacctgcccgcgcatggtgcacttcatgggcaaagccgaatacttcgagggcaagggattgaagggcaagttcaagaagtggtggttcacgtccgtgggcgtgttcccggttgatcgttccggtggcagcaagtcgcttggcgcactcgagcatgcacgcgagattatcgaggatgggcacctgttcggtatccacattgaaggcacgcgcagcccggacggtcgactgtacaagggacacaccggtgccgcacgacttgcgctcgagaccggttgcccgattgttccgaccgccatcatcggctcggacaagctgcagccgattggcacgtcgattcccaagaagggcaagaccaaggtgttgtatggcaagccgattgaggttgcgaagaagccggctgatgaaattacacatgatgatttgcgttcgctgaccgatcgtgtttccaccgcaatccagaaaatgagcggtcaggaattcgtgaacgaatacgcccagaaggtcaaggccgagctcaaggcccagcaggccgctgaagaagccgaaaagtaattaacaaatgaggctccctcgtctgaagacagagggagcctcattcaaatctcacacgatggtgagggtgatgacggtggggttgccgttggcatcgcgcaagcgaatcttgccgccgttggataggtccgtatcgccacttttcacggtacgtaccgtgccgaacaggccaccgagcaccttgtcggttttcacctcgaacccgagaccttcaagtgtcttggttacggcgctttcctgtttgccgacaaggccggacggtatcgtcgccatctccggacccttggaaatcaccacgtccacgctatcgccccacttcagctgggctccggcttcctgagacgcggaaatgacttgaccggcctcgaccttgtcatcgtactgttcggtgacattggccgtgagcttcaactcgccgagcgcggcttgcatctcatcctgggtcttaccgacgatgttaggcatggtcaccggcatcggtcccttgctcaaagtaaccgtcacctcatcgttgtgcttggccgtggtaccgggatcaggggagatcgtcaatgccacaccctgcggcgtgtccatcgaatactcatccttcgactcgtcatgcttgacattatcgaagccggccttcttgagcgcgttcaacgggtccttgccattggccgaattcgcgtcgagaatatccttcgggatggtggtcatccgcacgcccttggacaccaccaccgtaagctcctgattggctcgcttgcttatgcggctgttcacaacggccttggtcttgttcacggaagaagagatgatcttgccttccgccacgtcgtcgctgtattccttgtgcgtcttgtaggggatgccgagagccttcaacgtgctctcatacgtggcccaatccgcgccggccaacgagcattcggtgcttgcattcgcatcgcaggtcacgtcatccggcttgggcacactccaatagctgcccggtccggcaaaccaccaccagccggcggttccgccgattgcagccagtaccagcacgatcaccagtacgatgatgagcggttttttgctgcgctgcttctttggcccggtgccgttggaagcgacgtccggctcatcggaaaaggcaagcgctcgggtgaaggcatcgccggcctgaggcagcacttgtgtctcgctgccggactgtgccatgatttgcgtcttatggggagccgaagcatcggctggcgtcgacgaatcaagtgccgtggtgggggcgaccggaggagccggaggattgacgtctgcggcgccaccggtatcgacggtattgcttgcgacatcatcggccaaaaacgctggtacggacggcttgaacgttgctgcaccggcaggtacgccggtcagcggggcctgctcggcgatattgcctaccagcgctgcagcggtggcatcggtatgatcacctccgatgggttcggcatgcaaacggtattgccacgcctccagcggcaatttggcggccaactggctcaattcctcagctgctgccgcgccatcggtggggcgggcatccacctgacgcgcggtcagatgggcgatgaacgccgccacggacggatcaatgccctgacagaccgtggccacggacggcacgtcctcatgaacatgcttgaagacaagcgtcaccggattatccgaatcgaacggcaccttgccggtcagcatctcccatgccatgatgcccaccgaatacaggtcgccttgcgcggtggcctgattgttctcgatcatttcgggagccagataagcggcggtgcccaatagcatgccggtggagctcaatgtggcctggctggcggccttggccagaccgaaatcagtgatctgcacatggccgcgatcattgatcaaaatgttctcgggcttgatgtcacggtgaaccacgccggcgcgatgtgcggaagccagaccatccagcgtctccgcgaccacgcgcagcgtctcacgtacggagaatgtgccttgggcgttcatctcatgccgcagattgacgccatgcacatattccatgaccagaaaatcaagtccattgaactcgccggtgtcatacacctgaacgatgtgcgggttggcgatggacgcggccgaattggcctcgcggcggaaccgttcgacgaactgctcccgatgcgggcctttggcgagttgtgtgtgcatgaccttaatcgccacggtgcgccccagacgctcatcgatggcctcatacacggtggccataccaccctcggcgatattgcgcacgatgcggtagcgtccctcaatcatctgtgcgggctcgttctcactcatgttgtatcgtacggttcctttaatcacgactaaacatgttcagtgtacatggccccggttacgcggccggagcatcagcgcatagttttcacgggttttcaccggtgttcatggtctcatggtccggcggctcgcattgtggactatcgcaaggattcggggacgaatcgcgcacaagcctcggtcagacggcgttgcgcttcggaattcagctcaagaccggcaatcgccttacgggactcaccccatagggcagcgatgcgctcgcgggatcgatcaagagcaccggtcgacgtgaacagttcaatggtgcgggccacctggttgtcattgcgacaatcttcttcgaagatggcaatcagatcggccttatccgccgtatctgccgcagacagagcatcagccaacagcactgtgcgtttgccttctcggatgtctccgccaattggttttccggtattgcggcttgatccgacgacatccaacaggtcatccgccagttggaacgccagtccgagcggccggccgacggccaacgcgcaatgcctggcctgatccgggctctctcctgcggccagcagtgcaagcagcagtggagcgatggtggtgtaactggctgtcttccagcggaatacgttcaatgaggcgttcgccagagcttcgggattggacagtggggtcatctcgacggccaagtccagtacctggccgatttccacctcgcgttgcatggtaagaaacgcctcgttcagggcatcggtgttgggaagacggctggcggaccggcgtgtgatttcaatgcaggcggtggccagaatgtcgccgagcatcaggcccaagccacggcctatggcaccgctgtgtacggcctgttccaaggcacgatgtgcggaaggcctgccccggcgcagatcggattcgtcgatgatgtcgtcatgcaccagtgcggccgtctgaaacacttcaatggcgcaggccaggtcgatcatggcgtcacgccgatcaggcgtcacgtcgccggcaagaatatcgaaggcgtccaatgcgagcagcgcacgcagtcgtttgcctccttggctggaggaggcggcttggtccacaacctgttccatcaccggtttcagggcgtcggcaacctcgtcggtggcgggggcggcagtcagttcccgcaccaactgaatgatgcgtggctcgatgatttcgcggttgttagcagttgtgcacatgcctaataacttatccacagggtttgaagaacacaagaacgttgggaatcaagggttttgaagctagaaccacaatggtcgttttttcctgcgtcatacggcgttttcagccatagtgggcacacaccccctcggcgcatgagctatccggctcggcgcgcaccacaacaccaatagattgcacaccattagtcaaggaggacatgatgaacaacaacacgccgcacaagccgcgtaagagccgacacgccaaacggcacgccgccgaacagacggagccctttggctttgacgagttggagacgagatcacaggaatttcgcaatgatcgacgacttcgaggcgtgcaacaggctaatgccgactgggtggccgaaccattggacgaatggctgtcttgtcttgatgccgggaacaccgacctaggccgagagacgatggccgcgtttgcggtgggcatgcgtgagaccttatcgattcgtgatgcgctgattctctcgttggttattgatgaaagccgttgccccaagtcatggctcatggaattcgcggcgcgaccgcatctggcgcgtacgagaacacgaatgggcgagctgctgacctgcgcattcgaggatgaaggcatgatgccggataaggagcgttgccatgccggcatcggtatgttgctcgatatcgccgaagcctcaccggtgccgtactgcatacaaccattggccgtaatcgcctacaccttatggtggctgggcgatccgcgagcaatggtgttcgccttgcgatgcctgctgctcgatgaggattgttcgctggcggcgatgatattctcagccgccgatcgaggcgtggcaccggcatggtgctcgggctgaatgaacagaaacggcggatttccgaggttttatgcgcgatgcgcggaaggaaagcgtgtggtgatcggcaacacgtcgggcaacgatgtgggaataatcgtccgtggagggtggtttactcacatagttgacgatttgcccttgccagaagtgggcccgtgtggtatatgcacttcacggcgagagatcagaaggagcagttttggccacgaaggaaacgacggcaaccaagcagacagccgagtccagcgaggagaccgagaccaagaagaaggccagctctacgaccaccgcgcgcaagacttctaccaagaagtccaagtccgcagagccctcgaaaaagaccacgcgcaagtccgctgcgaagaaaaccgcgaagaaggccaaggacgatgagctcgtcaaagacgaggacactcaggtcgatgacgagcttgatgacgatgccgaggtcaacgacgacgatttggatgttgacgacctcggcgaggatcttgacgacgttgacgaaggcgatgccgacgacgaagacctcgatgaggacgatgccgacgacgacgatgtggaagacgacgaggacgaggaagaagccaagtccaaggcacccgagcagcccaaggaaaagggtgcctacgtggtctccgacacggatgatgaggaagagaacatcatcccttcgggcaatccgaagcgtcgtgtgatcgcggccggcgcaaccgccgacccggtcaaggactacctgaagcagatcggccgtgtgagcctgctgaatgccgagcaggaagttgacctgtccgagcgcatcgaggccggcctgtacgcccagcacctgctcgacaccgaaagtgaaggcatggagttcaagcgcaagcgtgaactcaagtgggccgctgccgacggcaagaaggctaaggaccatctgctggaagccaacctgcgacttgtggtctcgctcgccaagcgttacacgggtcgtggcatgctcttccttgatttgatccaggaaggcaaccttggtctgattcgtgccgtcgagaagttcgattggaagaagggcttcaagttctccacctacgccacgtggtggattcgtcaggccatcacccgtgccatggctgatcaggcccgcaccattcgcgtgcctgtgcacatggttgaagtgattaacaagctgtcccgtgtacagcgccagatgctgcaggatctggggcgtgaacctacgccggacgagctggcccgcgagctggatatgccggttgagaaggtgcaggaagtgcagaagtacggccgcgaaccgatttccctgcacaccccgcttggcgaggatggcgattccgagttcggtgacctcattgaggataccgacgccatcgctccgtccgacgccgtggccttctccctgctgcaggaacagttcaagcaggtgctggaaaccctgtctccgcgtgaggccggcgtcatcaagatgcgctatggccttgaagacggccagccgaagacgctggacgacatcggccgtgtgtatggcgtgacccgtgaacgcatccgtcagatcgagtccaagaccatgtccaagctgcgccacccgtcccgttcgcagaccctgcgcgacttcctggatcaatgatcatctggctcccctctgtgaggggagccaagcatttgaagagaaaaataggactgtatgcccaaagaagaatacggcgccaaggacctagctgttcttgagggcttggatgcggtgcgcaagcgtccgggcatgtacatcggcaccaccgactcgcagggtcttatgcactgcctgtgggagatcatcgataactccgtggatgaggccttggccggcttctgcaacgacattgtggtcaccctgcacaccgacggttccgtggaagtcgcggacaatggccgaggcattccggtggataaggaaccgaaaaccggcctgtccggcgtggaggtcgtactgaccaaactgcatgccggtgccaagttcggcaactcgtcttataacgccgtcggtggcctgcacggcgtgggctcctccgtggtcaatgccctgagctcccgactggacgtcgaagtggatcgtgacggcaagacgcaccacatgaccttccaccaaggtcaccctggcgtatacacggatgccgacccggccaatccgtctcccgattccccgttcaagcgcactcgcaagaaccgacccaccgagctggaaatcatcggcaaggtatctcccaaaaccactggtacccgtattcgctactggtatgatccggagatcttcaacaaaaccgccgagttctcatacgaacagctcatcgaccgcgtgcgtcagaccagcttcctggtgcccggcctcaaaatcaccatcatcgacgaaaacgtaccggaaacggcggcgactgacaccgtcgaggccactgatgacacaacagtcgaacctgcgcaagaccaggcaccggccttggatgtctcgtccagcgatgccgaactcttcgacgactccgccgaatcccagtccgacgatgccgagagcccggccgaggaggacttctcgctgacggccggcgaccaggtcgtcgatggcgcgttcggcgaacagcccgcgcacccgcgcgtcgtggaattcctgcacacaggcggcgtcaaggacttcgtcgacttcctgtccaaaggcgagccgatctccgacatctggcgcatccaaggcgagggcacctataaggaggagacccaggccgtgggcaagggcggtgaactgcacgcccaggaaatcgaacgcacctgcggcgtggatatcgccctgcgatgggtcaacggctatgacaccacaatcatgagcttcgtgaacatcgtggagacgcccggcggcggtactcacgtggacggtttcatgaacgccatcaccaagcagattcgcaaggcggtggaagacaacgcccgcaagctcaaggtgaacatgaaggactccgccatgaaggtggagcgcgacgatatccaagccggactcgtggccgtggtcaccgcacgcgtggccgaacctcagttccaaggccagaccaaggacgtgcttggcaccgcgcaggtcaagccgatcgtcacccggctcaccgacaagcaattcggcgagatgatcaccggctccaagcgcgggtacaaggaacaatccggccgcgtgctggagaagatcgtcggcgaaatgcacgcacgcatccagtcgcgcaaggccaaggaggtcacgcgccgcaagaacgcgctcgaatccgcctcgatgccggccaaactctccgactgccagccgggcaatgacgacgtggccgaactgttcatcgtcgagggtgattccgcactcggtaccgccaaggccgcccgcaacgccggtttccaggcactgctgccgattcgaggcaagattctgaacgtgcagaaggcgtcgatcacgcagatgctctccaacaaggagtgcgcggccatcatccaagtggtgggtgccggctccggccagagcttcgacatcgaacagtcgcgctatcacaagatcatcatgatgaccgatgctgatgtggacggtgctcatatccgtatcctgctgctgacgctgttctaccggtacatgcggccgcttatcgaacacggctacgtgtatgccgccgtgccgccgctgcaccgcatcgcgttgacaggctcgcacaagggcgaatatatctacacgtattccgatgacgagctggccggcaaactggccgacctcgacaagaagcgcatcggatacaacgacgacatccagcgatacaagggtctgggcgagatggacgccgaccagttggcggacaccaccatggacccgcgcacgcgtatgctgcgccgcatccgcatggaggacgccgcccaggcatccgagatcttcagcctgctgatgggcgacgacgtgccgccgcgcaagcagttcatcgtcgacaacgccgacgatttcgaccgctccaagatcgatacctgaccgtcctatctcaagctccctctgatgagggggtgtcagcgaagctgactgggggagaggcctcgggtggtagcgggctactcgtatttctctcccctcagtccgtctttggcggacagctatttcgtcagagggtgctgcggtatatcatcaggatttcatcgagtgcaccgccgccgattatctcaaggacaactacgacatcatcggctttgacccgcgcggcgtagccgattccacgccggtgtactgcgggcaagactccaaactgtgatgtttgcgtgttgctgaagcgctattcgatagactgatgacatcgttatcacaaccggtgccgtactgtgaatgggagatgggacatggccagtctgttgcttgccgtcatctatgtggcgtttatcagtctgggattgccggattcgctactcggatccgcatggcccaccatgagccaggatctgaacgtgccggtggcgtgggccggcggcatctccgcggtgatttccatgttcacgatcgtctcggcgctgctttcggaccgaatgacattgaaattcggggcaggcaaggtcaccgccgtttcggtggcgttgactgcggcggccttggccggtttctccgttacctcgaattactgggtgctgttggccatcgccataccatacggccttggcgcgggcggagtggatgcggcgctcaataactacgtagccattcactacgaaagccggcatatgagctggctgcactgcatgtggggcgtcggcgcatcggtcggcccctacatcatgggctatgcgctctctcaaggccaaggttggccgtggggctatcggtacatcgcgatcctgcaggtgatgctgaccgtcatcctggtgctgagcctgccgctgtggaagaaacgtggcgcaattgcggtcggcgaatcgaccgatgacaccgcatcatctgacggcaatgccgagagatttggcactgctgaaggggtgtctgttgccgaacgcaaaccgctcggcgtggccggcgtgctcgccattcgcggtgccaaggaaatcctcgtgatgttcttctgctactgcgccgtcgaatctacggcgggcctgtgggcctccagctatatggtgatgcacagcggcatcgacaagatcaccgccgccagctgggccagcctattctacgtaggcatcaccgtgggtcgtgcgctttccggctttctgaccatgcgattcaaggacccggtcatgattcgcctcggccaagtgctggtgttcgccggcatcctcaccatgttcgtgccattgcctcaccaccttggcgtggtcgttgggctggtggtcatcggcttcgggtgcgcgccgatttatccgtgcgtcatccactcgacgccggcctacttcggcgaagacaaatcgcaggccatcgtcggcgtgcagatggcctgcgcctatgtgggctcactgctcatgccgccactgttcggcatcatcgcgcaatatgtgacaatcagtctctacccgtggtatttgctggtgctcttggtgctgatggtggccatgcacgagcgtcttcgcaagttgcgcggctgatcatatgcgcatttgggcccgtcgcctactatgcttggagcccatggtgataagtggagaagaacatgaacagatgcccgagcccgtacgggagcgattgagagcgctgaaggatgcgccgggctcggtaatcgtggtcggctcgatgaacgccgattacaccgtaaccactaaacgactacccaagccaggtgaaaccgtcaatggtggtgccatgaaagtgctgccgggcggcaagggcgcgaatcaggcatctgccgcctctcgtctcggtgtcaatgtccagttgctgggcgcggtgggcgaggactccaacgcggacttcctattaagcaagctggatgaggccggcgtcgacaccgccgatatcctgcatgtcgaaggccccagcggcgccacggtaatcaccgtgagcgctgagggcgagaacaccatcgtctattcgccgggttccaatgccaaggcaagtgccggctatgtgcaatcacatcgcacgaccatcgccgaatgcgcggtattgggactgtgtctggagagcccgattgccaccgttatcgccgccgcgcagaccgcgcatgacgctggcgtgaccgtgctgctcaacgactcgccatttatggacgagctgcctcacgaactggtggaagccacggatattctgctggtcaaccagcatgaagtggctcaactgctgggcctgccggatgatgacgtggaatcactcgactggtatgaggtcgccgaacgattcaccgattacggattcgaccgggcgatagtgacgcttggtgcgtcgggatcggtggtgatcgagaacggacgttggcatcgcgtatccgccgcgcaagtcaatgcagtggacaccaccggttgcggcgactcgttcatggggaccgtgctggctggcttggccgccggtcatacgctgctgcaatccgcgcaaatcggctcctacgtctccgcctatgcggccaccaagtttggcgcccaaagtgcctacggtaccgccgaagaagtcatcgcctacttcagctgacctataatcgtacatatgtacgaaagcctgagcctgttttccgaacccaccaagatgtggttcgagcatgccttcggtcagccgaccgaggcacaggctcagacatggccggcaatccattccggtcgcaatgtcttggtcatcgcccctaccggttccggcaaaacattggctgcgtttctctcagccatcgaccgattgatgaccgtgccacgcacgcggcgtgccggtgtgcgtgtgctgtatatctcgccgttaaaggcgctcgcggccgatgtggccaagaacctagaacagcctttggagggcattgctgcacaatgcgaggcgcaagggctgcccgtgccgaagatcgcggtcgccactcgttcaggcgacaccaccgcacaggagcggcggcgcatagcctcccatccaccggatatcctcgttaccacgccagaatcgttgtatttgttgctcacttcgaaggcagggcggattctcggcactgtcgatacggtgatcgtcgatgagattcatgcagtggcgggcaccaagcgcggcgcacatttggcggtaagtctggaacggctggagaaccttgtcacagaatcgcgcaagcgagatgcaatcgatgcagatgctgatgagggcggtgatgccgccgtcgatgctggccgtggcgatcgtcatatgcagcgcattggtctatccgctacggtgaatccgcctgaaaaggcggcgcgattcctgggcggcgggcaaccggttaccatcgtgaatcccggtgggcggcctgcaatggatttgcgcatgattgagccgttagaaaacatgcgtgatttgcagtccgtgaatgccaagcagcgtgtcggtggcgtggatgctgaacggtccgctccgcatatcagtggtgtcacgccggccatgcagcgacttgctgaacgcaggggcattgtgccggtggatgatagagatgtttcttccacttctggggacgattctgatgcgagtgatgcgttcgattcctccgcgttggttggagcggcgggcgaccgtacctccggttccatttggcccgtggtggaacgcagtattttggatgagattctcgcgcaccgcactacattggtgttcgttaattcgcgtggtgtggctgagaaactcactgcgcgcttgaacgatctgtatgcgcagacccggcatggcaccaatcccgacactgtgcgggatctgggctctccggaaggccgcgaagggttctccacgcattacgatgctgtggtcggctccaccaccatgcttgtcggctcacatgagggcgatgatgtcatcgccatggctcatcatgggtcggtttccaaagaccgtcgcaaaatgattgaggaacggcttaaacgtggtgaattgcgttgcgtggtggccacctccagtttggagctcggcattgatatgggctcggtcgacttggtgattcaagtcgatacgccgttgtcggtctcctccggattgcagcgtgtaggccgtgccgatcatcaggtcggtggcgtctctcacgcattgttctacccgctcacccgtcagcagattgtcactggggccgcaagtctggaagccatgattgccggcgatatagaaccattggccgtgccgcgcaatccgctcgatattcttgcccagcagaccgtggccgctgccgcgatgcacgatttgaacgctgatgactggtatgccacagtgcgtcgtgctgcgccgtttgccgaactgccacgtgacatgttcgatgcggtaatcggcatgatgtccggcgaatacaacagcgaggaattctcggccttccggccgcgactggtatggaatcgggataatggcctgatttccgcccgtcccggttcgcagaaagtggccgttacctctggcggtacgattcccgatcgagggctgtacaccgtggtcctgcctgaggcggacgccggcaaaggccagcgtcgcgtcggcgagttggatgaggagatggtctatgagtcgcgtgtgggcgatgtcattacactgggtacctccacatggcagattcaggacatcacccgcgaccgtgtggtggtgacgccggctcccgggcgcaccgcacgtctaccgttctggcacggcgaaggttccggccgtgactacggtttcagccgtaccatagcccgcttcacccgagaaatcgccgccggattagacgtgaagcggactgaggggaggtctgccgcagaaggtccagctgtcccaaccttcatcccaacaatcctcacccgtctccaccacgatggcctagatgccaacgccatcaccaacttggcccgcctactctccgagcaacaagccgccactggtgcagtccccagcgaccaaacccttatcgtggagcgcacacgcgatgaagacggcggatggcgcatcgtgctgttaagccccttcggccgccgcgttcacgaaccgtggtccatggccatcagccgcagactgcgccaacgctacggtttcgacgggcaggtatatgccgccgatgacggtatcgtcattcagctaccggacggtgacggacatattcctgctcaagacctgttccttttcgacccagaagacctcaaagcagatgtagagcgtcaagtgggcgagtccgtgctatttgccgcacgattccgcgaatgcgccgcccgatcactgttcatgccgcgatccgacccgggccgtcgcgtgcccctatggcagcagcgactgcgcgccgcacagctcctgcaatccgcacgtatggccaagaactttccgctgctgctggaaaccgcgcgcgaatgtttgcaagacgtatacgacatgcccgccctgaacgaggtgatgaccggattgcaagccggcaccattaccgtgaaggacgtggaaaccgagtcgccatcgcctttcgccgagaacattctctttggcttcgtcggcgtggtgatgtaccagtatgaccaacctcaggccgagcgtagcgcgcaactgctgtctctcgatccgcacgtgctcgaacgcttgctcggcaccaccgatatggcacaagtgctcaacccggacgtgattcgcgaagtcgaacaggaactgggggagcacactttctggaatgagcttgccgacgatgatgtgactggtcgcgtgacccgttacgccaaaacccatggtcctttcaccgccgatcagctcatagccgatctacacctcgatgctacggatgccgtgcacactctggatgtgctggctgccaaaggcgagttgctgcaaggccactttgtagatgatgacgagcaaggccaacagtggctccataaggacgtattccgccgtattcggtctcgctcattggccaaggcgcgtaaagcagtcaagccagtagaatcagaggcgttccagatgtttcttatcgaccgacaaggtatcgggccggtcggcggcgaacgatatgaaggtgctgacgggctcatgcgcgttatcgagcagctggagggcatagcactgcccactgcactctgggagtcggcggtattccccgcacgagtacgagactaccaacctgcattgctggatgagttgctgaccagcggcgatgtggtctgggtcggctcaaaaaccgggggaaccagtgcgatggaccccggtgaggttgctttctatccggcggattcaatattgttcagcggtgtggaacatggtacgacatcgaacgcctcagacgccaccatgccggaagcgattctgaccgcactggactcagggggagcgttccatgcccgtcaactgatggatgccgccaaacgtgcgtggaatgagaccgcggagccggacatcaatccaaacaccggcgaaatcattccgcaagagtggagcgaacagcagttcaaggatgccttgtggagcttggtctggcaaggtaaggtcaccaattccagcttcgcgccggtgcgtgcattaaccgcaggcgcagcaagcccgcgtaaatccactacatcacgtcgtcgtgggcgtgtcgctccgattcgccgagccactacggatatgacgttaggaggtttgtggtccgccgtaatcgggcaagctgaagccgaagacaccgaccagaccgaacgggcactcgcactggtcgagacgttgctggacaggtatggcgtcatcgcgcagccggtgattgacaaggaaaatatcccgggtggctactcagcgttgtatccgatattgcagcgcatggaggagcatggtcgactggtacgaggcatgttcgtccgtggtttcggcgcggcccaatttgccgagcgcgacaccgtggatgcgttgcgtcatccgtcagagcatcgcggccagtccgtggtggcattgagtgtgctcgaccccgcaaatctcagtggctccgccatcgcgtggccggacgcgcctgccggtgcgggtaaaccggcacgccgtatcggagccacggtcgtgctcaatgcgcaaggcgcgctactatacgcggccgccaaagccaagcacctgacagcgttcgatcaatcggtcggccatgaagccgctgtcaatgattccgacgaacaaatgcgcaaggccgccacagaactggcctacgccctcaaacgcaatggcaccggctccgtgacattcagcgacatcaatggcgaacccctcaacgcccgtcaccccttcgcccgcatcctccaccagtccggcttcacccccgttccccaaggcatgcggctgtactgattgagcccagctatcgaatgcggtagttggagcctcgttgggtcatgatgaggccggcgcgggtgagcttcttatccagtgtgtagagggcgttcttgagtaagccctgttgctcgaagaatgggccgccgataagtttgaccaactcgctggtgttgacgaactggccatcagccttgaccagcgcttcaagcaaactgtattccagacgggacagtgagattgcgctgtgagtggatgcgtagtaggccttgtgattcgtggtgtccaacgtgagattgccacgaatgatcatggcgggggagtcggtggcaagcgagccgacgtatgagagcagttcgccatcggagaatggtttgctcagcgcggcatctgggcgtcgtacgttagcttgtgcgctagaggcagcattgtccgagcgttgttcggcttcggcatctgagttgtttgcgcgtgaattcgcgctgaaggagctgtagggcgtctcttcgataggggcgtactcgtcaggcagcgctcgccagcggctgccttcaccaatggttttgctgagtggcgtcgaagtcagcagcagaatcttgacggaggcacgggcattgcgtagggattcgatgagctgctcggtggaaatgccgagcagggattcatcaagaatcactgcgtcaaatgactccttggcgacagcggcgagcgcgatactaccggtgcttgccaaagacacctcatgacgaccggcaagcagggcaccatgaatggcgtgggccaacggttcattggatacggcaaccagtagtctcatcgccacctccttaatgcttagtgtaggccgggtttagggtctcttctctattgtttggctcactatcgttcgctcctcgcctacaaacaccccactggggtgtttgctttacggctcggcccatcagagggagcttaattgaggttacgcaatgaaggcgatgggggaggcgaggtctactccggaaccgtctcggcgcatatcgggcttgggaagctcgaccggagagcctgcggatgtagaggcgtgcaacgggtagaggcccacccaggcaagaatcagcgtgttctggcccttcaggaatcgctgggaacgcacgccgccggtagcgcgacccttggtggggtacatttccagcggagtgaccttcgccgcgccgttttcggtgccgggcagtgcatcggaatcgccggccacggtgagcaccactgcaccggatccggaagtcaagccgttctcgccctcttcataggtccatgccaccttgccggcgggaaccacgttgaaggccgccacacgggcgccctcggccagcttgatgccggccataccgcccgcagtacgaccctgcgggcgcacgttcttcgcctcaaaggtcagtagcgaggaatcggaggagatgaacaccagacggtcgtcatcctcggccacggcggcgaataccacttcgtcgccatctttcagatcaatgacgggccaagaatccatggtggtgggtgcctcacgattccaacgcttgatgacaccgttacgggtaccgatagccagcgacggcaacggcttggcctcggcggccccgccatcctcgctctcgtccttggcactggtcttgccggacgtcggctgctccatggcaatcgccgtaatcacacgctcaccgcgaatcggatcggtggattcggtcatgccgatcagttcgtcggcctgaactcctcccttcagcgacaatgtggcggtagcgggcaaggcaggcaaatcaaccacatgcgcgagcaccaggcggccggccgacgtgaccagcccatacgtagcgcgcgtggaagtctcgaagattgtggtgatctgatcgtctctcaaacgctcatcggaagtggatcgtgcattgaacacgtccatcgcgcttggcgtggtacgggcaatcaaaccggtagcgctcatcatcaccacgcacggctcgtcctcgatcttcaaggctccggtcagcgtggactgttcgccggtcttcttggccgcagctgcggctgcggccacatcggcttcggcggaggagatcgtagtggcggccttcaccgcttcgagcgcggacttggacacgcccgaagccccggcaccctgcgccacgaccggcgtcaacgtgccatccgggtcggcatccagcagcacggtacggcgcggcgagccccacttggcgaccgcttcgtccatctcgtcggtgaccacctggtcgagcgcctcggcggaggccaggatccgggtcagctcctcgatacgcttcttcagatcatcgcgttcggcctcaagctcgatacggttcatcttggtcagtcggcgcagacgcaggtcgaggatgtactgagcctggacctcgtccaaatcgaaaacgaccatcaaacggctcttcgcggcatccgcatcatccgaggtgcggattacctgaatcacctcgtcgatgtccaacatggccagcagcaggccctcgaccaggtgcaggcgctccagcgccttcttcttgcgatattcactgcggcggcgaatcaccacacggcggtggtccacccacacctgaagcatctccttcagacccatcgtgtgcgggcggccctccaccaacgccacgttgttcatggcgaagttgtcttgcaacggtgtgtgcttgaacaactgcaccagaaccgcatgcgggtcgaaaccagtcttgatctcgatgacgatacgcgtgccgttatgacgatcggtcagatcgaacgcgccggaaatcccctccagcttgcggttcttcacaccgtcggaaatacgttcgattaccttctccgggcccaccatgtacggcagctcggtgaccacgatggcctgcttgcgggccgtgacatgctcgatatgcgtggcggcgcgcgtggtgagcgtaccacggccagtggcataggcctcacggatgccgtcgcggccgatgatcgtgccgccggtgggccagtcggggccgggcacgtaacgcatcagctgttccagggtggcgtccgaatgcgccatgaggaacttggcggcgtttaccacctcgcccagattgtgggtggccaggttcgtggccatgcccacggcgatgcccgagccgccgttgaccagcagattcgggatggcggccggcagcacggtcggttccttgagcttgttgtcatagttcggcgtgaagtcgacggtgtcctcatcgatatccgcgttcatgccgagagcggccgggccaagcctggcctcggtgtaacgggaggccgcagggccgtcatccagcgagccgaagttgccgtggccgtctaccagcggcagacgcatcgcgaacggctgtgccaaacgcaccatggcctcgtagatcgcggaatcaccgtgcgggtggagcttgcccatcacctcgcccaccacgcgggcggacttcatatacgggcggtcgggagtcagattcatctcgcccatctggtagacgatgcggcgctgcaccggcttcaagccatcgcgcgcatcgggcagtgcgcgtgcgtaaatcaccgaatacgcatactcgaggaaggacttgctcatctcctcgttcagcggcgtctcgacgatatgctccttgaccgtgcgcggatcataggtttgcgcggacggtttgcggtgtgatgccatgaaactccctttcgaacgcccccatattagcgggagggcgcgaaacagtgcgcagagaacggttctcgataacaactgtgcgctggtttcggtgcgccaatcgcacatgtttgccgataaaacggcgtgattccagtgtttcagtcgatgtgcgtttgtttgattatgtgcgttggagcgcacagttgttattgagaaccgttctctgcgcactgagccaaggggaggggtgctacttgaatgggcaactatgagtgttgagacgccggatatggacgagttgctgcggctggtgcccacagtgggctatggggatgacgccccggccgatcggcgtgggggagcactgcacctgtccgccgtgctgcccgccttgtccgccgccatcggacatccggcccccaccaaggtccacgccgatcccaaggcatgccagcgcgcgttggggctgcccgatgccgaatcggccatcgtggtgctcgtggacggcctgggctactggaacctcgccatgcgcctcggccacgcgccctatctgcgttcgctgatgaacgaaagcgccaatcagcgtcccatcgctacctgcgctccaagcaccactgtggcggccatggccgcattcggtaccggaacctgcccgggactgaccgcaatggcgggctatacgcagctcgaacccgccagccataagctcatccaactcatccagttcaaagacgcgctggcacccaaaccagccaatccgcacattcctgtgccgcccatggtcgatccgctcgacctgcagcgcgaggagacggtgttcgagaaacttgcggctcaagaggtgcgcgtcacgagctcggggttgcccaagttctccaaatcgccattgaccgaagccgcattgcgaggcaccgactatcaaggcaacgtcaccccacgcgatcgtgtgctggccgccgcacgcgcctcccgcacccccggcctgacctacctgtacatccgtgacgccgacaaagtcggccacaattacgggtgggattccgaacactgggtggccgcattcgaacatatcgacgcccagctcgcgctcctgaaacgcagcgcacccaaaggcacgctgatcgtcatcgtagccgaccacggcatggtgcaaaccgacatggaccagcggattgacatcgccgttgaaccgcagctcacccgaggcgtgtcactggtcgggggggagccgcgctcgctgatgctgtatgccgagccggatgaacgacctgaggatatagcttgccggtggcgcgattgtctgcaagaccgagccttggtgcggaccaaggatgaggccatcgcggacggattgtttggaccggtctgcgagcgagtccggccaatgctcggcgatgtggtcgtgcaggcagcgggagccgtgaccctcgtcgattcgcgtacgcaaggagacaaggccacccacctgccgagcgtgcatggctcccaaacagcattggaaatggatattccctgcctgatcgatatggcctgattcggaaattcagtctccgaacagaatctcgtcccagcttggtacggccgaacgtcctgatttacgcttggccggtttggctggtgcctcatgttcggtggcggcggattcggccgcccgctcctgctcggtggctactagctgtgcattggggccactccgtatggtcttgtccgaaacattgtcagagccctgctctggtgccgtggcaggcgattgctgtaatcctgcggcagatggcgaaacagatccggcggtctgcgaagagaccggactgggggccgtagtgccatgagcctgggtcgtggccggtgagatggacgtggatagatccactgggggcatggaacctgtggaagtgacagagggccggattgcggcaggccgtgcggccggaatcgaaggcgtaggagccgcccaagcagacacggcgcgctcgatacgcgcggagcgtacggagtcgccgggcagttcgggaatcgtcggcttgagtttggaatccgtggctgattccggattctgttcgccgagcagttttcgagcggcattgttcaggctcatcacggaattgtcgtgcatattccacgtccattcggcatggatctcacggcccgcggaagtgaatatcgccacgatgcgccaaggctcaagtccacgtcgggtggatttccaggtcactgattccatgccgattcccgcagaggccagcgtgcgttccaccagttcgctgatggtgcgcaccctgctgtctttgggtgccgccacggcaaggaactgttcgatggcatactgtttctcggtctccacagccatggagaaacgacgtaccagcatttcgctcagatgatatttctccgcgacacgggccggatcggcaccggcgcgaatcagcgactgtatctgggaaatcggcaaagtggactgctgatgcggctggggagcctgtcgcatctcgcttctgacctgcttggcctcaagaatcgcccgttcgagcgtgtcgtccacgctcacagccatttccctgccgccaagggagaatacgaggtcccccgtcttgctcacgcgcacgaaacgggctttttcaagccgatcatctggcatattcgcaccactttccgtcgcaaagacattacttcttttaagtatgccccacgtgtcgaactttacgagtatttcaaatcgtgtatcctatgggcgagtacggcgctgaccgtgctatatatatcgacttacgaaccaaagacgacgaaaggaccatgatggctcaggattatgattccccccgcaacaaggatgaggacgaggaatcgctgcaggcgctggggaagtcctcgcagaacgcctcgagcgacatcgacgacgatgagaacgccatcgccgaagactacgaactgccgggcgccgatttgagcaacgaggattcctcggtgaccgtcatccccatgcagggtgacgagttcatctgctcgcagtgcttcctggtcaagcatcgcagccagctcgcctacacggacgaggatggccagccggtgtgtgaggagtgcgccgcctgatggcgttcgacgagacctacaacgagcccgaatccaccgaggtcctggtcaagagcctcgaccccgaacatccggcccagctgcactatgcccacgcgggcgatgccggtgccgacctcatcaccaccgtcgatgtgacgctgaagccttttgaacgggcactggttcccaccggcgtggccatcgccctacctgcgggctacgtggcgttggtgcatccgcgttccgggctggccgccaagcagggcgtcaccgtgctcaacgcgcctggcaccgttgatgccggctaccgtggcgagatcaaggtgcctctgatcaacctcgatccgaagcacaccgccgtcttccatccgggcgatcgcatcgctcaattggtgattcagcggtatgttgaggctcggttcatcccggccgagacactgcccggatccgatcgcgccgaacgcgggttcggttcgacgggagtggcgtcctgaccggattaggccggttgaatgactaaggtgatgacggcaacaacggttgtggaaccaatgatggcgaacaggtgaatgcacaaggctccggttcgcggctacaatgaacttcatgacgagggaggtgactggcatggcagagattgatggcgagcagtacgccgcccgtaagttgggttgtgagatcagtgccgatccgctcaatccgctggatccaatcaaaaaggtgtgcaagtcccatcaccccgatgaggatttgtccattcttgaccgtgcctaccggcgtgccgtcatccagcactccgcccagcgccgcaagtctggcgagccgtacatcatccacccgctggccgtttcccagattctcgcggatctgggcatgggcccgatcgtggtggcagccggcctgttgcacgacacggtggaagacaccgactatacgttggatcaatgccgcgccgaattcggcgacaccgtggccggtctggtcgatggcgttaccaagctgagtcagcttgaagtgggtgattccgcccaagccgaaaccattcgcaaactcgtggtggccatgagccgcgacgtgcgtaccttggtggtcaagctcgccgaccgcgtacacaacgctcgcacctggcgctatgtgaagaccacgtccgcccagaagaaggcgcgtgaaacccttgacgtgtacgcacctttggccaaccgactcggtatgaacgccatcaagacggagctcgaggaactgagcttcaaggtgctctacccgaagatctacaacgagatcgtggtgctggtggctcgccgagccggccagcgcgatgtgtacctgaagcagattctggcggagatcaacgaggatctcgacgagcagaacatcaaggcatacgtcaccggacgcccgaaggattacttctccatctaccagaagatgatcgtgcgcggccatgatttcgcgaacatctacgatttggtcggtgtgcgcatcatcgtcgacaccattcaggactgctatgcggcgcttggtgccgtgcatgcgcggtggaacccggttcccggccgattcaaggactacatcgccatgccgaagctcaacatgtaccagtcgctgcacaccacggtggtgggccccggtggcaagccggtcgaaatccagattcgcacttgggacatgcaccgccgcgccgaattcggcatcgccgcgcactggaaatacaaggaaaacggccaggccggccgcgccctgagcttgccggacaagtccgatcgaaagcgtgatgaaaacaatcaggagctttccgaggtcgataacctcaaatggattcagcagctcgccgactggaccagcgaaacccctgattccaacgaattcttgggctcgctcaaggaagaccttggctcgtccgaagtctacgtgttcacgccgaaaggcaaaatcgtatccctgcccgctcacgccacgccggtcgacttcgcgtacgccgtgcacaccgaagtgggccaccgtacgatgggcgcgcgcgtcaacggtcgtttggtgccgctcgacaccacgctcgataatggcgataccgtcgaaattctgacgtccaaatccgatacagccggcccgtcacgcgattggctgagcttcgtcaagagcccgaaggcccgcaacaagattcgtcagtggttctccaaggagcgtcgtactgaagccatcgaggagggccgcgacgagctgacccgcgcgatgcgcaagcgcaatctgccggtcaacacattgcttacgcccgaagcactggtgggtgtggccgacgaccttaacttcccgaacgcggacgccgtgttcgccgccattggtgacggacaggtctccacgcagaacgtcatctcgcatctggtcaaggatgcgggtgccgacgaggtcgatgaggaagtcgagcaggaagtcctgccgctgaagcccatggaacgcaaggcctccagcagctccaccggcgtgtccgtcaagggcgtgggcgatgtgtggatcaagctggcccgttgctgcatgccggtgcccggtgacaatatcatcggcttcatcacccgtaatcagggcgtatccgtgcaccgcaccgactgccagaacatgatcgatctgaaaaacaagcagcctgagcgtgtggtcgaagtcgaatggaccagcaccaagggcctgttcatggtcaagattcaggtcgaggcgctggatcgacgaaacctgctttcggacgtgacacgtgtgctttccgaccatggcgtgaacatcatttccggtacgatcgccaccggttccgatcgcgtggccaccagccagttcagcttcgaaatggccgatccgcagcatctcaactcgttgctggcagccgtgcgcaagattgatggcgtgttcgacgtgtaccgcatcactggtgccaaggaatccgccgaacctcgactgcgcaagatgaagtaggccgttgcttggctcccctccgggaggggctgtcagcgaagctgactgaggggagcagcgcgggcttgcggaactcccctcagacgtctgcggcgccagctcccctcagagagggagccaagaatacgaaaaggtcctgactggaataccaatcaggacctttgctgtatatgtgtcggtcttactcggccacgttcacggacaaaattacggccggctcgagcgggcgatccatcggatcggtgtccagtgcttcgagcttatcgacgaccttcttggagtcgtcatcggcgacctcgccgaagatggtgtggtgaccgtccagccacggggtcggcacggtggtgatgaagaactgggagccattggtgccatggaccttgccgtccatgccgcgacgcagaccggcgttggccatagccagcaggtatggcttgtcgaacttcaggctcgggtcgatctcatcgtcgaactcgtagccagggccgccggtaccggtgcccagcgggcaaccgccctgaatcatgaactgcttgatgatacggtggaaggtcaggccgttgtagaacttgccatgggaaggctggccggtgtacgggtccgcccattccttctcgccggtggcgaggcccaggaagttggccacggtgttcggggccttgtcgtcgaacagatttatggtgatgtcgccctcggaggtatgcatgattacggtagtcatggtccccagtgtctcatgggcttgagaccggccggaaaccccaatcccgtcatgcttcgaggggctggacggggaacccgagccggacgggaccccgaacggcacgaaaccggccaaggcacctttagctgcacctgagattccaccctcgaccggggcgtcggggttgaagggactgacaaggaacctgggggagccggcacctaccagagcacctggtttctcggtaaacactccatacttaggcttggtcgattcggtatatccagtttttaattgcgacatcaatgaatcatccatgagtgcctcggcggtggttccgagaaaatcggcagatttgaccaaatccgccactgaccatgcaattcgccccttcattttgttagtcatggtcggccgctgtatgcctagaaaagcggcaagagcactctgtgatttgttttgtgcagtcaaaagcattttgacgttccaggcaattacagactctgcatattgcacttcagtgtcgacgtttttcttggctgttgctggggctgatgtggtcattgttagtcctctgttatgcgtgtttcttaatagataacaacaagtgtatccatcgatttgcgtttcgtcaaaggaaacgctatattgttagttatgaagaaacaacaggacgcgaaaggaacatccgacatgaaggaatggctaaaagcacaggggatttcctatcgcaaacttgccgcctccatggggtcatcggctgcgactgtttgtaaaaagttgaatggtgagactccctggcagcagcgggatttgctgttcttccatgacaagttcggcttgtcgtctgattttgttcttggcatttcgtctgatgccgatcgtgaggaggttgcgtgatggctggtggaatctacgaacagtccgaatggccggacagccggtgggattgcgtcacggtgtgcgatggatgccacacagtggtctggggcacgttctgggatgactacgattcggccgcccgcgacgcttatttcgcccgtaacggctggcgcaactactgcgtcccgggcgacacggagattttggagctctgcccggcctgcgccgtgcgcgccctgcgccgcggcgagacccgcggcctggccgacacctggctccgccccacgcatgcctacacgcatgccttccgggaggtcgatgcacagctctccgcccgcgaacgggtggtggcaaacctgctgctgaccgaggggaggacagcatgagcgacgaagccggaagactcgtcttctcccgcgacccgtcgggaacattcatcgacggtatggtcttcggaacttcaggaggcggcgagaacgccaatctcgaagtgctgtgtgcgttgccctacgagcttgtacgcccacatgctagtgcctctgtcctgggtccgctggtcggcgtagggaatgtgaagaggctgtccctgagcgtcaaataccttgatggtgagatatccgtcgggcggtacgaccgtgtatccggctttctcgttgagcaggcgcgcgccctcattggtggggatactgagtatcagctcagcgtcgtggtctgccgcccaggagtcgcagaacgccttgatctgcgatccgaagccttcgcgccgatgctttctgacgaccgcgatcccttcgatgatggctgcatgctcggcgaaagcctctcgtatctgtgcggcatggaccccgctcgtcccggtgcggtatatgagcgtctcggctacgcaaagggctggctggatgagggccgcgcctatcagacggtcctgtccccatacgcctatgtacgtaggcctgatcgttccatcgtcgtgtctgacgactgctgggacgctttgatcgaagtctttgatgtccctgatgagcaggctcttgattgcctttgcctcgccatccgttgcggcggcgcgtggcccgtcgacggcgagggaggtggtgcgatggtctgatcccattcgattctctctctttctctgcagctaaaagaaaaaacgcccgttcccgatgctggaacgtcggggacgggcggtgcaaccaatattccgagcggccgcggatcccgtatcttgccggatcccggtccgtggccgcccaatgcattgtcttggagtagtgatcacacatgaacgactttactaaagcattccgcatgtcttgctctgtgtttcccgagtgtaaccgggatttccaggcgtcggtttggacgttcccggtcgtggtggcattcgcccgccacaacggtccgggctccgtcgattcccgccgcctggcgtcgatgatggcgcacccgtccatggaagggagactcgcgtgaactggcttgcaatcgtattgatcgtgttcgtcgcgttctcatggctgatgacgctggccctgtgccgggcggcacgtctcggcgacgagatgtccgccagattggccgacgaacgccgtgccgcccagcagcgtgaggaggagcgtccgtgagcaacatcgcactgtcatgggccttcaaatgccatgtgggcaacgccagcgcgaaggccgtgctcgtctacctcgcggaccgcgcggacgacgatggcaccgcagcctatccgaagatcgcgaccatcgtcaacgtcaccgaactctcggaacggaccgtgcgcaccgcgttgaagactctccaggaacgcggcttcattcgccgtggcgaccaacggtacgcgcgcctcggcaagggcggcaggaaccgtctgccccagtactgtcagatcgtgtgggacctcgcggtcgaatccgacccgtcgaccctcgaatggatcaaggagacgcacacggcggaacacgacccgaagaccatgggcaataccgtggaccccgccgcctccaccatcatggaaaacggcgaatccaaggacgtgctgccggaaaacgctggaacgaagccgattcccagcactgcaaatctcgcagggctggaaaaagggccggaaccggcactgcaaatcccgcagggccagcactgcgagagctgcacccccagcactgcaaatgccgcacccccagcactgcaaatctcgcagagctgtatatataaggataaaaccctccaggtaaaccctcctagtaaaccctccttcccctctgcccctacggggcatctccccgcaagcggggcggccgccgccgaaaagaataaaaacgaacaactcgacgaggacgacaccgagatcgccgaagcggccggacgggtcctcgcctcgctcggcgagcagcgctcgatgctcggcctggccacgccctcaccgaccaaagccgaccgcaaggccatcatcggcctgtaccgcaggctcgtcgaccagggagcgcaatggcccaccctcgtgatggtcgacgcgatcggctttgccatgaacggcgattggtggcccaaacgcatccgcaccggccgggccctcgccagacactgggacgaactcaacgacgacatgatcctcgcagccggccgcacagacggcgacgcacacgcgcagacggttccgccggccgagtccacggagccggatgctgcgccatggctgcccgactgggccgtgaagacgctggccgaattggacggccaggacgcgacggccggaggggaggcgacggcatgatcacgcgcatcgactgttccgaggtgggtttcaacgaattcctcctcgccaacccgcagctcgacgggcacgcggacctgatctggcagctgcatgccgtctactggcgcaacaagcgcctcggccatcccaaggccgtcggtctgctgatccaatacgcccgggcatgggccgcccgcaatcccggcgaaaccgccataggacgcctccatgcccgcaagacgccgatgacgcaaggacggcggccatgaacgggcgggacatgatgccggcctgcgcgagaatcgccgcggccgacccggccatggcggatcgcatgtggaacacgacgaccgacgacgatggccgggacctggtcgacgaacggatgcgcggcaagggccgcatgctgtgtgccgcgtgccccatgcgcctcgactgcatcagccgcgctctcgtcaacggctggaaggacaaggccgtgtacggcgggctcgactatccgagccgctggaccctcgcccgactgatcgcccgtgacctccacatcgccgacggcggcctgcaccggatcccacggagtcgggtccgtgactggctggccgaacatccggactgggccgaacgcatgcgccgtgatggccgcgactactggcgacgggccaaacgccgccaacgctcgcgccgcgaatacgcgaccaacgatccgctgttccttccgaccgaacccgtgccgaagggcctggtccagggcagcctcttctgaccgcttcccgtcgcgatccgcgtgggacgcggcataaaccgaaataccgaaaaaccaactaaccagaatgccgaaaaaccggataccgacataccgaaataaggagaaaccgatgaacgacaagaagaaccgcgagccgatggtgatcgcgttggcgaccggcaagggcggcagcatgaagaccaccagcgccgtgttcctggcctgcgccctcgtggaccagtcccggggcgagcagcatgtgctcgtcgccgacgcggacgtgcagggcgacgcgaaggactggtggtacagggccgccgagctggacgacccgctgccgttcgacgtgatgtccgccgcgccggccgacatcgcgcacctgcacgggatcaacggccgtctcgacgaccccgtcgactgggtgctgatcgactccgccccatacggccgcgcattggacgaatcggtgaacaacgcggacctcgtggtcatcccgtcgagccccagccgcatcgacctcgaccaggccgccggggtgaaggacctgtgcgaccgtcgcggcgtccccgccgcgatcctcctgtgccgcaccgaggccaacacgaccgccctccgcgacgccctagcctggatcgacgccgcggacatcgcgtgcttcgagacgctgatcccgaaacgccaggacatcctcaacgcgaaatccacccgcccccgcgggtcccgcctgcacgaataccgcgacctgtccggcgaactcaagcagaccatgcgacagctcaaggaggaggacctgtgaggaacatgaacctgacgccccgtccgcgcgacctgaccgcgctgctcaacagcgaccggacggacccggcggaaaccggaaaaccggaatcggtggaaaccgaaataccgaaaaaccggaagaccgtgaaaccgaacgacgcggagggctgggtgaagaccagcgtgagcctgcgcgcctcgacccggcgcaggctcaagaccttcgccgccgagcacgacacgcggatccaggaagtgatcgacgccgccctcgaaacgtacctgggctttggaggggaacgatgaaccgcatcatgctcctcggactgctggtctgcatctctcgcgtggcattgtgcggagtgatgggcgtgatggccgaaaccgtcgcccggcgcgctggatccagcagccttcgcggcctgtgccgcctgtgcgtcgtcgcctacgctctcgtcctcgtggcgtccttcgctccgatggactcggcccagaccgtcgtccatcgggccgtcccgctgcttttcctcgtcccgaatcttttcatttggatctcgatgcggccctccggcgcgtccatgcgcggcacgcgccggaggaacgatgcagacggctccgccgattcgataagctgtgaacctatgaacaaggagaacaaatgacagaaaaagaaaaggccatcgaagatgagaccatcgaagtttcggccgagtccacggaaaagaaaacaaagaagccgcatcgcagaagggccatcgtcatcaccgtcgtcgtactcgcactgctcacggcgggaggcatcgcctggaaggcgcacgcggaccgcctcatggccgaggccagggcggattgcgcggccgcatccgaacgcctgcgcaccgcgacgaacgactggaacacgcttctgaacgggtccgcggcggacgcggcgaagaccgataggaaaagcgtgaaggacgcgaagatgctggacgccctgtccaagacgatgaaggccacgattccgaagaccgtttcctgcaaggcggattcgaggaccggcgtgcaggaggccgcaaaggccatcacggcgaacgcggcatggtataagacgcatgcgaagacgctgtccaaggccgtgaaggcggtcgaatcgtccaaactcgacaagaccgtggacgacgcgcaggcgctctacgacgcgacctccgggaaggtgcaggacgacaagacccgcgcaagcctgctggacgccatcaaaaagcgtgacgcggatgccatcggcaaggccgtgaagacggtgaacgaatcgaaggcggcgaaggagaaggccgacgcggaggcgaaggccaaggccgaacaggaggccgcggcccaggccgccgctgcggccgcacagtcgcaacggcaggcccagtcgtacacgccgtcctatacgaacaccggcacgagttcgggccgctcctacacaaacgtcggttcggcgggcgcatcctcgggatcggctggctcatcgtccggttcggccggtggttccagcggttcgggtccaatcagcggcggatggggcgatccaggtgcctgtagtttggaggattgttccatcccaatccaacattaagccggtcgactccgtttctctttcagggccgttccacgaacatccgtgggacggccctttcctgtctcctgcgcgaatgtccaaaccggagtccgtgaaaccgggttgcaatggtatcggtcggggatcgcgatccccgacccgacacagtcaagtgcagagtctctgaaaggagaggaacattgggttacaccaataataaacggaagacgttggcgttgctgacggccgttgccaccttggccggcggcctgaccgcgggcaccgcatacgccggtggcgagggtggcaataggcccggcaccggcggcagcggcgcggcaacgcagttctgggcatacaaggacacggcagacggctcatggggcagttcgaccgacttgaacagcgtggcccgggccatgaaggccgtgggtgtgacgatggacgactcgtccggcaaggccgccgccgcgctggccgacgcgaacagccggtgcgtcgccggtttccaccagcgccatccgggcgagggcgacggcgactgccgcgtcgtcgcggtcggcgcggtctccggcaacgggtccaccaccagcgtatggaacggatccggcatcgccgacgtgagtatatggttggacaactggaacaagtacgtcgcaccaggcgattacaactacgctggaactcgtcactataagacctctaccgcgtttgatgacgatccgtccatgagtgtggacaagctcatggaacggtacgtgtccagcacggccagcatcgtcatcatcgcgctcgacaaataccagcccgccccaccgaactacgacctgaccgtcaccaccacgcacaagcagaggaccgacctgaaggtcggctccaccgacccgatcggcgacaccctgcacgcgagcaacaacggcagcagcatcaaagagagcctgaacggcacggccatcatccactacgagggccagaagaacggctacgtcgccgccaagacggtcagcaagccgatcaccttcgccaacaacggcgacacccagctcgagaacctcgccacgccagccgacttcggcatgagccactggcaggaaggccagtactggatcgatatccaggtcgccaagcagggcaggatgaaatcggccgtcgacacgaccgacaaggacccgtccgagacctggaccgtgagcgccgaaccgccgaccccgccgaccaagaccatcgacgagggcgtgagcgccgacagcatgaccaaccgcaccgtcatcacctacggcaccggcaagggcggctacgagatgacgctcaaggacaagatcacggccaacggcgtcgactacaccgtcgacgactacaagctcgtcgacaagaccgacaacgaccgcgacgtgtccaacgagttcaccatcacctgggaccgcaagacggacaccgtctcggccgtgcgcacggccgacaagggcgagatgcccttggaccaccagtacgaattcagcttcaatgtcaccgtcagcaagccgaaggacttccggaaggtcaaggaccacgcgaccggcaagtggaaccaggaacccgaggccgacgccggcagcaaggaattcgacacctggcagtccaaccccgacaagagctggatcttcgagcaggacggcgaatggcaggccgtcatcgacccgcaggagaccaacaagaccggcggcgactcccacacctacctcgacggcgacaaggtcggcagcgtcgtcaacggcaccgtcggcaggaacctgatccaggcgccgaaacagttcaccctcaccgatgactggacggccgccgactacatcttcgacgccgacaccaagaacatccgcgtgtacgaggccacggccggcaccgaccgcgaaagcagcgtgagcgacatcgtcaacaccggcaaggacgtgaccgaccagttcgacatcaccgtccagggcaccaaggccaccgccaccgctaaggcatcctacctcaagggattgaagaaactgaagaacccgaagcaggtcacgctcctcatccccggcaggatcaacttcgcggacggcaagggcgcggcccaggtgcgcgacgacttcggcaagcaggcgggcgacgaactcaccttctgcaccgccccgaacggcaagaacctgaccaacggcggctccgagaccgtgaacaatcacaccgagccgaccaacgaaccgcagatctgcggctacatcccgccggtcaagaaggacgtcgtgtccgaggcgagccagggcggcgaccaggagagcgtggacggcaaggtcgtccagcccggccagaaggtcgaataccagctcaacacccagccgcaactgccggccgacctcgcctacgaggtcaagtccgtgagcttcaccgactcctacgacgcctatctgaagccggacaagcagaccctggagatgatggacctgaacaccggcaagccggtgtccaagaagaagtacacgaccacgtgggatgattccaagcacatgttcaccctgaccgtcaccgaccaggagacgatcagccagtggcgcgccggcaccagcccccgcctccaggtccgcttcgagggcaccgtctccaacgacgcccccaccgaccacaagatcggcaacaagtgggtgctgaccctcaacaactcgctgaccccgagcaacgaggtgttcaacatcccgccgaagctcgacccagtcaagaaggacacgcagaaggacccgacgatcagcatcgacggcaagaccgccctgctgggcgacgagatctactaccgcgtcgacatcgacgccaggcaggacaaccaggcctacaaggtctggaggctcggcatgaccgacgactacgacgacgagtacctgaaactcgacgccaccaacgtggagatcaccgacgagaccggcaaggacgtcaccaggaagttcaacatccaggacaaggacggcgtgctctacgcctacgccaagctggtggacaccgagatccccgcgacgggcgagaccgtcaagggcgacccgcagccggaagacctcaaggcctacagcgagtccgacaagcacgacccgctcacccagcccgccatcgaccagaacctgttgggccacacgtacaccgtgaccatgccgatgaccgtcatcaaggtcaccgacggctacaccgtgaagaacaaggccacgcaggtgctcaaccggatccgcaaggacaccaacgaggtcacgaaccccctgaagcccatcaacccggccaaggacgtcaccgtgaaggtcggcggcgcatccgccaacggcaagagcatctacaagggccgcagcttcctctaccagctcgacagctccatcctgccggccaaccgcgcctatccgcaggtcgacaagtgggacatcgtcgactccctcgatccggccttcgacgaatacaccggccagtgggccgtgtacgcgacccgcgacctgctttcaggcggcgaggtcctcgcgtccaagggcgacaggatcgccggctccgacttcgactcctcgaagctcggcggcgacctcttcaccctctccgcggccaccgtcgacggccgcaacgtcgtcaccatcgaagcgaccggccgctacagggccctcgtgtccgacgactcccatgaggccggctggcgcgcctacatccagtgcaagcgcctcgccgtgaccgaccgccacgagaatcagttcacggagcactacaacggcaaggacctcgagtccaacgtcgtgtggacccgcaccccggacatggccccgagcattgacgtccagaagtgggaccgcaagtccggctggccgaacggcgaccgcgacaattcgaaggacgctttgaccgtctccggcgacacggagatcgtgttcaccatcacgaacacgagcaagaccgaccccgacacgaagcagggcgcggtgttccgcaccaaggacatcaagctcgaggactccaccatcgtcggcgacggcgaggtcgtggacctcaagtacccggccgactgggacaccaaggtgctcaagcccggcgagagcatcgaggtcaccggcacgctcaagggcgtcaccaagacccacaccgaccgagccaaggtcaccggcaccccgttgaccgaatgtccggtcgacatgtcggccccgttcggtgacggcacctcggacgacgagtccggcttcaagcccgaggccgagaccgagagcaagtccgatgacgtcgtgaccatcgacggcaaggactactgctcggacaccaaggtggagtccgccaccgacgactggaacggctaccgcaggagcctcgcccagaccggcgcgggcatcgcgctgatcgcgctggccgcggtcgtcgtgctcggcggaggcgcgggcctgctgatcgcgtcccgccgacgcgaggcgaaggccccggccgacaccgagggctcggaggagtgatccgacgaacctgaccccgggcccgcggcggaccgcccccacgatccgccgcacgggcccacgggcgcgcccagatcctttcccttcccggacgcgcccaagtccccaccggtgccgtctttgttttcttctttgtgacggcgccgggttcgactcccggcgggggcacgccgcgggaaccccttcccgcgcaccatggaaaccagaacggggtggcaggccggatccaatgaggttgggtccggccggccacccctttcccttgcgcatcggaccgtccgactccttgatgccgtccgtttccatgttccgcggcccgcggaacgccggacgggaaccatggcactcgaaacccggcgcgcggcggcgggacccggccccaccggcgaacggtcggcggggccttttccataccatcgtccgagcctcttcgggttcgtcgggaacgtccaaaccggagccttctcgacggccataccgtggtcatgtcatccaaaacatcgaaaggaaaacatcatgtacggaatcgccatcgcggcagacagcggcagcgtcgtcaccagcgcgttgcagctcttcagccagttcgccatcatcggcggcggcctgtgggccgtgtggggcgtcatcaccctggccggaggactgaaggaccagaacggccccgccacccagtcgggcgtctggcaggtcgtcggcggcggcctgatcatcgcggccgcggccctgttctccaacatcgccctgtagacgggaggccgcgcatggtcgatttcatcgtcggtatcctcaactcgatagggtccggcgtcggcgacgaccttgtggccgacctgctgaagacccccgccgaatacaacgcgggcatgtaccagctgagcctgaccgtcgcccgctcggcggtcaaacccatagccagcacggtcctggcgatcatgtgcgtcctggaactcgccagggtcagtacccgggcggacggcgaccgagagctgggcgtcaagctcgtcgccatggcgatgttcaagctcacgctcgtgttcacagcggcccagcacagcgagctcatgctccaggccatcgacgagatcggcgacagcgtgctcggcggcatccattcggcggcgcccaccaccggcgcatcgtcgggcctcggccttggcgacagcatgcgcgacgccatagactccgccggctggatgggccagataccgtgcctgatcctgctgctcatcccgttcctcgtctccaagggcgcgaccatcgtcgtcaccgtcgtcatcctcctgcgtttcgtgcagatatatatgctcacggctttcaacccgctgccgatcgctttcatcgcccaggaggagacccgccagtggggcatcaactacttcaaacagtacgcgtctctggtgttccagtgcgcgaccctgtatctggcgatcctcatgtaccgcacgctcgtgggcggcacgctcaacccgagcaagttcaaggacggcgacagcctctccggctgggtgatggacaacttcaccggcctgctcctggcgagcgtcatgctcatcggcgtcgtcatggcggccaactccgtcgccaagaagctcttcggcggcgaatgagacacaacgcaatccacgaaaggaagcaaacatcatggcgttgcagatgcccgtctacagggaactgaccaccatcgagtcgaaggtgttcatggggatgagctggcggcagtgcctcgccgccgtcatcctcgccgtcgtgtgcgggggaggatacgtcggactgtggctcgggctgggcgtggaccccaacctcgccatgtatctgatcttcccgcccggcctgcccatagccgtatgggggtgggtgaggccaaagggcctcatgcccgagaaatacctgaaatacatcctgcgccactacacgcagcgcgaggtctacctgctcgacggtccgggcagaccataccgcaccggcgcgaagccaacgatcaaggaaaggtgaggaatgttcggaaagaagaaactcccggtggccgcgccggccgaaggcggtgccgaagccagggcgaaggcgcggagaaagaaggcgacgcgtctgccgaagggcgtcaagcagctcatcggctacgacgcgatgctgcgcaacgggatcgccagcctgggcgacggacggtggagcgccaccatcctcttccaggacatcaactaccagctgagcccggaatcccatcagatggagatcatcgaccggtgggccaagctcatcaacagcttcgaggccgggcaaagcgtgcagatcgcctcctacacgcgctcacgcggcgtacgcgagatcctcgccgacgtgatgatggacgagaccggcgacagcctcgaccactacaggcttgactacaaccgcctcgcccaaggcaaactcgaatccgtcagccgcaacaccagcaccgtcaagaccctgaccgtcaccgtccgcgaaagcgacgagcaggccgccgtcgcgagcttgaacgccctgtgcaacaacctcgtcagccagatgcgctccatcgacgcatgcaaggccacccgactcgaccgcgagcaccggctgcgcctcatggccgaggtgctccggtccggcgaggagttccggttcgacgaacgctggttcgagcatcagcccggcaggcccgacaccaaggacctcgtgtgcccgtggagcatcgacgcgcgcaacccgaccatgctcgacatcgaatccctggactcgaaatacctgcaccgcaccatgtgggtgtccaacctgccgccggaactgtccgaccagctggtcaacgacctgaccggcctgcgcgcccgcgtcgacgtgagcatccacctcgcgcccatggaccgcagcgaaagcatgacgctcgtgcgccgcaagaacgccgaggtcaagatgcagatcatggaccagcggcgcaagaaccgcaaacagggcctcgaccccgacgaccttcccgacgacctcgccgaccagcaggaacagctcggccagctgcgcgacgagctgcgctccaccaaccagaggctcgtggactcgatcatcgtgatcggcgtgtccgcggcaagccaggaggagctggaggtcgcgtgcaggaacgtgaaggccaaggtcaacgcgcagtcctgcacggccgagagcctcaagttcatgcaattggagggcctgacggccgaactgccgctgggcaacaaccccctgcccatgaaacgcaccctgaccacgaacagcgcggccatcctcatcccgttcaccacgcaggaggtgttcgagccgcacggactgttctacggaagcaacgcgaggagcggcaacccgatcctcgcggaccggcgcagccacatgaactccaacggattcgtgctcggcacgtccggcggcggcaaatccttcaccgtcaaacaggagatcgccggcatgttcctcaaccgtgacgacgaggtcatcgtcatcgacccggaacgcgaatacctcgccctcgcggccgcgttcggcggacagatcatccagatcagcgccggcaccggcacgcgcgtcaacccgatggacatcgtcctggaggacgattcggcctccgaccccgtcaaggacaagaccaacaacgtggtctccatgatcggcgcgctcataggcggcatcgacggcctcgacccgctccagaagggactcgtcgaccagtgcgtcagcaacctgtacacgcgttaccgcaaccagggcgggggagtggtccagcccacattgcaggacctgcacgacgaattgcaggcgggcggcgaccaggtgagccggtaccttgccgacgcgctcaacccgtacatcaccggctccatgagcggcttcaacgggcagaccaacgtggacctgtccaaccggttcaccgtgttcgacgtgtccggcctgtccggcgagctcaggacgttcggcatgatggtcgtcatcgaccaggtgtggaaccgcgtcatccgcaacaaggccaacgggcggcgcacctggctgtacgtcgacgagttccaccgcttcttctccaaccagtacgccgccgcccagttcaaggacatctacaagcgcgcccgcaaatacgggctcggcgtcaccggcatcacgcagaacgtcgaggagatcctcgacctccaggacgcgcgcgagatgctgtccaactcggacttcctcatgctcctgagccagaacagcaccgacgcggacgccctgtgcgagctgctgaccctgagcgaggagcagcgccagtacttcaccggcgtgctgcccggccagggactcatgaagatcggcagcgcctacgtgccgttcgacgggcgcatccccgcgggcggcgacctctaccggctgtactccacgaccttccaggaaggaaagtaaacgcatgagcggaacccaagcccaccacgccggaggcacacgcgcccgcatcggacgcgcggccaccggcgtggtgtccagcgccgcgcagttcggctcggaccggaccgacatcgccgattccatgggccacaccgccgccgagatggcgggacgcgccggcatgtacggcatgtcctccaccatgcacggcgtgggctggacggccggcaaggcgcggcgcatcatgaaccgcggcaaacgcgccctgcggtcgggcaagggaatgcgcaagacggccggcaaacccaaggcgctgtccgaggcgaagcccagcgagaagatcggcaagttcgccgcgaaaggcaaagcgagcaagcggatcggcaagcacataggcacaggcattgggaaagccggccggagcgtcaaacgaatgggatccaccggcatgggctggatggacgaagccggcgcgaggctcaccgctgccgacgacgacttcgcatcgaagctgggaagcaccacacgcgacctgtccttcaaagcggcacgcgcgggcgtgaaaggcgtcaactcgtcggccaaattcatctggcggcaccgccgcgcgcccgtcaaggtggcgcgcgacgttcaagccaccggacaggccgccgtgcgtgccgcccgcgccgccgtgaacttcgtgcgcatggccacgtcccgcgtcatcgcgggagccgcctccatcagccttcccatcctgcccgtcatcgcggccatgctcgcggtgctcggcgtgctcctggccgtcatgggcgcgttcctgggatccagcgccagcgaatccacggtctcgggcgtgcccgcggaatacgagtccgacgtgatccgcgccggatccatctgccaggtcgtcacgccgagcatcatcgccgcccagatcgaccaggagtccaattggaatccgaaggccggcagctccgccggagcgcagggcatcgcacagttcatgccgtccacatgggcgtccgcgggcaaggacggcgacggagacggcaaggccgacatctggaacccgcacgacgcgatctggagccagggcaactacatgtgcaatctcgcctcgcaggtcgaaacggccaagaagtccgggaaactgaccggcgacacgttggagctgaccctcgcggcgtacaacgctggcctcggcagcgtgctcagatacggcatggtgccgcccttcgaggaaaccatcaactatgtgcggcggatcaaggaactcgcagcgaccaaatacaccgcaacggggaccgccgagggtggcacggtcggctccctcgaaccgaaactgacggtctccggcggcatcgtgtccacggccggcatcacgccggacacgagatacccatgggggcagtgcacctggtgggccgcgaccagaagagccgacataggaaaaccgataccagggtggggcaacgccgccacatgggcaggttccgcggcgtcggccggctacacggtggacggctccccatccgccggcagcgtcatcgtgttccaaccgggagtattgggcgcgtccgccgactacgggcatgtcgccatggtcgaggaggtccgcggggacgggtcgatcctgatcagcgagtccaacgcgcttggcctcggcgtcgtatccacacgcgaaatcagcgcctcccaactggccgcagccggaaatggcgtccgctacatccattgaaaggaaaaccaagcatggaaccaaagaggaacaggatcatcgccgcgacgggatttgcggtcgcgctcctcatcctgggaggaaacgtcgcggtgatatgcgccggcaacggaaccgcggaggacacgcaaagcaccgtcgcccggccgcgaacgaaaaccgaacccggacaaaaaacggctggagacgaagagaccgagccggcgacgccgacggaggatgatccgtgcgccgacctcgcgccgaaagcgctcggcgtctacatgggcggcgaacgaggccaactcgaaggcgaatacttcacgccggatgccgccggcctcgacataccggcatcatccatagccccgcagccattgcccgagaccgagttcaccggcttccccgtgtccacggggcggcgggtggcgacatgcgccgtatccaccgggctggaggcatcctgggtgcttgactacacgctcactgacgacggctggcgatgcgcggcggtcaagggcccattggaaggcggataccgggtgcatgaaggcaaaccagaggaacaaaagtgatgaaggcaaacgaacaggatcagccagtcctcatcaaagacgagggcggagaggaatgaccaggatcgacaggaagacgggtgagctgattctcagccccaagcttacggtcgaccagctgtacgccatggccaacgagcccggttggcgtccatggatgcgcctaatcgccgaacatccacacgcgtggccggagctcgccgaatggtggcataccgcgcaggagcaaggctttgacacggccggcgccgcgccgctgccgcccgcgtccatgcgcggccgccgtcgcgtcgccataccgtccgcgccgctgccgccggaagacgagccggggcaggaacccgtgtctgcgccggcggagcagtctcctcccgacgattccgcggagaaggccctgaaggacgccgacgacgattttgccgcactcgaacgaatcgccgacttggaatcggatacggcggacatccctccaataccggaagcagaatcgtcggggtcggccgtcacctactcggccgaccccgacgatctgaaggtgcgtcgcgtcttcccggtcgggaaagcgctcgtcgcgatcgtcatgaccgcgagcctcatagccgtgtcctggatgggactgcaaatcaaaaaccgccgtgccgctgccatgcggcaagaggtgcatgagaccgcaatcagcgcatgcgactcggccgaagcgacacgcaagaccgtccagtccgacctggacaggaccacggccaaagcctccagactattgaaggacaccagtcgcggccaagtcgcggatcccaagacgcttgatgcgttgaatcggctcctggacgcaaagacgtccaccatcaagggttcctgcgcgcccgacgccgtcacatccgacgtggacaggaccactgcggcgctgcgcagaacgaccaaagagctcaagaaccgtctcaccgacctcaagaccgcggccaaggccgtcaccgacagcaaacttgacaagaccgtggacgccgcgaacgcgctgtacaagcagaccgacggcaaggtggcggacgacaagacccgcgcaagcctgctggacgccatcaaaaaacgcgacgcggacgccatcgcaaaagccgtgaaagaggtcaacgaatcgaagatggcgaaggaaaaggccgacgcggaggcgaaagccaaggcagaacaggaagccgctgcggccgccgcgcagcaggcgcaggcatcgcaatcccaatcggttccacagcggcaaacaccctcatattcgggaggaagccaatcccaatcccaaggaagttccggatccggttccgaaaccgttcgacgtccgtcttcgggaggctcgtcgtcctccaccaatacgggcggagcctcgccgggatggtccgtgcccgcgccatcagacgagggcaccggcctgcccggcagcgatccggggttgtgattggcttcatgccgctgccttccattctttggaatgcctgagcgtggatttcggtctggcgatggcggttccgggccatgccttgcggctgaggaacgggtgcagtcctcgcaggttgtagatgcatttgtcgttgtccaattgcgcgagctcgtcgggtgtgaggagttcgcggccggtgcgctggtagttggtggtgtggctgccggacacgcccttggagtcgctggtggtgcggatgtcgatggtctccttgccgagcagcttgctgagccattcggtggtggactgctcgttgccgccgaggaacagcaccgagtcgcagttgcctacgatggtctcccacgagtccttgtacatcgtcttgagctgggcgatggtctggaggatgatgctgacgctgaccttgcgcgagcggattgtggcgatgagcttgtcgaagttggggatgcgtcccacgttggcgaactcgtcgaggaagcagtgcaatggcgtggcgaggcattcgccggggtaggtgcggcagcggcggatgatgctgtcgaacaggcattggtagaagatcgcggccaaaaagttgaatgtcgggtcctcgtcgggcagggcgaggaatatggccgtcttcccgttgggatgcttgtatccgcccttgtgctcgtcctggtatccgccgatccggtcgatgccgaggttgtcgtcggagaggatctcgcggaccggtccgacggtcagtggggcgaggcgcacgccgaggctgatgatgatgcccttcttggtctctccggcgccctgggtgaagggccggtactggcgggccgcgaacttcaggccctgggcgagacgccatgcctcgcgcaggtccgggtcgtcgtggtccgcgtcctcgcgttcccattcggcgcgggtctcctcgtatatttcagtggcggtccgggcgacggcgtcgacctggctttccttggtctcgtcctgttcgctggcttcgagcaggtcgcgcatgtcggcgaccgcgttgagggtctggccggcgtcgatgtgcaggcagtccttgaggatgtcgtcgggcaggtagtagacgaacgcggtgagtgcggtcaggaggctgcgttcggatttggtccagaagtcgtcggtctggtgctccttgggtgtggagccgttggtgttgtccatgatgttggtgaccaggcgcatgatcgccacgtcgggtttcgtggggtcgatgtagcgcatggggttgaatttcgtctcgctggtcaggtccaccaggtcgagttgtttgaccgtgtagcccatcgtctttagtttcccgccggtcttcgcgtagagttcgcctttcgggtcggtgcacgcgtagttcatgctgcccttgaggatgttggggatgacgtgggtggcggtcttgccggagccggagccgccgatcacggcggtgttgagattgcggcgcgtggccggggcgtcgaggctcaggccctcggtggccgtcatctggaggttctgcctggtgtcgcggtcggtatacggggccatctcccggctggtcgaccagcgtgccgacccgtactcttcgccgtccctccagttgcgtctcatgctccaccggtagaggtggaacaggccgaccgcgcacgcgccgcccagtccgcataggaggctggcccggtcgaatcccagggcgagcggatgctggagcatgatcgtcatgccgtctatgatccgttccatgctttcgccggcggcgatgccggcctggacgcgggcggccgcgaggtcggagagccagaatcccgcgaggatggtcagcgtcttgacgatgattcctcttgcttgttccatgattgttcctttctattgttttctttcggcgaggttctccttgagcctggcgcggaaccggtcgtacagcgtcttcctgctggtgatcctcccgtcggccggctccgtttcggcctgggcgtcgccgccggccgcttccgcgtccttcgggggtgggaggggcgtgacggtggtcatgccgcccggcgcggcgtcgatgctgaatggccggccgtctgccatgagcgtggacatgagtcggccgacgtggccgttgatgtcgatccattcgccgtcgccggccttgtccggtctgatgccgctgacggtggtggtccgtgtcatcgattcccgtccggttcgtcatggctgggatcgaacgcgaggcttgtggcttcgatgtcgatgcctgatccttcgtcgcccgcggtgcctttgaccatgaggcgggatcccttgcgcgcgtggtcgcggatgttctccgaatgctccctgccgctggcgtggatggtgattttcctcgtggctgttcccatggccatggtttcaagcagccagtcttccgcgcttctgttttgccgtgggctgctgatgagtgtgccctcgaaccagatgatgggttccggctggtcgtttgtttctgttgtcatgcgtgtcttctgctccttcgtatggaatgaatgcggggtggcgcggaaagcgcgccaccccgtggctggagaggactacagtcttggcccgtgacgcttcgtcgtggaatcggcctgtgcgggcgccttgtgatccggttccggccggtcacggtccaggctttgggccggctggggctccttcaactggtcaagctggtggagcgtccacgtggacagttcactgtcgtatgacgcgcgggtgaggatctcatcgcggttgtcccagacgatctggtcggcctgttgttgggtgatgcccgtccagtcgccctgcgcgttgatgcgcatgagcgggtcctttcgcgggtcccatccgcccatctcgcgtttctccgcgatgtccgcggaggtgaggccgtctccggcgatctggaccgccttgtcggatgggtaggcgaggtaggtggcgatgtcgttctcggggtcgtgcgcgttgacctcgcccacgatgccgtggaggattctgactgcgtcctggtcgggggattcgtatcgttccaggatgtggctcgcgcgcatgcaggacgccttgcggtgctgctcgtagagcacggccggatcctcatcgaccttcgtcacgacgtatccggcgttctccctcgccttcatcgcctggtcgcggtcgaaggcggtgctcaggtatgcgatgtgcctgtcggggtccccgggcttccgccaccggtaggcgtattcctccggcggctggttcgcggccagatggctcgtcccggctgcgcgggccgtgtgtaggccgcccgcgcgttcccagccctccaccgcctcggcgagtgttttcccggcggctgggtcggccgggtcgatgacggtgtgttcgcggtcggccatgtcgttgtcgtcgtattgccattccgcctgtggccggttggcgtaggacacctcgatccggccggccagacggtccgtgtctttccatgcggggttgtcgtggaagtcgatctgcacggcgcgtccgtccgtgagcctcgcttcgaggtagtggcccatggcgttgccgccctgggtgacttcggtgacgtcgtggtcctgttcgagcagtcgtctggcgttttccgttgtcaatggcattcctgcgctcctttccttggtttcctggtctctactttccgtctcccggggttcgtcgggtttggacgtcagccgttcgagttctgcctgtttttgcaggtactcgtcctcgtgggcgaatggttcggccagcgtctcctgcgcggcggcgagttccctttcggcgtccgccagccgttccgtgagcttgccggggtcggtggccatgttcttgacgatccggtcgagctggctgacgatgctggaaggtccggtcaggtagggtccgggcatctcggtaccggattcgtgctcgtggacggccttgacggccaaggtgatccgtccggtggtggccgccctgcgtgcgatgacgggcagtccgtcgtattcggcgatcgtgtccccgtcgtgcgcctggtgggcggcctggtggaggatcctgcatgcggtctgccggtcgccgaccggccggccgttgatggtcatgccctcccacttgccgttcatgcgtgcggtctggtggatgctcagggccttggacgcgagcggcttgtcgtcggtcttctcgcggatcgcctggcggatcccctcgatgcgtggctggagctgctggttgatgtccctgcgggtgtcggccttctgctgcgcccatgaggcgcgcaggagcttcagctggttgatctcgttctccaatgtcatgcggcgttggatgtcggggtcgccggtggccagcgccttgatgttggcgagggtcaccacgtcggcgtcgaggtccgcggcctcgcgggcggggctcttcgagctcatgagctggctgatgaaccgctgcttgcgttccacggtctggtagctgtacgcgtcgaacgtgccctcggtcacgtaccggtagtcgcgcacgtggtcatacgtgttgccctggcgttggattcggccgaggcgctgttccaggtcggcgggcctccatgggcagtcgaggtcgtggatcgcggcgaggcgttcctgcacgttggtgccggtgccgagcttctgggtgcttcccatcagcacgcggatctcgccggatctgactttggcgaacagttgctcgcgtctggcggggttgtcgccggcgtcgtgcacgaacgctatctgctcggcgggcacgcccaattggatgaggcggtccttgaggtcctggtaggcgttccatccgcccgacgcgggcgtgctcgagtcgcagaagacgagctgcgtgcccaggcgtggcgtctcctcctgccagatccgggcgacgttctcggcgcatgcctggatcttgccgttctccagggggcggtcgttctcgtggcctttgaggagcttggggtcgagggcgatctttcgcccgtcgccagtgatccgcaggaggttgtcgacctccgacggcacgtcgccgtcgcgcacgaggtcggccctgtcggacagttcctccatctccttcttctggcggtcggtgatgggcacggggacgggcacctgctccagttcgggcagcggcagctggatgtcgtcgttggtgatcatgtcggtgaactgcttcaccgcgttcatcagttcgggcaggttctggaagcgcgcgaacctttgcttgacctggaatccgttgccttcgggcttcagttccacggtgggtactacctggccgtaggcgccagcccatgcggcgaacgtgtcgaggccctgggccttgagggttccgggcgcgaggtagcgctgcatgttgtacagctcgctcatggagttggagaccggcgtgccggtcatgaacgcgatgttgcctccgtgcccggcctcgcgcagccattcgcatttgtcgagcaggtcctcgcatttcgcggcggacgacagttgcatgcccaggtcggcggaggcgacgggcacgccgaggttcttgaagtggtgggcctcgtcgacgatgagcatgtccacgccaagcgattcgaactcgatgcccgccagtgccttgtcgtcgcgcgactccttgccgtctcgcaggcgctgcatggcggtctcggcgcttttgcgcgccgcctccagccgtttgacggtggggtccttgtcgcccctggccttggcggcggcctcgacggcctgggcgaactcgtcgacgcgggcgcgcatgttcctcagccgtcgttccttgctgacgtgcagctggctgaaccggctctccggcacgatcaccgcatcccagtcgccgttggcgacccggccccagaagcgtctcaccgattcggggttgcgttgcgcgtccttgtccatgacgaggacccgtccggccggatagagcctgagcacgtcgccggcccactggtccacgaggtggttggggaccacgagcatcggcttggacgccttgccgagacgtttcgcctcgtgggagagggcaacgccctcgaacgtcttgccggctccgacgacgtgcgcgatgagggtcccctcgtcgctgcgcagggcgcgggccaccgcgtccttctgatgcggacgcagggcgacgccgtgggcgatgccgggcgtggtcaggtaggatccatcgacgtggcggggccgcatgccgttgaatctgcggttgtacagggcggtgagcctttgcgcgcggtcggggtccttgaacacccattggttccacgcgtcgcggatcgcgttggccttctcgatggcggccatcgtggccttctggtccttgacccgtttgggcttgccggacgccgtggtctccgtgggggagtccttggtgacggtgatctgcgcgttgtccaggcacgcctccagcagttggaacgggttgcggtcctcggtgccgtacgtccttgctgccttgtagtcgatgtcgccgccgcccgagtagccgacgcgccattgtccgagctgggggatccagtcgaccgagtactgggagagcttgccgggcgtgagcccgtggccgcgcacgttgaacgtctccatcatgaagtcgtggacgtccctggcggggatccacggggcccccagcggcgccttgatctgctcggtctccagcggggtgggctgtacgcgttccagcagatcggccacgtgttcgagccgttccgcgtccgtctggtcggcgcgcgcggcctcggcgtgctccggctgctcccgccattgtccgagctgttcctcgcggcgtgcgcggaacgcctggtagtcgtcggggcgcgcgtcgatggcgcgtggcggcgcgccgtaggcgtcgtgtgccgctccctggcgcaggtcgggcaggtcgcgggcgatgccccagatccattcgctgaccgacatgtcggtggcgagccgttcggcgagccgcgtggggtcgtcggtgccgggcatgagacggcgtgccatcgcgccgatggtcgtgtccgtccatatcgtgctgccatgcttgtcgtgggccgaatagctctcgaacaggttggagaggatcgcggtcttgtcggcggtttcgagccggtcggtgtgggcgatcttgtggacgaacagggcgaggtccctgacgggcatgcgccggtcggcgaggatcggcgcgtagtgctgtggcgcgtcgccgtcgcgccatgtccagcacaatgcgtcccacagtgggctggtgccgtgcgatcggtgccatgccggcgcgtgccacggcttccgctctccggtgtcggatcgttcgagggtgacgcgtgagtggcgctcgggcagttcctccaccgcccgccagacgagggcgaggacgagttccgggttgcggttccagcccatggtccatccgtgccgtccgtcgttgatgcgttcgatgaccggcgtcggatccctgtaggattcggcggcgtacgggtccgtgaggctgcgccacacgtccgttcccgcggtgtcgatccattcgcgtgcctgctctatggcgggcatgtcctccgatgtcgcgtaggtggatgccgcgaactccgtcatggcctcgcgtgccgcccggcgtctgaggtgttcggccatggccgtgacgtggtcgagcttcgtacccacgtctccggcgaggtagtcctcggcgggcatgacctcgccggtgtccgggtcacggatgatgcggtcgcccagaccggtctcggcctcctcgacggtggtgtcggccaggcgcgcgatgagttccaggtcgaccccgccggcgcggtcgagactgatgtccagcgcgtcgtccaggctgtcggcatggtcgggcatgggcggcaccgggctgatggtccgttgcgagaggcatttcgccttgccggcgaaccttcccttttcgtcggtctcctccaacgccatgacgagatggcagccggattcctcgccgctgtaggcgcgttggttggcgcggtcgcacagtcgtccgaactcgctcgtgaaccggtcgtatgcccggtcgagttcggcgcgcttggcttccacgtccgggtcgtctacgcgggcggggtcgagttcgagccgttggagctcgcgcgccaggtctcgcaggcggatcatgccgcgcaggcgtcgcgcctcgtcgccctggccgtgggctatctcggtgacggtggtgccgtcgccgtaccagaccactccgcgctggtcgacggagtattcgaacggtgccacatggtccggccggaccgtgatctccgcccgtccggccggttccgcctcgcccagcgacagcgccgggccgtgggtgatctgtgtggagagcagttcttggagtcgttcgccgacctgttccgcgtcgccctggaagacgacgtcgaagtcgccgccgaaccgtccgatcaccggtctgatgtcgcctaccgcgtgcgcggtcatgtcgttggcgaccgcctggttgacgttgacggtcacgtcctggtatccgggcacggcgaccggattggagtggatccacgcctcgtcgggcgtgcggtcgagcgtccgttcgcgtctgcgcagaacgagcacgtcggtgacggcctcggtgccggcctggcgggcgaacgtcgaggacggcaggcgcactgcgccgacgagctcggcctttctcgcgaggtcggcgcgcatggtctcggagcgtttgtcgagcgtgtatctgctggtcagcagcatggcgacgccgccgggccgcagcgcgtccaccgagcgttcgatgaagtagtcgtgcagggggaggcgggatgtgccgccgtccgtggtccggtagtcgaggctgatgtcgcccgaatagggcacgttgccgatggtcaggtcgaatcccggatggatggtgcagtccgcgaggtccgcgttgaggatcgtggcgtccgggttcagtgcggccgcgatgcgcgcgctgatcggatcgagttccacgcccgacacgttcgctttgatgttttcggggatgccggccatgaaattgccggtgccgcacccgggttccagcacctggatgggcgcggacccgatgtcgagcgcgtcccacatggccttgaccactggtccgggcgtgtagtaggcggtcagtgtggaggcgcgcgcctgcgtgtactcatcgtcgtcgagcagttcgcggatctcggcgttcaggtcggcccattcgggcttgtcggagaatgcgtccgcgcatccgccccatcccgagtatccgcgcagcgtgtccgtctgctccgcggagagaggctcgtcgccgttcccatcgagcgtcttgagtgtccgaatggcggcgatgttcgcttcggcgcgttcgcggggcgaacgcgcgcgttgcgagtcgagggatgctagaagctttccacgatctcgtggatcgccatgctcatcgactccgcttgcgcctcgttcatcccgttgagccggtccaggtcggtcatctggggtgccgccttcaggcagtccgtccggttgagcaggtgcctggactccatcagctggtccatgatctgcgcctggcgttccctcgtccgcctctcgatgtcccgcagatgctcctcgagcacgttggccatcatcatctccctgaaccgctgcggatggttgtccatcagccagttgatgcgcatgttctggatcccgtgcaggctgctgcgggtgaacaccttgtacggcagcgcccacttgttgaacagttccggatgcgccgcccggcgctgttccatcgccttgaggttcctctcgtagcgcgccttgaactgcgggtcggtccatgtcatctcgtccatcattgttcctttcttcagtgttgttttccgtgccggaggattgtgtgaaacgttttaccacaggttgcggcgtggtttcgccgggcgtggcggcaccgacgccgagcttgttctcggcggcgatccgcgcgtcccgtcggccgagtccacggagccggttctcccggtattcggccgccacggcggctatcgtctcgtcgtccgcgccgcgtgcacggagtcgttgcaccgcggcgtggcccaccgttatctcgtatccgcgcacctgttccgccgtcctgtcggcctgtcgctgctcctcctcgagaaggctgaacaggtcgatctgctcgtattcgaccgaggcggtctgcttcgcgtataggcgttttctcaccatggttctctcctttcttataaggttttccgctgcccgcggttacgatcggtgccggcggtgggcgggtctgcgttgagtccgtcgaggttcttcttgagcctggtgcggaaccggtcgagcgttgacttcaggtccgtgtgccgtcgttccggaccggcggccggggattgcgaggcgggaacgatggggccttgccgctgtttcgtcgccatgtccgtctctgttttccgtggcggcgcgggtgtctcatcgcctatggcgtcgggcgttttgccgccttccggcacgtactgttcgacggtcggacgatccgttgttttgctcctggcctgcgtcggatcctgcgtgccggtgagttcctggatgagcagtctggcggcctggcggcgttggcggttggtccaccgtccctcgtcctctccggcggtccggtcgacgagtctgcgcgcccatttcattgcgacggacggcttgtacgtaccggcacgctggtattccgtgaaccggccctgcatgcgttcgatctgcggccaggattcctccacggtcttcgaggcgagctccaccgatgccgtgtcgagcgtcttctcggcgtcgcggttgcgtttctgcgcgtcgatgaccgcctggacgagcgtctgcgggtcgacctgcatggtgcggcgttccgctccgcggccggtgaacagctcgaccggggtgccgggtctgaacctgatgttgacggcccgtccctcgttcttctgcctctggttcttcgcgctcatgaacatgtcggtcgcccagccggtcaggtccttgccatcgatggcggtgccgcgggggagtccgacgatcatcttcggccagtcgcgtccgtccttcgcatgcaatatataggtgtgcgcgagcctgttcgccacccacgcgttcggccagacctgcttcgtcgccgcggccgtccgggccggcgtctgtgtcacggctgtggggtcggtgtcccgctccggctgctcctgctgggggagcgcgggcgtcggcgagatgggttggccctggaggatggatatggcggcctggtcggtgaactcgtcccagtccggggcgcgtcgaccgtcgttcagattcagcagcggcttctgctccagtcccggtttgagcagtccgctgcgcatgacgcggccggtcatgccctgggcgacgggtccgccgtcctgttcgcgccagtgctggtattcgtcccggtagacgcggctttgtgtgagcagttcgccgtcgctcatggtcttggcggggaaggactcgctcatgtcctcgctgtggctgatggtggtgacctgcatgctcaggtcgtcgtattgcaggtgtttgaagctcatcgcgtcgaacagtccctgctggttccgatgccaggagaagaccatgaggtcgtacccgttatcctccaggaagaacacgcaggggcgcggctcgtgctcgaccgcgttctgcatgaggctggcctggagcaggtcggggtcgagccgtcccgccgcggacgcggcggcggcgaggctggcgctccatcccatagggagctgccggcccgtcgtcggatccgtcatgcggtactggcccggcgtggccacggcgtcccaccggtcgggatggcggtggttccattgttcgatgcccgcgagcatcgcgtccatcgggctctgcccgtccgccggtctgatggcgaaggattcggtggcgcgggtcacgtcgccggcgattgtgttccggtgcacgatggtgtcgccgggatcgtagatcatgcccaccgagtcctcgccggccgtccttgcagtgccggccgtccatatcgtgtcgccggacgaggcccacatggtcaccggccatggggtcgggtcgttggttccgttgatggtgtcctggaagatcgcggcgtgttgcgtcgcctgttcctgctggttcattatggtttcctttcagcggcccttgcggggcgtgcggtccctgttctgggtgggtggcatgtggttcttttgttcggcgaggttctcgttgagccgggtcttgaaccgttcgagcagtgcctttttcgaccggatcggcttcggtttccgctccttgccggccggcctgggattgtctgccctggcctgcgtctgctgtcgcgtggccggtgtccgggcttcgtccggcgcgggttccggttcgctttccggctccggtgccggcttctcccggttcggctcgatcgtctgcctgcgtgtctgctcctgggtttgcgcgccctgcccgtagtcgtcgcgcaggatggtgtcgagctcgtcgcgcaggctcgggtcggcggcggccttgccgatgatccggtccgcgaagtcgcggccggcctgctcgtcgcatgttgtgtcgcccatgagctcgtcccatgagagttcgggatgccgggcggcgaggctgttcgcggccatctccatgacctccgggtccacgaagtcccaggcgatgcgctgcgtcggcatgggcttcatggctggttcggccggggtctcccgcgccgggggttctggctcgtttcgggtctgttccgtctgctcgacggtgaagtcgtcgtcggtgacgtccaggcccatgcctttgaacgcgcgttgcactgcgtggcggacatggtcttcgtccttgccggcgaagtgcaggatgaactggccttggtcggtgcgttcgaggtggtagtcgatgccggcggtcttgaggctgtgctgtacctcgcgcatggtcgagtcgtcgagttgcagctcgtgcaggtcgccgtccttcttcctttgcaatcgtttctcggacatctcgccgctgtcgatcttgttcttgacggcctcgcccgcggcgtgcacgccggtcttggtgagcttcatgccggaacggagcagcgccatggccacgcccttggggattctgagcatgagcttcgcgcctccggtgatgatggtctggacggcgttctggatcttctcctcagcctgttcctcgattggcattgcggtttcctttctgttgtcggttggtgtttcctgggacggttcagatggaccgtccacgcttgtgctgatgctgttcgcgctgctcggtctccgtttgctcgcggtcgcgggtcgtgtggatctcccgttcgatggcggccagctcgccctcgtaccggtcgcacagggcctcgcgacgttccatctcgccgcgcgtctcggccacgaggtcgaggtctccctgttggatcgcgtcatgcaacgcgatgacggcggcctggagttcgtcgtgcgattcgcggacctttccgcgcagcagcttgagtcccttggcgctgtcgccgcccgcgagcctggtccagcggatcgccgcgttcagcgccttcgcctcgccggcgagccggtcgaggcgtcgcgcctgtgcctggtagtagcgctgctgggtggggcttaccccgtagcgcaggggcagccgttcgggcgaggccagtggttcgagccggcttgtgggctcgccgaaccactggtagaggccgtgggtggtggtcttgccggcgtaccggttggacgggtcgaggatgatctggtcgcggtggaggggcaggaacgcgcgcagcgtggatccgccgtcgtccacgagacgcttcgcgtcgaacgtgatctttttcttccggtgggtgccgggcagccacacggtgaccgtcttcctggtctgtttggcgacgagccgacggttgaacgtgatggggatgacgggcgtgctttgcagtccggccatgatgttcgtcatgtcgtacgccgagccgagtttcgtgtctcggaccttgaagccggtgtccttcatggtgaacgtgaagtgctgtcctcggaccgtcacgtccacgccctgcacgtcgagcatgttcctccagtcctcgaagttctccgcgccggccagggtcaggtcgatcagcatgcggagctggtccttgacgcccaggcccttcgcggacgcgtagatctcctccatcgacatgccgtagcgacgctccatcggctcctcgttttcggcccgtcgcgtcgttcgcgccgtcgccgccgtgcccggttcggaagtctcttcgacatgtttggggtcgcgtgcctgtgtcgtcgggtcttcgttcggcgtggtttcgtcgccgcgcattttgcgtgcgacccgctcggtggcggggttgaagatgacgcttagcccctccctctcgctgatctcgttggcgatgacgcgccactgttcgatgatgtccttgggtagttccgccttcagatgcttcccgtatcgggaggcggcgcacaccatgatgtggtcgtgcaggtggtggcggtcggtgtgtgtggcgaccacgaacttgtattcatcactggtgatgcggtgcgcaaactccacaccgagttcgtgcacccgctcgggcgtcacggggtcatcgggactgaagctcagcttgatgtggtacgccaaacggctgttcttttggatgcctttgggtgagttctcgttgtcttcgagcattggatcagccagcgcgtcgtagtccgttccggtccgctcgtagttggagctgaccagtcttccgccgtcggtcttggcggggtcgatgatgtacgccatcgccccgttggggccgccgagattcgatttcacgggcttgccgagcttgaccacggccatgctcacacgtccttcccggcggtgcgtttgttggcgaacaggtcgccgagcagacgctcgatgcggtcgaacgacgcgcggagctcggccacctgctcggcggtgatgtgctcgttcgcgttggcccagtgggcgatctggttgacgttcacgccgatgcggccgatctctctggcgagcggctcggggtctgtcagcggcctgatctcggtgacgcggatctcgccatcggtcagcattttgcgtgcgaacacggtgaacgaacggtatcttgtcgtgtacttgttcacctttttgtgcagcgaattgacgcgttcccactcgtcgggagtgaacgtgacgagcttctgcacggtgcgtcggcgcttgttcgcccagctcatttcgcacctcccgtggaggtgtgcggacggcacgtccgtgatgccgcgaagcggtctggagagcttgctcggccatggggtctgggtctcccgagcaagccgattcgcggtgcgaatcgagtgaacgtatatacgttcacgtcacttgctactcccatatcaatttcattgattgggagcgatttcgcacggcatgattgcggaatgccgtgaaggatgatcgcgttcactccttgctcctttcgcccatggccttgagggcacggccggtgtcttacgccaatcgtccgtcgtggaaacggcgatgggtttggacacttggagcagggaaacgagaaggccccgcgaaaaaatcgcggggccggtgggtcgttggtggcgcgtcatgtccgtcatgcatacgggcatgaaaaagccccggcagtcttgatgacggtcggggcaggggcgcgtgggcttctagatgatttgcatgtcggagcggacgcgttccgcggcgatgtcgatgtctccgggccatgagggcacgccgaacgcgagtcgcacgcggtcgaacgtctgcgggtccttgagcggtttgaacatgccgcggtcgacgtatcgggacatgtcgaagattccggtcgcgccgtcggagcaggtgaccttgagcttgtagccgggcatgggctcgcattgggtcactttgattgaatagtcgatggtcatgtccgttgcctccttgtcagcgtagcgggtcgattctgaacgggtgctcgaggttgaaggccagctcccagtcggcttccagctcttcggcatgcagcagcacccatgcctcgaccagtttgcgctgcttgcgcggtaggtctcccttgagcaggttgccatcgaaggtgaaggacgcttcgtggccttggtatctggcgtggatgtgcggcggaacatggtcgtccgcgttcatggtgatgatgattccgaagaacatgctgatgaccggcatgtccgcctccttgttttcgttgtcttccattctaggatatttttcttttgaccggatggtcaagcgaaagcgctagcggtggtagcgggttccgtcatgagaacgcgtcgaaaccacgggtttcgctgcgcgggcgttgacgggttccgcgtgccgctatgatcaaggcgtcagccggccggtcaaaagaaaatcctcgggatgcgcgcggcatcggtgccgtgctccgtttcccgtcggcgagacgtggcctccgtgccacggcgacgccctgtcgggtccgggaaccgttcccggcgcgtggagtccagaggacggtagtcgtcctctggccgccggaggcgccgcccgcatgacgcgggcggcatcggccccggggcgtcacttggccgggaacggcgatgacgttttagtcttcgacgcttgtccagtagaggccgtcgtcagggatgtcgtcgacctcgtcccacatggttcgcgcctgttcgtcccaccatgccgcgtcggcccaatgcgcgtcggcctcgtcgtatccgacgctgccgttcgccagagtcgcgtaccggtcgaagtcgatgcccgtcgggcatatggcctccatctgttcggcggtcgcatagtggaggctgtccagatggtaggcctcctgtccgggttccaagtcgtgtgcggcgaggttggcccgcgccgtttcggcgagctcgtcgtgtttggcccggaaccattcctcggccctgttcttctccttcatgtccatgtctcctttcattccgcgcgcccgaacggttcgtcggtgaaccaccagttcctgatgacgagcatccacccgttcctttcgagcagcgggtcgaggtcgtcgggcgtgatgatgtcgcccgcgtggttgacccatactgttttctcgatgctgcatggcggccatccaccgtcgcctccgcgcacggcgtagcagtgccatccgtcgggaatgtcgcccgcgtggagccgtacgtcgctccacatcgcgtcgattcgtcccccgtcggtctcgaagacggcgtgctgcaattccatcggttccatctgcatggttccactccttagtgtcccgccggcgttcctgttttcctttcgccggacatggggcagcctcgcggtcccgccgcgcggcggaggacgcgtgggccgtgcccgcttcgggataatcgggcgaagccctcccgaagcggagcatggaacacgcagttccgaagacgcgggcgcggggctgcgatgatgaaccatggccggccgaccgttcccttccaggcgtcgacgcctggaaatcccggaagggtcggcgaagatagcgcgcggcccagggccgcgctccgtttccggcgaagccaggatcacaagcgtgtgatcctggcggagcccgactgtccaaaccggcgcgtgtccaatcgcgtgaccatggttccagccggatcaaaaccgggaaccgatgaaaacaagactggaaaggaaacggaccatggcatccgattacgtggacgacttcctgcgcaacgaacgcgagtcgttcaaacgcaaggagacggcggcgaagaagttcgacaaccgcctcgacaacttccgcaaaagcgcgcaggcgctgcgcgacgcggcgaggcaattcgaggaggcgttccccggcatgagccgaacaatgatcgcggacaagctggcaatgaccggaaccgaaaaaagcgtcgcgttcgacgcgaagggcgaactcgtcgccgcgccggccggaagaaaaaccgtctccgccgaacccaccgtcgcgccggcgcccgacgccgcgacggatccggagacgaccggatccgacgtccaggaggcggacgacgagcccgccccgcaggagcccgcagccgaacccgacacctcggacgacggacggcccgcatgggcgtccggcaactactgatgatcggacgtgatgcaagatgcgactgatcatcgccgagaagcattcggtcggccaggacatcgcccaggcggtcggcgggcacatggaaaagcatgacggctatgtgcaggtcggcgacgacctggtcacctgggcacaaggacacctcgtcgacctggccgcgcccgacgaatacaagaaccacgactggggaaagtggagcctcgacacgctgcccatcgacccgacacccgactggcaatggaaggtcagccgggacaagggcgcagaccgccagtacaaggtcgtcgcaggactgatgcgccgcggcgacgtcgacatgcttgtcgacgcatgcgaccccgaccgtgagggcgaggccatcttccgtcggatcgtgacgcatgtaggagtctccaagccgatgcgacgcctatgggtcgcgagcctggaggaggacgccatccgcgacgccctcgcgtccatgaaggacgagacggaataccgggggctcgccgattcggcgatgatccgcgcgaaggccgactggctcatcggcatgaacgcgtcacgcgcctacagcctcgtctacaacgcgaggttcaccgtcggccgcgtgcagacgcccacgctcgcgatgatcgtggaccgcgaccggcaaatcgccggccacgtggcccgaccgtactggaaggtcgtcgccccgatgggcggatggaagctgtccggcgaacgtttggacaagcgggaggacgccgaaaccctgctgcggatcgtcaactcggacgacttcaccttcgagatcttcaaggccgaccgcaaacagcagcacgacgcgccgccccgcctgtacgacctgaccggattgcagaaggacatgagccggctgcacggcctgaccgccgcccgcaccctgaccgccttgcaatccctgtatgagaaaaaactggcgacgtatccacgcaccgactcgcagtacatcacgcacgacgacctggacacgctgcgcggcctcaccgaaggcgaccgcctcgtcaccggcttcatcgaaccggacgcgaaacctgaacggccgcgactcgaactaaccgtgaacgacgcgaaggtggccggccacaccgccatccttcccaccatgcaggccgacaaggcggcgctcgacgaactcggcgacgacgaacgcctcgtgctcgtccgtgttgctcgccgcatgtgggaggccgtgggcgacgactacgtgcacgacgtgacgaacgtcgtcgcgaacatcgacccgcattggtgcgaaaagcatccggacgaaggccgcctcctgtccgaaggcgaatgccgtttcaccagccgttccgaccagcccgtctccctcggctggcacgccatcgaacatgacgggccacaggaagatcaggacgacaatgacgagactgcgggcaacatcatccccgcgaacctcgtcaccggggtctccatcgcgcccgtcccgcaatgcggcgcgacattgtccgagggaaagacgaaaccgccgaagccgttcagcgaggcgacgctgctcgccgcgatggaacacgccagccgctgggtggaggacaaggacctcaaggccgcattggacgacgacgaatcccactcgggaggcatcggcaccccggccacgcgcgccgacgtgatcgagaagctgatccgcaccggatacgtggaccgcaagggcaagcagctgcgctccacggaccagggccgttccctgatcgacgtggtcgccccgaagctcaaggacgtggcattgaccgccgacatggaacgacgcctctcggaggtcgaacacggacaggcggacgcctcgcaggtcgaaacggagttccgcgacctcgccgcgcgcataccggccgacgcgcagaccaccgtccggcaggaccatgtgcaggcgaagacgcggaacacggaatcgttcggcggctgcccgcgctgcggcaagcccgtcgtcaaaacgggcaaggtgttccaatgctccaccaaccggcgcgagaaacaatccgacggtacatggaggaccacggagggatgcggctggcgcgcctggacgaccgtggccggcaagaccatcaccgacacgaccatgcgcaggctgctcgacggccggaaggtcagcttcaagggcttcacctcgaggaagggcggcacgtttgacgccgcgctcgtcatcgacaaggacaagggcgtcgccttcgacttcggcaataacaacaaggaaaggaaaaagaaatgacggagacacaacagaccatgaccgaattcacctacgcgacgggggagaccgacgtcatcggcgaccggttcagcccgtccgtggtgctcttctggctcaagaccagcgtcgccgcgagcaacatgcgcgtgatgtacaagagtccgaacaccctgctgggcgtgatcccgctcggctcgtccacgcagacgatcccgctgcgcaacatcgcgtccgtggacacgaacacgaagttcaacctcggtagcttcgtctggggcgccgtcttcctcgtcgccggactctcgttcctttcgagcagcgcgcttgtggggatcctgttcctcctgctcgcggccgcgaacctggcgaacacgatgagcgcgcagctcgacttcgtcaaccaggccggcggcaggaacagcgtcaaggtgtccatcctcgaaaaggacaagctcatgcagctcgcgcagaacatccagcggctcgtcttcgccgacgtcgagggacaacgccaccaggaaagcatggacatggcccagaagcagtacacggcccagaccaacagcgtcctgatccagcagcagatgctcgaccagcagcgcaaggccacggccgacgataatccatcgatgccgaccgagtgacgaaaccggggcgcggccacggccgcgccccgggaaacgccgggtccgccctgtagaaaacctcgattatactaaaagtataatcacggttcgcgcaggcggatccggctttcttatatccaggaggggccatggtaaaagaggattggagcgaggccaaggcgtggatgcgcgcgacgcgcgaacgcatcggcatgacccagcacgacgcggccgtgcttgcgaacctcaccgtggacatggtcaagaaatacgagtcggagaaataccggatccaaccatcggggataatgcgggagatgctcgaacactatctcgccgagcacaggcgcgccgtcgtggccatcgtggaacggcacaggggagatgagcgggccgtgctctcgttctcccgcgtctccgacctgcccgaggggctgcccgactgggtccgggccgaggaatccgtgaagcgccgcgccgccgccgtgcgcgaggcagccgtgctgcttgaggcggagggcgtcgccgtcgactacacctatctgcccgaagaaacggaataggagagggaaggaaggccgatcatgttcggactttacatgctcgcgatatacctgggcgtcgccgtcatcgccgccggcttcgtcgcactgctcgtcgtcgtcgcgctggcggtgggactggtcacgcatcccatccgcacgctcgccctcgtgttccacaagctcgccgccctgtccgccggcctggcgttgatcctcgcgttgatcgcctggttctggaccgaccatacaaagccggacttcgtcccgtgcttctggggatccatcggcgtgatcgtcgcgtccatccttatccgcgcgttcgccgagtggattctcgaacggcccaccagggccgaacgccgagccatgaaacgtgccgccgcgcaggaaaccggccgggtgacgatgcgcatgccggtatcggaagaagtggccgcggcgttcgaatcgacccgggacggccggcgcgcctccctatgacatgcaggccgcaggacggaacgaaccgcggctggaataatgaactttgcaaccggaacacgaaaagagggacatgatggccaatcccgagctatcgcagcgcatacaggaactgcccgaggaactgctcggccttgaacacgagccgggaatcgccgaacgtctacgacggatcgacgcgctgaaggaccgtgcccgcgcactggaccccctggacggcgtcgaggacatggcgctggcggattacgaccgcgactggctggtgcgctacacctacaattcaaacgccatagagggatccacgctgaccctggaggacacgtccctggttttggagggcgagttcgtcccgtcagattcgccggcacggtacgtgttcgccgcgcgcggcgtcgcggacggcatggcctacgtacgcgaatacgcccgggaggggaggagactggatgaggaactggtccggcgcgtccatgaggtgacggcgctggacctccagccgttcgcccgcggcacgttccgcccctacggttatctggcgaggatcaccgcgacccgcgtcaagaccgccgacccgctggagatccgcgacgacctgcgggccctgatcgacgggctggacgcgagcggcgctcatccgctgctcagggccgccggcttccatgcgatgttcgagaacatccacccgttcatggacggcaacgggcggaccggccgccagctgctcaatttcatgctgctgaagcacggctatcgtcccgtggcgatcaagtatgacgccaagcgcgactatgcccgcagtctggagacctggcaggtggacggcgatcccgtggcgttctgttctgtgttcctcgactgcgtggaacaggaggaacacgcgttcatcgatctggtcgagggattgcgtcggaagccggacgccattcgcagcaaaacggatctgctggacagattcggcgacgcgctgcggaagaatcttgctcggcaagacggggatggcaagagtgccgggattgatcacaaaggtcctgggcgccatatgggtcattaggccgaaggccctgggccacgaaatgagaatcagggagaaagggagtggcgtgatgttcggaactgaaactatatctgaattcgaatgcgacgccgcgcggagaacttttctgctccgcccgcgcagccatgctgagggacagcctcccgcccatggaggggatgctggggtctggtgtttggtcggctgagaacagcgtttcacgggtcgtgccgatactcgttgtcggtttctaataggtgatactgaggggtatctgatttcaggaggattatggcatctgtgcaccacggtgttgtctatacgaaaaaatgggttgtcaacctgattctcgacgtggccggctatgtgccgggcaccggcatttcggataaggtgatcgtcgaaccatcctgcgggtgcggagctttcctgaccgtgattgccgcacgtctggccgatgatgcaattgccgttggcaaaggttggacgtcgctggggaatgcgatccgcgcctatgacatagactccgcgtcgatcgagacggcaaggaaggccgccgccgagtcattgatgaaaagaggatgccccgcgatccaggctcgggagctttgcgagcagtggatcgtacacggcgatttcattcttgatgacgtccctgccgctgattttattgtcgggaatccgccatacgtccgggccaccgaaatagaccgggggaagcgggcactttacgttaagcgtctctcttcggtaacgacgggatgcgacctgtacgtgagcttcttcgaccgaggcctcgatgcgttgagggatggcggaacgctatgcttcatctgcgccgaccgatggctgcagaacaaatacggcacgttgttgagatctcgcatgggcacggattgtgacctcgtatccctcgtgcgcatgcacggcgtcgacgcgttcgacgacgaggtcgatgcctatcccgcggtcacgacggttcgcaagggcccggcgtccgatcatctgaaattcgtgaactgcgccccggaattcaacgaggccgacgccaccacggtcctcgattggctgatggacgacgagccggagctggttggtgagcgattcgaagcattcgagattgataagccggccggtgataggatgtatccgctcggtaatcatgacctagtgagattcgtctcgcaggcatgtgaaaggttgccgaaactcgaagaggccggcgtgaaactcggtatcggtatcgccactggttgcgatgacgtgttcctcaccgaggacaacgacctagtggagcccgaccgcatgatgccgattttctacatgcgtgaccatcgtcgtgggaacgacgataggcatcgctggcttgtaaacccgtggaacgacgacggaactttggtcaacctcgacgaatatccacgactcaaaacctatttggaaacaaacaaggaacggctatcgagacggtatgttgcgaaaaagaataaagctgcctggtaccgcactatcgacaagctcacacctggactgcttgaccgggaccttctacttataccggatatggcggctcagcccgatccgattctgtcgcatggaaagtatccgcatcacaactgctattggatcacttccgatgagtgggatttggaggttctcggcggcctgcttatggccgatacgacgcgtcgtttcgtcgatgcgcttggtgtcaagatgcgtggagggacgttgcgctttcaggcacagtacctgcgcttggtgcatataccggaatatagccaaataagtgacacgaacaaattggggctttcgcgcgcttttaacgagaaggacagggctttggcaacgaaattcgccgaagcggcttataaggaggccatggaatgagatctgacatcgaggccgcgattctcggcatgtacgattcaatcgaacgcgcccgcgaggcacaggctgcagcagggcattccgatcagggagcacgtcaggggatcacgtctggaaagcacctggatccgattgcagctatcattcgtgacgatctcattaatgcgggtttccatcctgatgaggtctatgaccaaggacgcatgtgcacattaccgggctggttccgtcccaccaagaactgggacttgctggcgcttgacaacggcgaactcgtaagcgctatcgaactgaagagcattaacagttccttcgggaacaacgccaacaaccgcgcggaggaatcaatcggctcggcatttgacgcgcatacggcgttcgatgagaatctgctcggttccagcagtattccaccggtcatgggctatgtgatgatagttcacgattgtccggacagtcggattgtcggacgtggggtgcggtcagcgcattttccgattgaccctgatttcgagggggcgtcgtacctcgatcgttttttgctgctctgtgaccgactccgtcgaaagagcttgtaccaggccgtctggctcgtgtttgcgaatcccgaggacggtgtggcctatgagccttcgccggcactgacgtatgacaagttcatcgcaaacattgttatggcgcttggcgtgcatagggcgtaaaagaatgaaagcagaatcgatttcgttctttcgacttttaccggttccggtagccggtccgtagtctctatccgatcgtgcatgttccatggtgtctaagtgttgcaacattcatggtcggggatacacggtcggccatacgcaggggtgagggtctccgtatacgatgtgagatgctcacccttggcccctacgggtgtcggcggcggtccttatcctatttcgccgctgatctgataccgctggtcggaccaggagaagatggttccttccactgggcatatagtttgatttccccgcatttgtcttttgggaccatcgcgtcaaaatcatccgcgtctcttatgcttacgccatgaccgtcttcttgcgtattccatccttcaaagatgagtcccttcttccgacttgaaggctgatggtacgcgcttttcgccgaaagaccatagcttattattctgtgctcgtttattattttgagcttgcttttctgtccatcatggaagatcacatgatggccgtgcagtgcaaactcatcctcgcggataaaagaaataatacaaatgagagaaactacgattgagaagaaaaccacaaggcttaggataatgacaagcactaatacgcagatattatctatagccgattcgaaataaaccacttcaaataagatggaaatacatagccagaatacaaaattagagccagccaacatgcggcaaagtgtgggagaacagaacgaatcatgataatgatcttccgagtctggacgattggcgaatctccatctatcgattatgtaatcgatggcatatcccacggcaaggctcaaaggaacaaacagggcagcgattgccaccagcattagctccctggctaagagtttggcagtatatttcgtggctgtctcaattgacactgcaatcgttgccgagaacaacatggatatcgacatccaggaaaaaccccatatcgatattgggttatttgcttctttgacggcccggtatgaacggtaagcaacgatatatacaggaatccagattatcggcaggataagaaaagcgaggaggaaacccacgcctagtaagtcttcctttttaatattgcttaaaatgctgcttttctcaggggaaagcaatcccgagaatttgagcaagaagggtattgcccataggataagaaggagcagaagagaaaaaagagtaaaaaagaagctggctcttcttcgagacgttttattctcgattagttcattccgatgtttttgtgttttctcttgtcgccaacggcaccatgcatcgtatctgttcacttttgctgtctctgcgtcgatttcagcttcaagaagcacatcaggatgattctcctttgcctggcgaagagatgacagtcttgaaagacgcttctgctgtcttgaatatgcgttgcctccaatcaaagtcgatatcttgatggcacaatgagcaacaacagtcagaaggagaagagctgccaccaaagtgtagggccagtcgttgctgctttccgtcatagtgctgatggcttcagaaattaaacctaaggtttcttttattccattcattatcttgtccgtaatgtgtctgatcctaaaactacttcatgcacaacactaatactgtcgaccatctcttcggcaaggggcgtactgtgatggattccgagggctgaaactgattccgttatctcgtttggcctttcgctgtttggtgtgggtgagtgggtcgggggggtggtggtgctggtcgggtagtttgggggtatggataccacgtcgttgttcaccgccgccctgcaactgcctgacccgtggagggtgtcgggcgtggagttccgtgacgaggaggacggcagacgggaactgcatatcgcgatcgggttcgcggcgggttcgcggttcccctgcccggaaccggggtgcggcgaggccgcgtgtccggtgcatgacgcgagggagcgcgtgtggcggcatctgaacttcttccagtacaaggcgttcattcacgcgggcgtgccgcgcgtgacgtgccccgcccacggcgtgcacgcggtcccggtgccgtgggcgaggccgggaagcgggttcacgctcctgttcgaggcgatggtcgtggagctggccaaaagccagccggtcgcggacatcgccgagcaggtcggcgaacatgactgtatttcgtcaagtcggtgtttcgtgttggggctggtgccgttttgttggactcgtcgttgattccatcaccaccaatcatgccacaagaccgagctcgcgtcgacgatccatgatgctcatgccgaactccgtcttgatccgcctgtcccggtacgggacaggcggatcaagacggagttcggcatgagcatcatggatcgtcgacgcgagctcggtcttgtggcatgattggtggtgatggaatcaacgacgagtccaacaaaacggcaccagccccaacccgaaaaaaatacatgactaaacacgaaacaccgacttgacgaaatacagctgttcgcaatgcagcttctcgatcaggatcctctcctcggacgacaggtgcgaatactgttgacccatgagtgcaacaccttcttaagttagaaacttcgaacacttccaaccttagacaaggtgttgcacttctatttagaacccggggcgtaaacacgattgccttcaaagaagatggtcgtgactgtgctggaatcaatgttcggtgctatgaagcgaagcgttggttgtgtgtctaagctggccgcattgttgaatgaggctcaacttcggggtgtcgttttatcggctgtgatgttattgtggcgcgacacgccagctttataggcgatgagtggtggcatcagatgagttcgcttgtacgtctccattctttgttgaaatatgttatgcaaagtgtgtaattggcatatgaaactgtcatatttgatgtgttgcgttgcgtttatgtgaacttattttcattgtgcatatcgttatcaatttgttatcaaggacgatcgcgagtgaaatgcgctcatttatataatggctgctgcatggctgcccttgagggacgttcctctggcatggctttgcaatgagccgcgatgtggtcgtaaccaacgtgggattcgattgtgcggcgaagaaaaaatgatgggggggggagtcgccctccatcattcaggaaagggaactgaatggtttataacattcacatattgcaaacaaggaaaaccggtcgtgtggttgctgctgcggctgcatccgtgctgtgttgcatgggggctgtatttccagcgactatcggagtgactgcggcgtcggccgatgaacccgtcgaattggtcgtcaacggcggattcgaagacgatcttaatggttggaagtctggaacggtgtggaatagctccgcatcgtccattgccgtcactgcggatgatgtgcatggtggcagtggcgccttgagcgttactgatcgtacatcctctgatgctggtgcaatccagtctcttgatggcaaggtggaaaaaggacagacatataccggaagtatgtgggtcaaggccacggaagacggtgaattcaatatcactgtttgttcgggtaatggttccggatgtgaccagattgcgaccggaacggcgaaagcgggtgagtggacacaaatttcaggtactggaacgttaggtggtagtggtgatttcaccagtccctcgctggtgattgaaaacaagtatggcacgagcaatgccgacttcattgtcgacgacatttccgtaaccggttcggattctggttcctcattcgtgccgccgactacgggtacggcaacggcagccaaggctttcggcgactattcaaacccgattatcgattattggtatggcgccgatccgtgggctatggaatacaacggacgcgtatatatctacactacgggtgatggcacttctgtgaatgctgatggctcgttgaattatgactatgaatatgacagtactgggcagatcaaggacaattcgttcgctcaagtaaagaccatcaatgttctgtccagtgatgacatggtcaattggcgtaatgagggttacattcgtgtggctggagaacagggggtggccacctgggccagcaattcctgggctcctgccgtcgctcataagaccatcaacggtaaagagaagttcttcctgtatttcgccaatggcggcagcggtatcggtgtgctgacctcggattctcctgttggtccgtggaaggacgaaaccggtgagctgttgattaagggcggtactcctgaatccgctggtgtggtctggctgtttgatcccgcggtgttcgtggatgatgacgggcagggctacctgtattacggaggtggtgttccgacaggcgaggaagaacatccgaacacggctcgcgttattaaactgtccgatgacatgctgcataccgaaggtgaggctcaggccatagacgcacctgccatgtttgaggactccgggattgccaagataggtggtacttattactactcgtattgcactaatttcagccatgacaacgtaattgatggtaacacggtcggttacggcaatatcgcgtatatgacttcagacaacccgatggggccgttcacttatcagggtgagattctgaagaatccgagcacgtatttcggtgttggcggcaacaatcatcacgcgatggttcaacttggcgaccagtggtatatgacctaccatgcgcaaacggtggcaaaggaattgatgaacggcggtaatcttgacgcggcgcatggctaccgaaatactcatctcgatccgattacggttaacgaggatggttccattgccgatattgcaatgacatatgagggtctctcttcggtgaagaatctggacgcgtatcaagatggaggcattccagcttccaccattgcatgggattccggcattcagaacgcatatgacctgacttctggtgtgcgcgtggtcgatatgactacagacaattccgaaggtcagaagctcagcaatattaataatggtgagtggacgtctttggcgaatgtcgatttcgggaataacggcgcctcttcgctgactgtgactgcagctggcaaagccggaggcatccttgagattcgtcttgatgatccggattccgaacctgtggcttctatttcgattcctgccggtgatggatccgagtacgccgattacacgaccacccttgagggtgtgacaggggtgcatcatgtggtgttctccttcaaatccgatggtggtgcgaatgctcaggatgagctgtacgacatcactacgtacactttcacggagtcgcaggatgaaactccttcgactccggtggacaagtctgatttgcagagcgcagtgaatgagaattccggcctgaacgcttccgattacacggaagagagctggaaggtgtttgctgacgcattgcagaaggctcaggcggtattgcaggatgaatccgctactgaacagcaggttcaagatgcgcttgctgcattgaatagtgcacgtgccggtctgaagctggctgatgattccactgatggcaatgcttccgatgccgttgatgacacggatggcgtggatttggcacaaaccggttcctctgtcttgcctggtgctgtgattgtcgcttgcttggctctcactggtgtgatcgtagcgcgagtgcgtcgcgagatgcgctagttacctcttggtaatgcggtcatcccgtagcggcagcctcgggatgaccgcacatgaaacctagaactggtacttgttcaagcgtaagttttggcagtggtaatgtccatcacttatccatatgcgggaatgtcttatcgtcattcattgctgatttgtgcgggcatgctattggaatacgcactcgatgttgagtgcttatcatgaaaggttaaaagacttatgaattatttacgacaaaaaatttcggctagtgctatcgcggtgttgtcgacttgtgggttgattttggcgccaatgccggtctttgcggatgattcaacgccatcttcaacgccatcggatggcagttacaccacgactgatagcggtgatggcacgtattccattcccatgttgaacacggatgttccggatatcagtgttattcgtgtgtcgaaggacgatccgaataacaaagacggtcgtgatgtgtattacatggtgagtaccactatggagctcagtcccggatctccaattatgaaatcctatgatctggtcaattggtggatagtcacgtacgtgtatgatcgcatttctatgagcgatgcttcatccttgcgcaatggagctagctcgtatggcgaaggcgagtgggctccgtcgctgcgctatcacaatggccgcttctacgtgttattcaatacgaacaaccttaatggcgcttatatctactacaccgatgatattgagaatggtccttggacgaagattgcccttaatcggggattccatgatccgtcattgtattttgatgagcaagggagtccttggattatctccggcgtcaaccaatataggctgtccgatgatttaaccacggtggtggagagccatgagaatatcatctctgccgaacagttcactgatgatcttggtgagactcctaccggatttgaaggatctcagactttcaaaatcggtgattatttctatactccaacgatttactggggcaaagacggtcgtacggtgatgctgctgcgcaccactgatttgcttgatggctccaaatacgaagccaaaaagtattgtctaggtgctttcgcacaaggtagccttgttgaagtcgacaacggtgatggcacgacgtcttggcatggattcttcttccgagacacatatccgaccggacgtattcccggtttgattcctgcaacgtggggtgatgacggatggcctgtgtttggggacaataatcaggtaagcgcgtcggacacctacgacaaactgattgatttgcctgctgatttggagaatctggttcgccagcgttccctggtcaattcggacgattttgataatgacgcgcctcatcagtcttatcaggatcaggattggtggactctggaggagcctcctcaggttgacgattctctgattggaatcgagctggtggacaatggcgatttcgaaaacgggactgaatcgtggacccctcagtggaatggtacgcttaccgcgattacggatggttctctttctggaaccacgagtcttgctgtgacgaatcgtggcgaatacaatggcgctggcccgggtcaatctatggatggaaaattgcagcagggcgtgacatatcgtgccagtgcaacgattcgatacgaccatgagatggacggcgtcgattcatcggctgtgacttcccacctgttttatgtggcgattcaatatgcagacggcacaattaatcgtgtggccacaggaacagtgaaacgtggggagacgactactatcacaggtgagttctccatcccatccgacgctaatgtggaaggttccaaactcattgtcgaaaccgcgtggggtgcggaaggcacgtgcatggattacgtcatcgacgatatttccctgatcggtcttgctgatgagaaggaatatccggtcgccgaagaataccaacccaatggttcgaatcttgatttggtatgggaatggggacataatccagataaccgatattggtctctcactgatcgtgaaggctggttgcgtttgaccaatgggcacaaggtttccgccacggccaaatatatgaaaggcacttatggcgacctgacatattttgaaaccgcccgtaacgttttgtcgcagcgtacctttggcggatccatgtctgtggaaacccacatggatgtcagtcatatgaaggatggagacaccgcaggcctcgctacatatacccgtagttttgcctatgccgctgtgcgtcaagaaaatggacagcgaacgttgggtgtggtcaagcgtgtctacgacaatggcgtgaaggacgcggacggtaatatcgttgacgatacgattgatcgtgacgctgaagaggcctttgtatcgggcggcacagtgacattgccagatgatgcgaccaatgtgtggatcaagtcggacaacacactggataatgcgagtggtaagttgacgattcagtattggtacagtctggacggtaagcaatggtccaagcttggcgacgagcaggggccgctgacttacgattggagcttgtcgcactttaaggggtatcgaatcggcttgttcaattacgccaaggagaatacgggtggttatgtcgattttgattactatgacttgagcgacgtgttgacttctgacggcaaagctgtggatacgtctaagctgcgttcggccattgatcaggctgactctctgcagtctgcggaatatcctatggatgagtgggataagatgctcacgctacttgataaggcaaagcaggcgttggcatccgatccttccacgcaaaatgaggtggatgccccgcagcgtgcactgagtttgcagctcgcgcaattggcggttgaccgtcagtctggtgatggcggaaatcctggtggtggtgatcagaccggtgatggtgatcagaccagtgacggtaaccagtcgggtaacggcgatcagaccggtgatggcggccagcaacagtcttctactgctgatgataattcatctgaactgtcatcaactggttcgtccgtaacaccgatggtgctgtctgcaattgccctgatgctggctggcatcagtgtcattcggatacgccgctcttcgcgctgaaatatcgccgcagcctgttggttgcagcgattgaatgtgcggaatcagtgatgtgtcgcaatggtgggttgtgcgaatgctcggcaacgtggattcgtacaacccatcctgttatgttgagaccgcggcgtgagacatggtggagcatgacatcggcgtagaaacgggggagcagggcatcatctttcttgcttccgaagcgcgaatcgggcgagcggggcttgtctgcgggcaataatgacgttgctcccacggattcggataaggagaatcgtagcaaggatcatggtgaggaccagggcgagtaatcgatcgtatcggagacttgcccaacacgcacgctaagatgggcatcgcaataatcggcaatgagcaggtaatcggcgaggcggtgcatggagcaggaatccaacgagcaagaacctaacgaggcgacggaaatcgtaggcggcaaagtagagactgtcgaggtttccaagcaccccgaggcttccatacccgagaccgatttgtctctggcggatatcgagcgccgtcgttcgcatccgttgcgttgggcgctgattattcttgccgtactgtgcgccatcatcgcgccgtactggttcgggcgttcgttggcggtaaataatactgactccattgtggccgtgctcgggggagtgtctccgcaaggcatcgcactggtcggttgggtgaccgtggtgattgcgtacgtcggattggcgatggcggtggtcgtctcgccgtcctggccgtggttgatcgtgttcgtgatcgggttggccggcgaacagttcatcgcgggactcagtatgctcaatctcaatttctggtattccacgtacgtggtctacggtaagcaggccggcctggcgaatgccgcgaatctgggcattatgggtgcggcgatcggcatcgccgtatatgccctgatgttcgtgggtctgctggtgattatccggaagacctcaccactgaacgtactgaccaaaagctgggcaagtttcattctgtacttcgtgattgaaaccatcgctctgctcgtggtgttgtttggcggattgctcaccactgtgtgagcgcacgtgagtcgccgtacgtcgctcagtactcaccgctcactgctcaccgccgcgcaaaccgtgtgcccgatgtctatttagaggtgcaacaccccctgttggtcctgcaattctagcagttcgtcggcgaatgcctcggcgggcgtccggtagtccagcacgcgcatgggacggttgtcggcctcgtcgacaatctcccgcagttccccggccatgtccatccggatctcgctgcgtttgggcagataccggcggatcatgccgttccggttctcgttgcttccccgccgccggctggagtacgggtcggcgaagcacgtgtccatgcccagcccgtcgcgcaggcgcgtgtggcgggcgaacccggtgccgttgtcgtgcgtgacgccgccgcgcgcgccggccggcagcggcgagaacatcgccagctgcgccccgacgctttccccggcggtcttgccgggcacgatcccggccatgaggaacctggtcttcctctcgacctcggtgtgcaggttgcatccggcgccgatcacgccgtcggcctcccaatggccgaaaccgctgcggtctccggcctccggcggacgctcggagatgggaacccgtccgggaatcgggaaacgcgacgtcctcccgccgccacgcctgcgacgcctcccgtggccacgtggaagacgacgcgcccagcgttcacggcgacggcggtcggcgtggatccaacggcagacggtctccgggcacacgcgcatggcggagtcgtcggggaacaggacgcgcagcctgccgctgacgggcagcagcgaccagccgcgacccagccattcggccacccgcgcccacaggcgttcgcatgacaggcggtggcgcctgcgcggttcggcgcgcctgcggccggccttgcgctgcgcggggccggcgatgtagtatctgcccggccacgggcccgtcttcagccgtttcggccggtacggccggtaggactcgttctcgttggacgggaaccacgtgtcgcgtttgatctccctgccgaccgtcgaggcgttgcggccgagcatcagaacgatcccgcagatgatggtgccgttgccgatctcgatctggatgacccggcgttcctcttccgacaggtgcgaacatgcttctcccataggtgcaacatcccttcggactggttatccggacaatctccaatctaacgggtgttgcactttcaattagacaacggggcgggcatgtccgtacgaaaaacgtctatcatgtgcaccatggggaacccaaatgaaattagactggcgatagtcgataacgacgacttcgtgctgatgggtttggcagcgttcttgtcgcgtcatctgccgaatgttcggttagcttggaaggcgaataccggaaccgatgctctggaatatgcgacggatcccgcaaatgaagcggacattctgctggttgacatgagtctggaggacatgcccggagacatggtgtgccgggaaatcagaagtcgtaacaggatgttgccgttgctggcggtgacatcgttcagtttaactcgctatgcgcgacgtgctgctgagggtggtgctcaaggcattgtgtcaaaagctgattttccagcactgtgtaaagcggtcaagttcgtcagcgatggtcatactctctgtgttcgagtaggaggggagactattggattcgaggatgtagatgctgcatatcatcgtctggttcgacttcccgtgaatagaatcgaaagattgtcggaacgggaaaaatatgccatggaactatattcacagtcgtataagcccactcagattgcccggatgatggatgtttcggcagggacggtgaaaacctatcttgaccgtgttcagaacaaactccatcttacttccagagccgaactgattgcctattggtggaggcgggaacgatggtgagacgattggcaatgaaaacgatacttgtggttcgcaagaaatgcttgggagtatcgaaaaaaaatcttgttctatcgatagtggccatgacatgtcttgccgcatgtatcgccgaatggattcttgattctcctgagagtttgaatgatgggtttattcgcatcgtgtacatgcttgctgtgagtatgttgccgttatatccggtaccggcaacatgggggattatcgtcatcgcattcctgaatgaattgatgccttgcttatcgcaatgcgatgagtcatggggtgttctggtatctcttgcgattcaaggctatgctgctgtttggtggaatggtgtgacggcaacggtgctgttgtctattagcgctttgctgaattatgcgatatatcgggagaatagtgaatttggttcgttcgatggttccattaatttggtggtgttgctttggtttgtgtttcttttaggggtttggctacggcaaaggaacggacttgaaaagaaaaaagagttagaaaagaaagctgaaattgttcgatataacttacagcttgctgaggggatgcatgatgccatgtctggtgagttgacacgaatgttggtcatagtgcaggaaggtattgatgcatcgaaggaagaagagcttaagcgatggagaaaattgcagaacggtatcaataggatattccaagatctgcattcggttatgaattatctatcggatgatgaccataaacaagatgatgtatttcatgtaagtcttgccgaacatattcaagctacattgagtgaaagtgaccgtcggttgcatgacaaagggttttgcggtcattcatctcttcgcggtgtatccagcgcaatgttgaactcgtggaatcaaataatcgttaacctgttgcgtgaaatttacacgaatattgaacgctatgctgacaaaagtgaatattccgtcattgtcacattttcaaataatgctgttgatattgttcaggtgaataaatgtcgacaaaagagtcggcgatgcgtgactgtgggagcaagaaaagggctaagtatatattcccgtttgatatctggacaaggaggattcatcagatatgaaaaagacggcgaagaatggtctttctattgcatgttaccgctactgacctaatttctgatatggcataatggaaaccatacagggcatagtgaatatgttgatatttcttcctccgttgaactgttgcttggagtgctggctgacgctccgaatgtcaaaccaagtaccgtaagtattaaaagcggtgttctcatgagggttcctttgcgtcggggtgtgtcaatgatcattgcacaacatggattcatataaaagtccttgtcccctaatggcatacaagtcattgcgaagcgggagaaagcgcgtcatgcttacagtagctcttcgcctgaagggcaggaattaggtaaggaggcctatatgagcatcaatgagaagtccattgtcggtgaatccttcgaggatctgtcggcggccgatatggcgatgctgaccggtcgcaacgatgatggcgtcgcgccggcgtcgctgtcgttcgcggtttccgttctgagcgtgtctttctcggcatgttcggcaacggtcgtcacccgacttgcatcctgtgggaactgcaagtgaacgttgctttacatgggtcaggtatggattgcgtaaaacatccgacccatacctgacacttgttatcgttaaggggaagtggcatgaaggcgattctgtttcgtgactgcaaggcatgtttccagtcattcaagaactggggtatggttcttatcattatggtcacggcaatattcgtggagatggttgccagtggcgcaggcattctagacccatttacttgggctgtcttttttggaccgtttttcatctattcgtcatgctcggtgatggtctccatcctgtatcaggatttccgagatggactgtttgagctctatatacagtctggtcgttcctattggagctactgctggtgtaaatgcctgtttcctgttatcctgacagtgatttccgtgcttttgaatctggcttttatgcgtgttttgtcatcaggctttcagataaccgctggagcagatgatgcaattggtgctcttatcgtatcagtcttaggaacaatcgtctgttctttgggcgcaatgccgatggtttatgtctcccggaacagcgatccgacaatggcacaactggttttggtgttgattgcggtcctgctccaattggcatatatgcttgtgatcgtcaacgtgatgccgctgtgcctgttctcggttggttatgtcgtattggtagtggtcgccatcggtatttcaaccggagtattctctcgatattttatcaacaccaatatcgagctgtgacatctactggattcgaagcttttggaaaggtggatttccatgaccagcatggtggcctatgtcgcttcgcgtaatccgcagtcgcagacgttgcggtcggttcgtctgatacaggatgcggtcagtgcgaacattgacgcggaatggacgattctgacgccgaatgacacgacgatcttgccgtcggatggtactgcgagcgagttttccaccggtgtcgatcatatcgagctgaacggactggacgattccgcccgggtcaaaaaagcaatcgaacgatgcgattatctgattctcggttcgccgacctatggccataacgtttccggcgacatgaagattctgatggatcgactcacctattgggggcatttgttccatctggcgggcaaaccgggcatggcaatggtcagcgccacaaccaacgggttccttgaagtcggcgaactgatggaacggttcatggaatcactgggcatcatcattgatgaaaccgcataccacaccacttttacgccattcgatgaggcaatggccgatcagaccgccgcggctatcgtgcgggcgctgaacacactgcgggatggcgtcgtgcctgaaaccagcgaaaggcaggagctggcattccaatcctacaagcgtgactacgcccgacgagacggtagcgatgcagaatcgcggtattggcgggaacgcggcatgttcgactgcgcgacgttccatgaatacgtcgaaacgcggcggaagctgccggaatccgtccacgccgaacggtagggggactttccatgaacggtaacgttggaacgacctgggcggcttctgccacgacccttgaggaacggtgcatggcggcaaccgctatgccggatgctttgcgacagtatcgggcatcgcacgcggaagacatactttcggcaacggtggaatggaaaaaccgacggaacccactgcgggacgaggactatcaaggcatcgccgacgcgctcggcgatgacgcatccgtggtcgaaaccgtcatcgcggatcgggaacggaaactgagcggccatgtcgagccggcatggtccgttgaactgcagacgattctgaaccgttacgacagcgaggaagagcgagtcgaacgcacggggtatgccaccgccttcgcaccgttcgtcgcgtacgtgaaagcggaactgcaagcgtatatgtcggcttgttcattgccgatgaatgacgagcgccttatcgaacagtgcctgagcgcatacgtcgagcgtctgttgggcatcggattgaaaaccgtcgtatgggaattgcatgtcgcgcgtcaggccggttcgttgggcgacggcgatgcgaagcgacaattgcggcgatatttcgaactgctggccaccgacgaataccgtggccatatgtatgcgaaatatccggtactgcttcgttttgtcacgcagacgacagtccattacatcgatttcgtcaaggaaatgctcgaccgcgtatccatggatcgcgacgagctcgcctccttcgcaggcgtcggcgatgatttcagattggaagatatgtccatcgaccgtggcgacgcgcacgacggtggaagagccgtggccatgctcaccatcggcggacggaaaatcgtatacaagccgcgtgacctgcatatccatgagcttttcgccggattggtgaggcgatgcgaacggacgaagggtttccttccgatgcgagtgtcggacgtgctgacgaaatccggctacgcctatgaggaattcgtggaacacggcacctgcgaggatgcacgtcaggtggagcgctattacaccagatacggtcagctgctcggattggtatggctcctgcacggcgacgacatgcaccacgagaacatcatcgccagcggggaatatccgatggtcgtcgatttcgagacgatcgccacgaaccatgtgaccatggacatgcccgacggcaccgatgccgacatccgcgtatccacgatattgcgggattcgctggcatcctcctgtctgttgccggcgaaaacggcgatgtcggccgacggtacatccgtcgacatcagcgccttcgaaaccggtgagcagacgatgcccggcatcgtcgcgtccccggtgggattggactccgccgatgcccattacgagaggaacgccgtgacgttcagcaaggacggctgcgcggtgacattggatgacgccgttgtggatccgtatcattacaagcgacagattctccaaggattccgcaatacggtcgccgcggcgatgaccatcgacgcggatgaatgggatgcgatgctgtccggcgaggatacgaccgtgcgtgtgctggtgcgcaacaccagcgcctacgcccgatttgcggatttcatccatcatccgtcggcgttgaaggacatgctggacgtcgaagccatactggagaacctgtatgtctacccattccgtgacaagcgcatcttcgcaagcgaataccggcagatgctcgccggggacatccccatgttcaccgcacagctgacgggacatgatctgcacgctcccgatggaacgaccattgacggcgtctgcgaacgttcggtacgcgaacgggtgcttgacaccatcgggcatcttgacgaacaggccgcattgcaatcgcgcattatccgcaacgccttgcgcatggaacccggcatggaggacgcgcatccgacggcttcggtgtcgtcggacacggatgcggagcattacccaatcgaactcggcacgaggatagccgacacggccatcctccaggaaaccgatggcaccgtatcatggcttacagcgaaccgatccgacaccatggccgcggacaagaccgtggatgaacggtacgaaccgggggcgccgacttcgggactctacgacggcatggccgggacgggcatgttcgccgccgaactgtatcggcggacacacgatgagcgctggcgtgacctgtgcacgcgtatgatgcggagtctgatgcgccgcaaggacagaggcattacgtattccggcttcacttccggcctgtcgcgaagctattgcgcgttacgcatggccaatgccggcatcacgtcgcccgaagctcgccgttgcatgacgcagacggttcgtatgctgccggcatacatcgacgatatgctgccgaagctcctgcagcgcgacaatcctcaaccgtcattccatctggattacctgaccggggcgggcagttcgatcatgctgtatctgcggctgtacgacgtattccatgacatgcgcatagtggaacaaaccagccggctggggagaaccgtcatccgtgcgtttcccgaaacccagcggaacgccgacgaatccgatgacatgccgtatccaaccggtgccgcgcacggactggaaggcatggccgtggcgttctggaagctctacgcggcgacggggaatcgcgaattcgccgaattcgcccgaatgctttggcggaaatcggacgctcgaagaagcggtgcgaaacaggaggacgccggcaaatggtgccgtgggaaggtcggcgtgctctgggcacgcaatgagctggcggccactgccggcgcggacggcgaacgtttcttcgaggatgaaaacggacgggcgttcccagacaaggcagatatcacggcgttgcttgggaacgcggattgggacgacgacggcgtgtgccatggacgatgcggcatgatcgacaccctgatatccatcggcaatgccaacggtgacgaatggtatcgcatgcaggcacagcgtctgatggacgacatgatcgcgcaggcccgttcgtcgggacgtttccggctgaggcaatcccgtgaattcgtggatctgtcgtacttccaagggccggtcggcgtcgcctacacgatgcttcgtctgaacgacccgtccacgccctccatactcgcactggaaacgcgatgacggacatgacggatacgaacacaaccgaatcgacgacaaggaaagacaatatgaccgccgaccacatcaaccacgccgaccgcaccgacaacggcgaacatgccatcatcgccgtcgaacacgtcaccttcggctacaagaagaaacagaccgtgttggaggacatcgacttcaccgtgccgcaaggccagtcgctggcgatcctcggatacaacggcgtcggcaagaccacgctgttcagactcatcgtcggactgctgcgcccccgtgaagggcgatgcgtgatcgataggcgtcgggtgccgtcgatgcgcgacgtgttccagatgaccgagaacggcaatctcgtcggcacgatgaccgtgcgtgacaacatccacttccggcaactgctgttccggtccggcaagggaatcgcggacggcggccataccgtcgactcgaaacggctggaggatgagccgctcgtccgtgccttcgaattggaggggcatctcgacaagaaggtggcggaactctcgaccggtctgcgcaaacgggtcggcatcgtcgccggcatgctgttcgacccgcatgtcatcatgctcgacgagccaagcaacgccattgatccgatcacccgctcgctgctcgtcgattacgtcaaccagcttcgcgccgacgagcgcactttgctcaccgtcacccatgacctcgaatactgttggaatgtggccgaccggatcatcatccttgacgacaaacacctcgtcaaggatatgatgctcgccgaattcgacgactatgaggcgttcaccaaggcgtccacgctcgggcgtgaccgcacgcacgtcgacttcggccttcccgcgcgcggacggcaagcatgagatcatggcgtcgccaccgtgtcccgtttatcgaacaaggcgagcacagcgaatgcgggctggccgccgcagcgatgatcctcgccgcattcgggcatcccgtgaccatggacgagctgcgccgccggtacggcgctccacgcggcggactgagcctcgcgaacatcgtaacggtgctgtccgactccggcatccgcgtacgcgcggtcacgacccccagcgccgaagcgttgaaaaccgtcatgacgccatgcatcctgcattgggacgacaaccatttcgtcgtgctcgaccattacgcatacggccgattccgcatcgctgacccggcgaacgggcgccatgcctatacgcccggcgaactcgcggcccactgttctggcgcggtgctgattccgcaaccgacaaacgacggctgcgcaaccattcccatacggcctcgcagcggaaccgtctccatcctgaccgggttcctccgccggaacatgcccgccatcggtctgagcctgctgttctcgctcgtcgtccagggactgacattgatcgtgcccgcaggcaccggctatatggtcgaccatgggtcgctcgccgcccaaagcggtttcacgccgttggtcgcgacgatgctgcttgcctcgctgctggtctactatgcggtcggcgcgttgaacaccgtgatgctcacccgcgtgcaggtgcgattcggacgatacctgtcccgccgatacatgaccggcgtgctcgatcgggagttcccgttcttcgtgaaccgttccggtggtgacctgatctaccgcgcgaacctggtcatggtcgtcgaacagatcgtgaccggcagtctgccgtcgacggtcgtgtcgatggtgttcctcgtggtctacctgatcatgatgatcgcctattcagtgccattgacgatgctgaccctgacggtgtgcgcggcggtgctcgtcgtatccgtcatttattccctgcgcaacaggacgctggtcgagcgtgcgaccgtcgcgcaggctgacgtgcaacgcgccttcatcgaaaccttctccggcatcgaaactgtcaaaagcctcaatttggaaagccactgctacgaccgctggtcagcgcgtctgggagcgcagctcgactaccagactcggcaagggcggctttcggcattgctgtcaagcctgtcctcggcgctggtgttcgtgttgccgctatgcgtggtcgccttcggcatgaccttcgtgggacgcggcacgctcgcactgggtgccgtcgtcggattcatgtcattggcgtccgcattcgtcacgccattctccggcatcgtcggcgtcatcagccagatcatggcgttcgccacctatatgcgcaagatttgcgagatgattcccgccggtgaaggcggcggtgcgtcgcttgaatgcgacgaaccgggtggcgaaccgggtgacgtcggactgggtgacggcggacggtccgcatgtggtgggccgagtggtgacgaatcgggtgatggcatactcgaacggttgcatgccaccggcgtgggatactcgtacacggcgttcgacgctcccgttctctccgatgtcgattgcgacatccgcaaaggcgacaagatcgccatcgtcggccccactggctcgggcaaaagcacgctgctgaaactgctcgccggactcatcgaacccgtctgtggcacggtgaccatcaacggcggcggatgccggatttacgacgcggacagccgatggaaggccggcaggctggcgtatgtgcatcaggaatccacggtgttcaacgaaaccttgcgcgacaatatcacgctgcaccgtccgtggctgacggatgacgacatcgtcagggcgtgcgaggttgccggcatcaacgaggggatgatggatccggtcgtcggcttggacgccatggtcagtgaacgcggcatgaacctgtccggcggccaacggcagaaggtcgccatcgcgcgtgcggtcgtcggaagaccggacttcctacttatggacgaacccaccagtgctctggacaacgataccgagcgacatgtcatgacggcgttgctcgactccgacaatgcgtgcatcgtcgtggcgcacagactcgcatcgattcgggatttcgaccgcatccatgtcatggatcatgggcagatcgtcgaatccggtacgcatgacgaactgctgcaggccggcggattgtattcgcggctgtaccggcaggagtgagtgtccccttacacccttacgcctttaaacctttaccctttacaccttatcccttacaccctcggctcatgaggccccagtccggcccttgccgtatagttttcatttggcgtaatttcgcccgcggatagagagcgtttcgagcgaacctgcacgaaacaccgcgcaacgacacaataaggaggacgccgtggcactgacggctgacgagaagacccagattatcaacgagtacgcgacgcacgaaggcgacaccggttcccccgaggttcaggtggctctgctgtccaagcgtatcgccgacctgaccgagcacctcaaggagcacaagcacgaccaccactcccgtcgtggtatgcagctgatgatcggtgaccgtcgtcgcctgcttgactacctcaagcgcgttgacatcaaccgttaccgttccctcatcgagcgtctgggtctgcgccgataattgaagacttccgcccgagtacctaggatggtgctcgggcgttttacatatcgccagccaacggcaacaacggcaagagggttagaggataggccagcaggtaaggccgacaagagaacccgaatgaaggggttgacacgaggaacgacggccaaggggccagtcgaaacaaggtatgtgacgtccgctgaagaggacagttgcggttcaagcgagtcgccgaaccgcagcacagtatgtaggaataattagaaaattaaagaaggaggaaccctatggagggtcccgaaatcaaggccgttgaggccgtaatcgacaatggatcgtttggcaagcgcacgctgcgcttcgagaccggccgcctcgcccagcaggccgatggcgctgtggccgcctacctcgacgacgattccatgattctgtccaccaccaccgccggttccagcccgaaggagaactacgacttcttcccgctgaccgtcgatgtcgaagagaagatgtacgctgccggcaagattccgggctcgttcttccgccgtgaaggccgcccgagctccgaggccatcctcgcctgccgcatcatcgaccgcccgctgcgcccgctgttcccgcacaccctgcgcaacgaagtgcaggtcgtcgagaccgtgctcgccgtgaaccctgatgacgcttacgatgtcatcgccctgaacgccgcctccgcctccaccatgatctccggcctgccgttcgaaggcccggtctccggtgtgcgtctggcgctgatcgacggccagtgggtcgccttcccgcgttggagcgagcgtgagcgcgccgtgttcgagattgtggtcgctggccgcgtgatcgagaacggtgatgttgccatcgccatgatcgaggccggtgccggcaagaacgcctggcacctcatctatgacgagggtcagaccaagcccgatgaggaggtcgtggccggtggtcttgaagccgccaagccgttcatcaaggtgatctgcgaggctcagaacgagctcaagaagatcgccgccaaggagaccaaggaattccagctcttcccggagtacaccgacgaactgtacgcccgcatcgacgagatcgcccacaaggatctggacgaggcgctctccatcgccgagaagctgccgcgccaggaccgcatccacgagatcaaggagcacgtgcgcgaggtgctcgcggacgagttcaccgacatggacgacgccgagaaggacaaggaactgggcaacgccttcaaggaactgcagcgccagatcgtgcgtcgccgcatcctgaccgaggactaccgcatcgacggccgtggcctgcgcgacatccgcaccctgtccgccgaggtggacattgtgcctcgcgtgcacggttccgccctgttccagcgtggcgagacccagattctgggcgtcaccaccctgaacatgctcaagatggagcagcagatcgacgcgctgtccggtccgcagtccaagcgttacatgcacaactacgagatgccgccgtactccactggtgagaccggccgcgtcggttccccgaagcgccgcgaaatcggccacggcgccctcgccgagaaggctctcgtgccggtgctgccgagccgcgaagagttcccctacgccatccgacaggtctccgaggccatcggttccaacggttccacttcgatgggttccgtgtgcgcctccacgctgagccttttggctgccggcgtgccgctgaaggctccggttgccggcatcgccatgggcctcgtgtccggcgacgttgatggcaagcacatcttcaagaccctcaccgatatcctgggtgccgaggatgccttcggcgacatggacttcaaggtggccggtacttccgagttcatcaccgccctgcagctcgacaccaagctcgacggcatccccgccgacatcctggccgccgctctgcagcaggccaaggaagcccgcgccacgattctcgaggtcatcaacgagtgcatcgacggcccggccgagatgagcgagttcgctccgcgcatcatcaccacctccgtcccggttgagaagatcggcgaagtcatcggcccgaagggcaagatgatcaaccagattcaggaagacaccggcgctgaaattgccatcgaggatgacggtaccgtcttcatctcctccgagggtggcgaggctgctgagaaggccaaggccatcatcgaccagattgccaacccgcacgtgcccgaggccggcgaaacctacaacggcaaggtcgtcaagaccacgtcgttcggcgctttcgtgaacctcacccccggcaccgacggcctgctgcacatctcccagatccgcaacctggccaacggcgagcgtattgacgctgtcgaagacgtgctcaaggaaggcgacaccgttgaggtgatcgttcagggtgtcgatgatcgcggcaagatctccctggccattcctggtttcgaggatcaggagaacaacgcccgcccgagccgtggcgatcgcgatgaccgccgtggcggccgtggccgtggtgaccgtgacgatcgccgtggcggccgtggccgtcgctccgagcgcgatgaccgtgacttcgacgatcgtgacgaccgtccgcgtcgccgtcgctccgatgacttcgaggatgattacgacgaccgtccgcgtcgccgtcgctccgatgaccgtgacttcgatcgcgatgatcgcgatgatgatcgtccgcgtcgccgtcgttctgccgaccgtgacttcgacgatcgcgatgaccgtgatgctcgcgactcccgtgacgatgatcgtccgcgtcgccgtcgctcttccgatcgcgatgaccgtggcgatcgtgatgaccgccgtggcggttcccgtggccgtggccgtggctcggaccgtaacccgcgctacgccaccgacgacaactacgacgactaccgcgccgaccgcgaagagcgtactgagcgcccgcgtcgccgcgtccgtcgcgactttgatccgttcgaggactaaatccctctcacggatcggtcgcggcatagccgctcccctcacctacgggaagcccgtagggcttcccgcttaacggttcggcattcgaggactgatcgttctctagcttctctcgggtgagaagggcttgatcgcaaaccaaaaggcttctataccgtttcattcggtatagaagcctttttggtttttcggcttcttcgcgctgcatatttcgatgttgaataaggcactcgtgctgccgccatgtacgtttagttgtcggttgacaactattcccatgcatcaagaatggcggatgatcatcgaaggtactcatgggcgttgatcactgtggcaacaacaaaggccgggcccttgtgagagcccggcctttatgccgtatggcggcggattaatccttaaaggctaatccgttgtcaatcagcgttacagaatcgccatgcacacgaagtccagaatgaacagcgcggccacagtccagatgatcgggtgaacctccttggccttgcccttgcaggtcttcacgatgcagtacatgatgaagcctccggcgatgccgtaggagatggagtaggagaaggccatgaacacggcggcgaagaacgccggaatggcttcggcgatgtcgtcccacttgacttccttcagggaagcggccatcatgcagccgacgatcaccagcacgccggcggttgcggcggacggcacggcggagacgaccggggccaggaacgcggacaaggcgaagcagatcgccacaaccacggaggtcaggccggttcggccgcctgcggcgatgccggcggaagactcgacgtaggtggtggtgttcgaggtgccgcagatggcgccgatggaggtggcgatggagtcggcgaacagggccttgtccatcttggaggagaagccgtggccgttctccagagccttctcatcctcggcggagaagatgccggtgcggcggccggtgccgatgaaagtgcccagggtgtcgaacgtatcggacatggagaaggcgaagatggtcacgatgaccagcggcagcttggtcggatcagagaacagtgccgggaagccctcggcggagaagatcgcgccgaaggtctgcggcagctgggagaaggtctcgctgatggactgcgagttggaccaggtggtcacgccgaacgggatgccgattacggtggtgatggcgatggccagcagcatgccgcccttaaccttcatcacggtgaacacaatggccagtacgaggccgatcaggaagacccacagcaccttgtcgttgaagttggccagacccggggtagccgcaacggcaccgcccttggcggcggccttcggatcgccgggagtgaacttgatcaggccgacgttcagcatgcccacgtaggccacgaacaggccgatgccgccgccgatggcgtgttgcagggactccgggatggccaggatgatcatcttgcggatcttggtgacggtgatgaggatgttgatcaggccgcacaggaacaccatgcacatggtctgctgccagctgaagccgaggccgaagcacacggtgtaggtgaagaacgcgttgaggcccatgccggcggcctgggcgtacggcacgttggcgaacaggcccatgaccagggtgccgatgatggccgcgatgatggtggccaggaacacgccgccccacggcatacccgtctgcgacaggatctgcgggttgacgacgatgatgtaagccatcgcgaagaacgtggtcaggccggccagaatctcagtcgagacggtcgtgccgttttccttcaaatggaagaacttctccatttactctctacttccttgggtttatgcggggctgcgcaccgcgtgcataatgctgcggctggccccggcgagaattgcgactcgccctgatcggcctgcccaacgcgcgtcaggcgctgcgcacccaatcagaaccgtggccgattatagcttgtggaggcaacgtgaacgggtccgggagtagactgactgccagaataattcggaacaactcaggggacacgcaggacacacccgtggaaggaaggcgcgcgatgaaaccggccgtcgaagtcagcatcacctcttggaagaagaatgtcgtcaagcccggtcaggagtacggccgcgtactgctgatgcccggcaccggctacaactgcgaccgtccgctgctctactggtcggcccaggctctggtcgaggccggctggcgaatcgaccgcatgaacgtacgcaacgcttccgacgacctgtccacggtgattccggtcctcaatcaggcgattgacggctgggtggccgccgcgcgcgagtccggcgcgggtaaagccggtgattccggggatggcgttgccgccgatgattctgctaccgtgctggccgatggcgcagctggctcgccgaaccgtgattccgacaccccgtccggccctcgcctgttgctgatcggcaagtcgctgacgacgatgacctacccacatgtggcctcacactacggtctgccgttcgtgctgctgaccccggtgctgcatcacgccgacttcgatccatccgcccgggtgattccggtgccggctgtcggcgatgatatcgtcgccgaatccgaggccccgagcgtggccgaagcaagggcgatcatccgcgcggaacaggccggccagtcgcacgccgccagctcccgatactccggcccggcaccgctgatctgcgccggcaccgccgacccgttctacgatcaagcccgcgccaacgcgctcaccccgcacgtgcacgaatacccggatgccaaccattcgatcgaggtgcccggccactggcgtcgctcgctcgactatctgaaggaagtcaccgcgtccgtagcccagtacgccgccacgctgtaatgccccgcgacacgcccgaattctgcaatgtcgctgaccatccgtaatctgatcatccgtaaaccacagaccgttggttgaagtgcgcgcgagtgcatttccgaagtttggttcgccaagccagcgcaggttgagagatataagcccgtcaagggccggcgaaggtcgcttcgcgagattatattgctctgcctgtgcgcagggcttttttgttgcccggccgaaagttccgaactccaagtcaacggccgacttaggaaggaacgccatgaagaggcccgaaaaggaagcggtagtcgctcagcttacggaagaattccgtaacgctgacgccgtctacctgaccgagtaccgcgggcttaccgttccgcagatttccgatctgcgtgaaaagctaggccgcgatacttcctacaccgtggcaaagaacacgctggcacgcatcgccgccaaggaagcgggcattgagggtctcgacgagattctctccggcccgaccgccatcaccttcgtgaagggcgacttcatcgaggctgcgaaggtcatccgtgacttcgccaaggacaacaaggctcttgtcatcaagggtgccgccgctgacggcactgtctacgatgccgagggcgccaagaagctggcagacctcaagtcccgcccgcagctgcttgccgaattcgccggcgacatcaaggcatcgatggccaaggccgcgtacctgttcaacgctctgcctaccaaggctgtgcgcacgatcgacgccctgcgcgaaaagcaggagaaggctgcctgatttacgccctcacggcatgaatcagtcgcttcgataatttaaacaataaggtttattaggcagcggatctaccacttcgtccgccgccaagattgaaaggaagccataatggctaagtacaccaacgatgagctgctggaagccttcggcgagatgaccctggtcgagctctccgagttcgtgaaggccttcgaggagaagttcgacgtcgaggctgccgctccggttgccgctgttgccgctgttgctggcgctgctgctccggctgaggaagagaaggatgagttcgacgtcatcctctccgccgtcggcgacaagaagatccaggtcatcaaggctgtccgcgccatcaccaacctcggcctggccgaggccaaggctcttgtcgacggcgctccgaaggccgtcctcgagaaggccaagaaggaagatgccgagaaggccaaggctcagctggaagaggctggcgccagcgtcgagctcaagtgatttgtgcggcataagccgcaatcacagcttttcgaggaaccccgcacctgtgtttcaggctgcggggtttccgcatactgagtagactagttgacgaggacgaggcggagaacgcgatccggcgtggaaacacaaagctggcaatgagcgaaagttgtcaattctgtgcccagtaatccgccaaaagccggtaaaagatgacacaatggcacgtagtgtggtcaaatagtgtgtccaggaaggcggtcacggtgagcgagtggacggtgaagatcaacggtgtcgaccggatcagcgtcaagccgggggagtgcgtggaaatcggccgtaagccgttacgcccccttgccgatgatggcaacacccgccttgacgtcgccgatcagaccaaatcgatgtccaaacggcacgccatgttcacggtaaaaagcaatggcacggcctcggtccgtgatcttggatcgaccaatggatcgtatgtggtgcgggaaaatggcgatttgttgcgcttgccggccaatgccgagttcctgttgccgacgtctcccatgcgcatgcagttcggcgatgtgcctgcggacttcattcgtgtcgacgatccagtggcaaagccgctcgacctcaaggtgcctgatttgtttggctatgcggttcacgaagcaccgcaggagccggatgcggcggatatgtccgtcgacgatattcttgatttgcgggccggcgagccgaccgccatcttcagcgcggataatgttcgacgcaaggtcgacgagcttgaacttggctcgctgaatatcacgcagccagtgacgaaaaacgatgagccggccataccccgtgatctgttcgcggatgcgttggcccagcatgccgagcaggagaccgaacgcaaaaaccagcaggccatgaactccgtggcactgccgaagcagcagaccgaacctgagtcgacgattgtaacgcctgcatccaagcacagcaggatctccggtattgttccagtagatgccatcgcccatgccgttgttaagcacgctcccagcacaagcgagccggcagtggcgtcggcggcggttgttgaatccgatgcagcggctggcgcaagcaagtcagccgaaaacgttcagtccgctccgaataccaggaatgccggcgattctcagccggcggacactgtcgaacagcatgctgaagttgcccagcctgaagccgcccgggaagccgaagccgctcaatctgaaaacacccagcctgagaccgctcagccggcaaccgcccagtctgaaaccgaccagccggcagctgacgtaccggacgatcagcagcggaccgcagccgaagcatatcaagaagccaccgcagcaggcgtagcagaccagcagccggctgccgaaaccgcccagcagtcggtatccgaagcatatgatatcgactccacgggcgtacacactccggtcttcgagcccggctcggtgttcgagcgtgtggccaagggcgagctgaaagcacaggagccggcagtcgaagtcgatggcctgacctctgacgaggcaaaaaccacgcaagatttcaatgttcaattcgaagtcgcccgtcatcccgaattgctggcgttcctcgccatgaatccgtacctgtacgacgacatgtattcttggctcgccgcccgtggcgaggccgatattgacgaagccctgtctcacaacaagggctatcaggaataccgcgaagcggttggaaagtgagtcgagagatgacccagagccagactcagaaccagaatctcacggaaggtctgaatcgcatccgtcgctggcgtgaccaataccgcagcatgcagccgccatcgccgctcgaggatgtgaatcaactggccgcgaagctggagatgacccatgcccatccctccggcatcgcccagctgttcgcttccggccatgtccggttggattcgttgttccgcgacacgggtgtgcttaaggccgccgaacgccatattgggcgcgtgctggatgaccaggccgccaaacgcaggatttccggcgtggcggagttgtcgctcgtggtcggcgtggccacatggaagggcaacgcgctgccggtgctgttgtacccggtgagcgtcacgatcgaggatgatggcttgtcgaccaccattcgattcaccggtcgcgtggccctgaacgtcgcgttcgtcaatacattgcgtgagcagggggtgttcctggatgaggattccctgtttgacggtgccagctatgacagtggcactcccgaaacttccgcgatgttcgcccgtatttcgtccgaagcgtcggagcgtatctccgacttcgccatcgagcgccagattgtgctcggatgcttcatggacccctcgtcgcagatgatcagcgaaagccgacagttcatcgaccagctggagaacggccccaccggcaatgtgctgttggacgcgcttgccggcgacgaatccgcccgcaccgcgctcaaagatgccaatattccgcaatacagtcctttcgacgtagacccgcatgctgagtacgaagtcggcgatgtggacaatacggtgcgatatgccgcgtcacttgccgccaatggccatagcatcgtggtcgacggcgccttcccgaagggcaccgcggagcaggctgtggccatcgcatcgcgctgcctgatgaatggtcgttccgtgctgtacgtgcccggcgtggccgagcagaagcgtctgttcatccagacggcctccgccaatgagatgaaggcgcaggtactggatgtatccgatgaacacgccaacgccgcgcttgataagcagctgattgccgcagtcggattccaaccgggagtcgccacccagcgattcgaccagttggccgacgaactcgtgggcgtgcgttcgcgcttgacccgctacttgggcgacctgcacgggggcaatgataagtggaatgtgtccgcatacgagaccattcagaatctggcccgtatctccgtgctcccgacgcaccctgccacccacgttcgacttgacgagtcaagtgccctgagcatcgccaacgatattgacacatggatcggcaagatggaacgcgccggcgagctcggcgaatacaccatcggcccggaagacaccgcatggtacaaggcgtccatcaccactgaagaacaggcagtaaccgcctaccagcgcgtggacgatttgctgcgtcgcttcctgcccgccacccgtgagcaggtggcacgcaccgtgcagacctgcggattcccggttcctcccaccacccgcgagtgggagcgtcaggttacggttttgaagaatctgcgacgagtgcttgacgtgttccagccggagattttcgagcgagacatcagctccatgatcgaggccaccaagccgaagagccagcgcaaggccgagggcacgtcgatgggattctgggagcgccgccgccacatcaaggaagccaaggatctgctgcgcgtcggcgcgcaggtcgaggacttgcacgaagcgttgaaggtagtcgccaagcaaggggagcagtggcatcagttcgtgcctcacggcggttggccggtgctgcccagcaagctcgacgagatcatctccacccaagaggcgctggtcagcaatatgaccgcgctggataccgtgctttccaccacacccgctggtggcaatctggaaaccgccgatttcgagaaggtggaagcacgcctgaaagcactgctggatgatcgcaaggcactggacaccttgccggagcgttgcctgctggagcaggaattcgcctctgccggactgaacgaactggtcgccgatctcaacgctcgccgagtgagcgtggagcaggtgcgcggcgaagtgcagctggcctggtggaccaccgtgtttgaggacattgtgcgttcgtccgccatcatctccaaccaggatggtgccgcgctgcaggccgcatccgaccgctttgcgcaggtcgatgtggagcacgtgcgctccatcggaccgatggtgtcgcaggaatccatgcgccgcctgtgcgacatgctgttctcccgcactcaggaagccaaccagatgcacaccgtgctggcagggcgcgccagtgtgtcgctgagcaggattcgccgtgatcatccggagattctggccgcggccaagccgattctggtggccgcgccgggtacgctcgccgcactcaccgagccgggtgtgctggctgatgtggcgattctcgatgcgtgcgcgcacattcccgctatcgagttgctgtccatcatcggccgcgtgcagcaggtggtggtgatcgcccactgcgcgacggtaaccagcgaaagcgtcaagcagctgatcgacacgttgcctcatatcgaggtggatgctgccccgtctcgccgtgcgccgcgcctgtccgcattccttgaatccgagggatatggtcctgttcgctatgatgtggccaccgagccggctgccggtgaggtgcgattccaccgtgtggaagcgagcggtgtgccggttatgtcttctggtctggtggaatccagccagccggagattgatgaagtggtgcgtctgattacgcaacgtgccgccggttttgccgtggttccttccagctatcgacttgtggtcgtgatgttgaccgacgcattccgcacacgcttgggtgccgaattgaagtcgttggcaggcaaatccaaggcgatgggccgattcctgcgccatgtgcggttggtttccttgcgtgacgtggccggaggtcgtgccactgacgtgattctgtcgatgtgctatgcgaaaaccacgcacggacgtctgcttcagcagttcggtccgctcgaaagcacaggcggtcgcggactgttgctggatgccctggcattggcggaccacagcttggatattgtgtcggcctttggttccgaagatttggatgaagaacgactgcaccaatccggtcctcggttcctgaagaccatgttgacgtgggccgaacagcttgacgaccgtccggtgcttccgttgcgtgatgcggcaggcggcaacgtgctgttcgacgatatcgccgacaggttgcgcgcgcgaggactgaacgctgctgttgattatggattcgacaagggcgtgaagattccgctcgtggtgggattgaaggacaagccgtttgccttggccgtgcagaccgatgacgcgaactttatgtccgtgcaatccacgcgtaggcgtcatcgtttgtcggcacaggatctcatttccttgggctggaatgtgatgaccgtctggagtgtcgccgccttcgtgaaccccgataaggaagtcgaccgtatcgtcagccgtatcggtgagatctatcgcgaggttgaataaccatggcggaatactcggctacacggcgcacaccgcgcaagcacaagcgcgtggtgatgaagggcactgagcagtttgacgctgacggtgtcaaactcgagcccggagacatgcagaccgaccaacaacggcaatccgacgacgacaaacgcatcctcggcgaactgccgccgcattgggccgtttttaacgagcgcgagtaggagttggggcgcactctgtgcgccccaacactgtgttttccgcagccgacaggctgcggaaaacacagtatcggccgaaggccgattccgcttcctaccgcacaacggccataatcgctccggcctgttgcagctccataaccttggccgcggcctccggcggcattgcgaacgacaccagtcggtcgttgcctcccaatgcaccaatcgcatccggtttgccgacattcatcaccgtggcgttctcggccagcgtgcaatcagcgccttcgcaaccgacggcggaaaccagtctcacctgatcgccggccaatacatcgtcgacgctactggccaagcggacttcaatcaccgtagtgccggtcggtgctacgggcgcatctctggccatatgcgtggaaatgggatcggctgcttcgatatcgatttgcgctaccttgcccaccacatcctcaatattgcctgtccaagacgggcctgccgcagataccggcatatcagccaactgaacgtcggcggccagaataatgtcaccccgtcgaatcgagcggacggccaccaccatcggctcggtctccaccacggccaatacggcttcaagcccaaacagcactgcgagtcccacgcacaacgcagcagtgagtcggcgcaaggcatccgccatgcgccgtcgccgcaatgagccgcgcgcaggcggcttaataaacgaaaaggtcaccatgcaaccatggtgacctgaagtttttcgtaagcgcaagccaaatcgacctatgtggttctagcttgccaagttatccacaacgcttcaaacccgtgcaacagacagtgcccgtagtgccaatatccgcggcataccgccgtcgacaccgtcgtttacagaggaaaagcgggtgtacagaccttacttgccggatttgtcggtgcggtagaagccgtgacccttgaactcaatcggcacggcggaatacaccttgcgcacctgctcctgcgagcacttggggcacacggtaatcgggtcgtcattgaacgactgctgttcggtgaagtcatagccgcagttcttgcaacggtaatgataggtaggcaacggattcctccaacaaagtcatatttctcgcggatggcccaaacgccatgccacgcaaccgttcatatcctagtcgccgccctgacacattggcgttacggtcttactagccagcttgctgttgccactctggttccatcggccagtgtgcgtggctggttggtcagtctggcttgcgccgagtatcttggccggccggccagctcaacaggcccgatgagctaagccgccggtatccctccggcgtcagcactccgtcggccggcacatcatgtggttcggccggcaaatcaatgtccaacacctcccacggccagcacaccgcaatcaggggacatgcgggcttgcggcgagccaaggcccggtcataccagccggctccacgccccagacgattgccctgcgggtccactgccaaagccggagcgatgaccagatcggccttctccaacgcttcgggcggtagaactgcgccagttggctcatcgggtctgtgatggacggtgctgggagagctgcagctaccggcattgttcgcgccacccactgcatccatcgagcgcaatgattccaatgaatccagcacactccagccaatttccaacccagaccccaaccttggcaccaacacgtggcagccatgagcccgcagccatcgcaacagtggccgggtttcgatttccgaacccatcgacacatatgccgccactgtgggaccatcctgaatcatgtgtgctgggaaccgtcgcaccagcaattcaccggccgctccgcgttcttccgctggaacgcgcttgcgccgagacagtatatggtggcgcagcgtcgctttatccgtcttctctgttttctctgtgccgctgtagtcgctgccgatattcatgccactgcccacttcgctcataccgcacaatctagtgtttccatcgtaaaacgaaagtggccacggtagcggcgcaagaccttcatatggctacaataaaggccgtgtcagttttccagtcgattaaagaggcgttcaagctggaccaccagatccgcccgccacgtctcacccatcccggttttccgatagtcctgcgccccctgaccatggatgatgaggacggctggaacgaagtgcgctggcgcaacaacgactggctggcaccttgggaatccggtgacccgatgcatggcggctccatcacattcaatcaatgggtgcagcggcagcgccgtaacgagcagcatggcgtcggcgtgatcttcgccatcgaataccagatgcgtatcgtcggccagatttcgttgggagccatcgtgtatggtgccatgcgtaccggcgtggttggttattgggtcgatcaacggtgcgccggccacggattcgcgccaatggcactggccatgcttgccgattgggcgctcggagacccattcgggcccgcgttgcatcggctggaaatcgccattctgccggataatgcgcgttctttggctgtggtgcgtaaggtcggagcccatcatgagggactgcgcgagcggtatatgtatgtcaatggccagtggcgtgaccacgtaacgtttgcgctgttggctgaagatatggggcaagggttcgccgccagactcgccgccgccggttccagataagcgtcgaccggaagaattccgctccgacacgcccggacggaaagccccagttcgtcggcacgtctcctatccttgactctatgggttatgagtcactgagcactgtcgtcgtgctggtgattgtggcgattattatcgttgtatggctgcccgtacgtacggccaacggcatgaaacgtgtggacgagcaccggcaggatcgttattcgccttccctgcatatcgttgatgcagagaacggcagacgattcggagacatcaagccgcataaggcgaaaggggcagcaatgccagcatcaacaccgtcagcgaggctgacatctgagcacatcgcccatgtgcgggaactgcgccgcgcggccatccgccgccggcagattctcgccgtatgcctgcttgccataaccgtgttggtgtttgccgtatcgttccccctgcatttcagtccgctgcttgctcttattccgttcgtgctgttgctgctggtgctggtgctgggagccaatgcctcacgccaggcccggcaatgggagcgcaaggtggtccgctacgagcgggctcatagcggtacgggctggtccaagaaaccgtctgccgagtccaaggacagcaagcgtgtgaacaaggccgaaccggttgcggccgtaactgcgcctgccgagaagcctgccgagcagattgaggatgctgccaccgaggtcatggaacagcggcagattcgccgcgcgttacgcgatgccgagattgagcaggccaaggccaaggcgttgcgtcagtccgccgccgcatatcaggccgcggaagagcacgccaaacagtctgagaagtctgatattgcacagtccgccgccgataagcctgccgccgaaccgtctgctatggtcgatgaatccgctgaccgtaagtccgctgccgaaaccagtgaatcttccgccgcgcccgatgcctccgctcgcacggataagtcgactaagtcggataagtccgtcgcccctcgagttgaaccatcgcttacggtgcgtgatgagcgtgatgagcgcgacgatgccgctgccgacgctacgtcggaactggccagcgtacgccctgcccgagcactggatgtcttcgatatggccacctcgcaggatctcatctccttcactttgggcggggaacataacgccgacaacgctccggaaagcttggagatcaagtcgacccgtcaggtgtccaaggcggaacctgtcgaacccgcagtggcggaaaagttgattgacgaggcccgagccgtcaaggccgcggacgacgccaaggctgtcagtgccggaaacgctgtagacactgagtcggagcagcgcgatgatgccgatacgaacgccgctacggacgccgatgacgaggctgcaaacgccgcccagcgagccgcattccacgaatccgaggagcgtgccgacgtcgaagcgccagcggcgaccaccgattcgttgggcgcaggcctggactccattcttgcccgccgcggcaactgagcgttgcgattcgccgattttctctcacagcgttagcactcgagttggcagagtgctaataatcgcgctacgatgtgtcctagcgcaaagggacaacgcaagtgatcgtcagcctcttgaggcgttctggcgcggcattatcgaactacaagtagatacgaggtgacccacagtgtcgattaagctcacaccgttggaagacaagatcatcgtcaagcaggccgaggcccagacccagaccgcttccggtctgtatattccggacaacgccaaggagaagccgcagcagggtgaagtcctggccgttggcccgggccgtcgtgacgacaagggcgagcgcatcccgatggatgtcaaggtcggcgacaaggtgctgtactccaagtacggcggcaccgaagtccactacgagggtgaggactacctcatcgtcggcgcgcgcgacattctcgccatcctcggctgattagtcgcctagcgaacttcaacaaccccgactgttcccacggacagtcggggttttctcttgccaggcggaaaggggctcccctcagagaggggagccgaaaaccgctcccgccaaacgcccagccatgcctgctatgcataaaggtgcatgcgcgcaacgtagttgagttcggcgttgcaccgcatctacactgggtaacggattggggtccctatggaagaggctcagttggcgacttggccgagcggcttaagacattttgcacaagacggcagtagatcgacggtatgttgttttttccgtgtcgcaggttcgtggtgtcgtcgcgctgtgccaatggttgtctctctaccgacgctgagtgccgtggcatgaggccagcgtcggcagtgggccacggaatggcgatgtgctgatgctgagccgcgttggcgtcgttatagggccagtttttggaccattgccgacggcaaatcggcgttttgtgtcggcgacggtccaatacctggcggtctgccgacgataagtgccgtcatcgtcggcagaccgccaggtattgtccccgtgccgacgtaaaaagccctgccatcgtcgtcaccgagccattttgtgactcactgacggcggcagcagggcggaagaggccgaaatcatgcgcgcggtgcggtctcacacctcgaatccggcctccaccagcgcgtgatcgatgtcgcgaatcaaatcgtccgtatcctccagacccacggccagacggaagaagccgcggtggaactcaggcgggtacaggtactggcgctcgtcatcctcgccgaggaacacgatcagcgattcgtcatggccgagcgagacggccgacgtaatcacattgagcttggaaacgaaccggttgtgcccgtcatgattggtgtcgaggccgaacgacagcacgccgccgaacccggagtccgggcgggccagctggctggccgccaccttgtggtgcaggtgcgattccagaccggggtacgccacgaaacgcaccacatccagcgattcgagatgcttgacaatcgccaaggccgaggcgtcgtagggcagcgcgtaggcgttcgccagcgtgatggggcgacggatcgcgccggtttcggcgtcgaccccgttaccgaggtgaatggccagcgtgccgaatccgagcggctggtcgtcgaatgattgtccgtgatgtacaagatcagaagccatgcgcccagcatgccagcatgcgccgtgccgcgcaaacaggcgacatcgctcgaaaaccgcgccattgcaaggttctagagcaccatataagaaaaaatgattgggtgaagtgcggggtgcagccttggtcggggctgtttgcagggccgaagcgggccctgaaaacacgctgtgagacacgccgataaaaccgcagaattccgcggtaaaacaaggttcgcgtaggggccgatttgcatacctggaaaatctgtggttatatagccaagttgcctgttgaggtcaaacaccgcggcgggaaacagactggcggatttcccaagcggtcaaagggagctgactgtaaatcagccgcttcgtgcttcagtggttcgaatccactatccgccacgccccgatagctcagtggtagagcacttccttggtaaggaagaggtcgtgagtccaattctcactcggggctctctggcggggtagctcagctggctagagcgtacgactcataatcgtaaggtcaagagttcgagcctcttcctcgctacaaatcgcgcccgctaaccggtgggcgcgcactatacctaagaacacagaggtgaatgacaatggctaagagcgccgacatccgtccgggcatcacgctggcctgcaccgagtgcaaggagcgtaactacattacgactaagaaccgtcgtaacacgcccgaccgtcttgagctcaagaagttctgcccgcgctgcggcaagcagaccgtgcaccgcgagactcgttgatcgcaagtatcacagctttacaaaacccggcccattcggccgggtttttgcgtattgcctccggaggcgagtggcagggtgcggaatcagtatccgcatcgcgtgagaaacggcagaaatcccgcgtctgaacgaacccctcgcgggcgttctgtcgtttcgggccgccaaaacggcagaaatcccgcgccaccttcgttcagacgcgggcgttctgccgtttcagccgatgattgcctcgatatcgcacctgcgccactaagatagtaagccatgacaagctttgcagacatcaccaccatgggcgtgggcggccccatcgcccatttcatcgagccgaccacgcgcgtgggactcatcgaagccgtggaggaagccgattccaaaggcctgcccttggtcgtcgtcggtggcggctccaacctgcttgtttccgataagccttttgacggcgtggtggttcgagacgcccgacgcctcatcactgtgccggacgaggctgcaccggtagagggcgaggatcgcaccgtgcatgtcaatgccgaggccggtgccaattgggatgatttcgtggccttcaccgtagagctcgggctcgagggcgtcgagggactgtccggcattcccggcacagtcggcgcttccgtggtgcagaacatcggtgcctacgggcaggaagtcgccacttcggtcgaatcggtggaagtctgggatcgagacaccaaaacaacgcgcgacctcacacccgccgatcttcgattcggctatcgatactccgcactgaagaccagcatgtacgccggccccggccggccggccggccgattcttcccgacgccacgttacgtggtgctttccgtcacctttgccctgacccactcggccgaaggcacggtaggttacggacagcttgccaaagcgcttggcgtcgaagtgggcgaccgtatggccaccgccgacatccgcaaagccgtgctcgcagtacgtgccgccaagggcatgctcgaggaccctactcgctacgccttgcctgacatggccaccgccaagcgcgaggccaatatcctgaccgatctggagcgtctggcctccctcaatgaggccgccggcattcccgttggcgatgacggtctgcctgctcccgactacaatcgccacagctgcggctcgttctttatgaatccgattctgaccgccgaccaagcggcggccctgcccgaagatgcgccgaagttcgacgcgactctgcctgacggcactcccggcaccaagacgtccgccgcctggctcatcgaccatgccggctgccataagggatataaggtcgatgcggacgcgccggccagtctatccacgcagcacacgctggccttgaccaatcgtgggggagcgagcgcggccgatatcgcagctttggcgcgtgcggttcagcaggcagtcaagagcgcgttcggagtggacttggtgcccgaaccggtctgcgtcggtgtgctgtaatcgcgctattgattgatggagtgggttattaatcccatatattgcggactctgagtcttattaatagacaagacacgcgggctcttctatactcgattgtcggtattgtgcgcattcggtgcgcaaacaacagagaaaaaagaagagcactatgcaactgttccgtacaaaatccgtcgaacagaccattgccgaaaccggtgaagagggccgcaagctcaagcgcaacctgacttggtgggatctgtcaatcatgggtgtggccgtagccgtgggcgccggcatcttctcggtgggcgcgcaggccgccgccttccacgccggcccggccgtgatcatcagcttcctgatcgccggcatcgtgtgcggcgcagccgtgatgtgctacgccgaattcgcttcgatgattccggtggccggctccgcctacaccttcacctacaccacggtcggcgagatcatggcctggatcatcggctgggatctgatcctggaaatgctgatggccggctccgtgatttccaaatattggggcgtatacctcaacgatttcatgcgcctgatgggctggaacgccaacaccaacctgacgttcggctccttccacatcgatatcgccccgattatcatcgtggcgttctttaccacgctgctcgtattcggcaccaagatcggcgcccgcgtggacggtgctatgaccgtgctcaagatcgccatcgtgttctttgtggtgatcgtcggcttcttctacgtcaaggcctccaacttcaccccgttcattccgccgagccagccggcctccaccgtggaaggctcctccgccgtcaccggcgtgatgacccagccgttgtggcagttcgccaccggcatgaccccatccgtgtacggcgttcctggcatcctctcgggcgcggcgctcgtgttcttcgcgttcatcggattcgacgtggtggccaccgcctctgaggagaccaagaacccgcacaagaacgtgccgctcggcatcggcgtgggcatgctgctcatcattgtcatgtacatgctcgtggccgtggtgaccaccggcatggtctcctatgccgatctcgccaagcaagacagcccctcgctggccaccgccttcgaactggtgggcgccgactgggccgccaagatcatcagcttcggcattgtgctgggcctggccaccgtggttatggtgctgttgctcggcctgacccgtatcgtcttcgccatgagccgcgatggtctgctgccgcgcggcctgtccaagaccggcaagcatggcaccccggccgctctgcagatcgtcgtcggcgcggtggtggcgctcgtggccgccttcttcgacatcggcgtgctctccgacatggtcaacatcggcaccctgtccgccttcacgctggtggccatctccatcccgattatgcgcaagaagcgccccgacctgccgcgcgccttcaagatgcccggcagcccgtggattccgatcctcatcgccgtggccaacttctggttgatgctcaacctgtccgtgctcacctggattcgtttcgtggtgtggctcgtggtcggcttcgccatctacttcggctacggctactggcatgcgcgcctcggcaagggcgacctgaccgaaacgctgtccgccgaaaccgataaggccgttaacggctgagagcgaggagcgtcccaacaggcgcgtacccttgtatcagtatttgttaaggaggattccatgccatatgtaatcgctcagccttgcgtggatgtcaaggacaaggcttgcgtggacgagtgccccgtcgactgcatttacgagggttcccgctcgctgtacatcaaccccaacgagtgcgtcgactgcggtgcatgcgaaccggtgtgccccaccgaggccatcttctatgaggatgatctgccggacgagtgggcttggtacaaggatgccgctgtcaacttcttcgctgaagtcggcgatttgggcggcgcttccgccaatggtccaatcggcaaagacccggaacaggtcgccgcgctgccgccgcagaaccagtaagctgattcgcggataagcgctgcacacagcgcatagttcggattgaaccctcggtctatcacggccgagggttcgtcgtatcttaggaacataccgtccaagaaaggggttctcatgggcttccacgcatattcgtcgccatacgactggtctcgtatcgccggcttcaaagccaccgccaaaaccgtgccgggtggcatgatcgacctgtccgtaggctcgcctgtggacccggtgccgagcagtgtccagcaggcgctggttgccggcgcagacgcccccaacgcccatggatacccggtcaccgccggcaccgccgaccttaaggccgctatcgatacatggttccgcgaactgcgcggggtggatctgaaatccatcaacgctgccgccgtacccaccgtgggttccaaggaggccgtggcgctgatggccagcctgctgcaccttggcgaaggcgatgtggtcgtccaaccggctgtctcctacccgacttacgaaatcggtacccaacttgccggcgccaccgtggtcaaagtcgatgatgtgaccgacgtcgattcctgggtgaatattccgaacgtcaaggccatctggatcaactcgccgtgtaatccctccggcgaggtcatctccgccgactggctgaccgacatcgtggctgctgcccgtcgcatcggtgccgtggtgctctccgacgaatgctatgcgttaatggactggcgttcggtgcgccgcaatacagccgcgtcctctgcgcctgccgcgtctgcatctgctgcgtctgtgcctgccgcaccggtggccgaatccaacgagcccgcctccgataccgcattcagtctctccgccacgccatgtgccctgaatccacatgtgtgtgaaggttcggcagctggcatcctggtgctctactcgctgtccaagcagtccaacatggccggctaccgtacggctctaattgccggcgattaccggctggtcaaggaaatggccgaataccgcaagcagatcggccagattatccctggcccagtgcaggccgccatggccgcaggcctgaaggacacagccgctgtgcacgagcaatggaggcgttaccgtcgccgcctatccgcgctggttgacgcactgaaggcatatggctattcggcacaaatgccctccggcgcgctgtacgtatgggtcaaggccaagtccggcgactgctgggccgatatggccgagcttgccaaaatcggcatcatccccagccccggcgaattctacggcgctcccgcctacctgcgtttctccgccaccgccaccgacgaggccatccgttccgcctgcgaacgtctcacggcgtaatgagatcgtaagtggcgttgagccgttcacgccccaaactgggcggccttgttgccgaatttgcggcgcacagcgtccagtgcggcctcggcatcatgcaaacgcgcctgtgaggtctggccgcgggcattgtcggcctcttcgagcatgtcatccagtgaaggctgcacggccgtagccgccgccttactgagcgaagacgtgctcataccggccaagcgaatagttttgggcaggggagtggcagactccgccgaggccggtagccccagcatgactttcagctgccgcacgcattccgggtacagcacgccggccgtatcggtcggccgctccatcgtaaaagaccgggtctgatagctcaggtcggcgaaccgcaacttcaccgtcagcgtgcgcgccaccagccccttgcgccgcagcgtgctggctacttcgtcgcaggccgaacgcagtagcccacacaccacgcgcatatcgcgtgtatcctcggccagggtttcctcggacccaatggatttctcctcgcgcaccgtggtaatttcgcgggaatccaacccgtgcgaggccgcccataatccacgtgccgcagctggggagccagtggcacgagtcaatgcagcctcatccagctgagccaattcagccaccgaatgcacgccccaagcgttaagccgcttctccaaagacggcccgatgcccggaatgccacgcaatggcatcatctgcacgaattcggccgatcgggccgcgggaatcagcagcatgccgtccggcttggcattggtcgaggccattttggacaccagtttgttacaggcgatacccactgaacacgtcacgtggaagcgctcggccacctgagcgcgaatccacgcgccgatcgcgctcggccgcccccactccagcagtgcggcggacacatccatatagccctcgtccaccgaaacctgctcgaaccggtcggtgacggtcaaaaacacctcatgcatgattcggtgcgacatcatgcggtaatacgccatatccactggcagaaaaatgccgttcgggcacaaccgatgggcgcgcgcggccggcatcgccgaattgatgccgtatttccgggcttcgtagctcgcggcggacaccaccgcgcgcggcccggtgccgatgattaccggcttgcctttgagcccggggttgcgcgccacctccaatgaggcatagaaggcatccatgtcgatatgcagcacggtgcatccggtctcgtcgtggccccaatcgcgtttggcggcctcaagtctcggtgcggtgctcatgccaccattgtaggaatgccgaacgaggtcatgctcactatgtggcgcgcatgacgcggcgctcattgtcataatgccgaatatcgccggaattccaagggtttacgcactgtgcggctgtttcgcatggtgggtgcgattccacggaatcgtccacattgcgtcactgtccgtaacgccttccaagtcaatgcgcgctgtcccggctctccgagtagcgtaaacctcatgaagaaggcagtggtcggtatcctcaaccgtgttcccgtggttcttatcgtgattggtgaggcactggtgatttatttggctacggccgtcgccaaacttgcgttcacccagctcgatccgctgtactcggtgtggtatcgcgtgggattcatggcggtgctgttgctgctgtggcgcaggccctggaacaaggcgaagcgagcgcaactgtttcaccgcgacgcccgcagctgggggctggtcgtactgctcggctgctcgctggtgctgatgaataccctgttttatgtggccatcagcaatatggatatgggcattgccgtgtctatcgaatttttgggaccgctttcggtggcggtgattaccggcaaaagctggcgcgagcgggtcggtatcggtatcgcggcggtcggtgtggtgctgttagctggcatatcattggccaatccgtccggcaatggcgcgtttttgtatggtctgattgcgattttgatcggcgggtcgatgtggggcatgtatatcatcaccggccggcgcgtggcggctggcggcaattcgctggataatctgtgcatcgccgtgaccatcggctggctggtccagtccctgttccttggcgtgccggctgtggctcatgtggttcaccccaaggccgatgccacgtgggcgcttgagcccggcggctcgctgaagctgctggctctgctgtttgtgatttccctgatggcctcgttcattccctatgtggtggagcagatcacgctgcgacgcaccacatccggcgcattttcggtaatgcaatccatcaatcccgccatggcggtggccgtgggactggcgttcggcgagattcccagcgttggtgaaatcgtcggtgtggcgttggtgatttgtgcggttatcgttacgttctccggcgacgccgcacccgcggacgttcaataatgtgtcgttcggcacgccgtatccgcaggacgtggtacagtaatttgctgttgcgcattattgcgtaacgtggagtcatgcctgagtggccgataggggcaccctgctaaggtgttagtcgtgtaaacggctcgagggttcgaatccctctgactccgccgattaaggttccgggtgaaagctcggaacttttttgttttccggaaactccgggttaagtaactcctgaaataaccgaggacgggcggtctccgcttgtggtaagcggagtcggaggtacgccattgtccgtccgcctccaaaccgccattttagtgggcgaacgagtgcggcacgtcgggaaaagtccgagcgacgaaagaaaaatgtccactaagtgagacttttgcgtggtgttcgtgaatggtgattgaagattaaccggtttatatattgcttgtccaatcgcttgctcatcgcctccctccccgcagtacttgaccgagatgggcggtaccctagagagagaagaagagttccgaagggcgggcaaagatgagccatatcgctgggcaggggcaacatcgctccaactcgacacgaaccaaccgtgcggcgctgattatcgtgttcgtgatcgtgctcgccgttgcgctgggcatcggcgcatggttcgcaacccatcgcacggacggcaatggccccgcacacgccggagtgtcggacgtcgcgttgaataaagcgaagaacacgcccaaaccggtgaccgaacatcacggcaattcaccggattgcccggatacggactgcatcgccatgctggtcaacggcgatttgttgttccatgagggattgtggagccatttccaaggcccgaaccccaacgccacggatggcaccgccttcaacttcgacccgctgttcgcgccgatgaagcagtacattcaggcttcggacatcgccgtgtgcgaattcgaaaccccgatcgcccagcgcggcggcccatatgccgcgtacccgatcttcaacattccgccggaagtggcggatgccgcccgcaacgtgggatacaacgcctgcacacacgccaccaaccattcctgggatcagggggcggatggcatcgcccgtctgtgggacacgcttgaggccaatggcatcgcccagaccggctcgtacaaaaccgaagccgactccaccaaaccgttggtcatcgattccccgaccggcggcggcaagctgggtctggtcaccggcacggtctccctcaacggcatgaccgccgacgaggactggcaggtggatcgtctgcgcgaagacggcgacccgaatcacgacagcgacatccagcgcgcggtagacaaggccaacaaggcccgcgagcaaggtgccgatgtggtggccatcgccatgcactcggtgcaggaataccttgattacgccgattcctggcagatttcggaagcccatgagcttgccgacactggtgccttcgacgttatttacggtgccggttgccattgtgcgcagcccatcgagaactataacggcacgtggattatctacggtctgggcaacgccgtcaccgagtcggcgaacacgccggaaaccttggtcaacaatcagggtgtgaccgcacgcatccagttcgccggcaagaagggcgtcaaggggtcgtggcgcgtcaaccgcatcgattgggtgcccaccgccaacgtgcatcaaggcaactaccaatggtgcccgatatccagcgaccatcccataggcacatgttgggacgaagcctacgacactcagatacgccaacgcatctgggatgtcatctattcgatgggcgcggaccagaacgtcgtcaaggaatggaacatcacgcaggagcaggcggcaaagcaatagttgctcggcttggtctcaaggaggggaagccgcaaggtgacgcttttcccgccggcctcctaatgtggagcccatgaccgagatttacgaaacccaaagcgaacgcaccgatctgcccctcgtcgtgatgccgtccgtgcttgactcgatgatcgagcccatcaaggcccagttccccgcgctccacgacgttgcccgcgtgcgtatgttcgaggaattcacgtccgacgaggcgaccatagccgagcgtctgaaggatgccgacgccctgctggtgggcggctaccacatttcggacgatctgctgcgcaccatcagcgggcaggggcacgtcaagtgcatcgtgttctgcggtaccggcgtcgccagctacctcaatctcgataaggcgcgcgagctgaagatccgcgtctgcaacgccgaacattatggcgatcacgccgtggccgagcacaccttcgcccttctgttcgagctcatccgccgcgttggccaactcgataaggacgtcaaggccggcaactgggcgtgggccagcggcgatggactgcaactcgccggccgtcgcatgggcatcatcggactgggcggcatcggctccaccgtggccggcatcgcccgcgccctcggcatggaggtcgccgcatggaattcgcatgtgccgcccgagcatttcgaacgctccggtgccactccggtcgacgatctcaacaagctcatcgaaaccagcgacgtcatctccgtccatctgccgctgaacaacgccacgcgcggcatcgtcaccgccgagaaccttgcgcatgtgaagcccggcaccctgttcatcaacaccgcccgctccgaagtcatcgaatccggtgcgctgcttgcccgactgcaaaagggcgatgttcccgccgcactcgacgtgttcgaccatgagccgctgaccgccgacgacgccatctgccatgtgcccggcatcgtcctgaccccgcacgtcggctggcgtgccgacggcgcgttcaaggagctcacccgccagatgatcgcctgcctgaccgcctacttcgccggcgaagactataacgtcgtcgtctccgaacgctgatagccctgcctagcctcgcgctcaatcgaacacccagccagtcgaccaccggaacacgctcatgcagacgattctcaacacgcccgacgatcctgcccacgattcgctcgtcgaaaaaaagtccgaatttatcggcgacgccgcccatgtcgatacgctcgacgaggcgctcgcgttcgtggctgcgatccgtgagcagcatccgaaagcccgacacgtggcgtatgccgccgtgtgcggaggcgcggatgggcgactgtccgaacgcatgagcgatgacggcgagccgtccggtaccgccggcaagccgattctcgacgtactcaagcagtcgggcaccaccgattgcgtggttgccgtcaccagatatttcggtggtattctgctgggctccggtgggctggtccgcgcgtactcatccgccgcatcattggcgatgaaagccgcccgcgccgcccgcatcatgaccgccaagcgataccgggttcgcctcgaatacccgcagttggcccgattccagcagatcctggcgcagcttggtggcagtcaggaggatgaatcgtatgcggtgaacgtcgagttgaccgcggtggtgccgcaggatgattgcgcgcgattcgaggagcgtgtgcgggaagcgttcaatgccgctgtggtgccggctccgattgacatggtcaacattccggttccgctcgcgtgacgcctgtatgactaagctgggcatcatgaccgacgagaacaccaccagccagcagacccagcccaccgaggccgcaaccgaggccgcggccgagactgcaaccgacacggacgcccagcagcaggaccaaggcgcgcagtccgcagccgagtccgccgctccggtggatttcgaaccgctgaccgctacatacgagcgtctgcgccattccaccgacccggccgaactgtccgaattcgcccgtcggccgttgcctgaccgtgccgatcaggcggcgttctcccgcgccaccgcacttttggaggctgtggccggcaacccgcacaccccggtggccgatcgtgtgttcctcgccgacaccatgccgttcccgaacgtattggtcaaactctccgaagaccccgaaccgtccgtgcgtcaagccgtggccgccaacggggacgacaagaattggctggtcggccgtctgaccaaggacccggtgcctgcggtccgggatacggcgttgaaaaacaagcgcaccagctggaagatgcggcttgagggtgcgcaggaccccactgcggatgcggagacattggatttcttgggcgtacttggcaccgaatccgaagagggagcaccggcggtgctttcttcgatggtccgccgtgccgtggcactgaaccccaatacgtccgaagcgatgcttgccaaattggccaacgacccctcggccgaggtgcggcacgccgtggaaagccgccgctaagcacactattgctgtgttttgccgcgcaaatttggccggcaatcaccccccctgtccgccattgtgagcgctcacatctcactatgtgagggtaaaaagtacataatttggcggaatcatggcatttttcttacggtgtggcgcaatcaaacggcgttagactggggctatgagtgagattaccgagagtgaagagcgtctggcccgtccgttgattcgactggccaagttggtcggtgtcggcacgagttatttgggcatgagccatgactaccacgagatagacgatgacgtcctgatcgaggtgctggcagcgctgggcatcgacgcctccagcgagagcgcccaactcatcgccatccgacgcattctgaacgagcgttacgcccgattggtggcacccaccgtgctgcatatcgccggtagcgaggaccgggtgctggtgaacaccggtattctggacgtgccttcggcgagcatcacgctggagaatggcgagccatatcaaggcaccattgaagttggtcctggagatggatcccaggcctacgacttggatggtacgttcatttcgaatgcggctgtggtcattcccgccgatctgccgattggttaccatacgctgcacgtcaaggtcgccgaccgtgtgcaagacgccactttgatcagtgcacctgatcgcgtcgatctgcttgacccgatgaagggcggcagtctgtggggctggatggcccagctgtactcgattcgctcctccaactcctggggcgtgggcgattacgaggatctgaagaccatgctggtggacgccaagcagaagaccggtgccgacttcgtgctcattaatccggtgcatgccgccgagccggtgtccccgctcaccccgtcgccgtatctgccggtaagccgtcgcctgatcaacttcacgtacatccgtcctgaggcgatcgccgaatatgccacgctcagcgagggcgacaagaatgccgtcgacggactgcatgccgacaccgaaccgctgaacggtgattcccagctcatcgaccgtgacgccatgtggcgcagcaagatgcacgccctgtggattatctttaaggccggccgtaccgccgaacgccaaagcgtattcgaccaattcaaggcggactgtggttccgacttggaggcgtatgccacgtggtgcctgtgctacgacaagtggggagcacccaacggcgaggagagcaactgggagcgcaagttcaatcgcaactccccggaaatcgccaatctgcgcaagcagtacccggacactttggacttctaccgctggctggaatggattgccgccgagcagctgtcctccgcccaacaggcagccaaggacgccggcatgcatatcggcatcatgtccgatatggccgtcggcgtgcacccctccggcgctgacgtgtggtggaatcccgagcgcttcgccaagggagccacggtcggcgcaccgccggacatgttcaaccagcaaggccagaactggagccagccgccgctgagcccgatcaatctggagaccaccggctacgaggcctaccgcaatatggtgcatggcatgttcgcccgtgccggtgcggtgcgcatcgatcacatccttggtctgttccgcctgtggtggattcccgagaaccgttcggctatggatggcgcttacgtgtactacgactcagacatcatgctgggcgttctggccatcgaggcctctcgcgccggcggcgtggtcgtaggtgaggacctcggcgtggtgccggaccatgtggccgattccctgtcgagccacggtattctcggttgcgccgttgaatggttcgagcagtgcgacggcgtgttccgcgccccctcccagtggcgtccgtatgcattggcctccgtgaatacgcatgatttgccgccggccgccggttacctggaatacgagcacgtcaagattcgtgagcgtctgggcttgctgaccggcccggccgaggaattcgaagcctccgccaaggccgagcaggatgcgatgctggccatgctggtcgagcagggttatcttgatgccgactttgccgaacatcgtgaggatcacgaggcggatatcgtcgacgcgctgtaccacgcactgaagggttcgccgtgcaagctgctcgccgcctcgatcaccgacgcggtgggggagaagcgtgcgcagaaccagccgggcaccaacaacgaatacccgaactggcgcatcccactggccgacgccaagggcaacgtggtaccgctcgaaaccctcttcgactcccccggtgcccaacgcttcgcccaaatcttcaattcctgacccgctttacctccctctgacgagccgagtcgttaagcggacagtccagtggactgtccgtagacgaggcctgaaagaagcgatagctgagagaaggcagggaattgcctcaccgtaggtgagtcggttagccgaagtgggtgggagagaaaccataaataggggaagagaagccataaacccaatggagtgtccccagttgccctatgtcaagcccggcgatatactagtggattgttgtgtttccctaaggggtccttcaaagcgctatcccactcgccatcgaggactttcagggagcccacggataatgaggttcgacgcctcttggatgcggccctgaccaagccacaccaagcagctgagacccggaacacaatatagaaaaggtaatccagtgaaaactttcactccgaagccagctgatctgactcatgactggtacgtcatcgacgccaccgacgtggtgctcggccgtctcgccacccaggctgcaatcctgctgcgcggcaagaacaagccgacctacgctccgcacgccgattccggcaaccacgtgatcatcatcaatgccgacaagattgctctgactggcaacaagatgggcaaggaactctactcgcactccggccgtcctggtggtctgcgtcgtgactcctacgccgagctgctcgagaagaaccccgagcgcatcatcaagaacgctgtcaagggcatgctgccgaagaatcgtctggccaaggtgcagctcgaccgcctgcgtatcttccgtggcgccgagcacccgcacaccccgcagaagccccaggtcttcgagatcgcccaggtctcgcagcaggccaagtgaaacctgagaggagataagaatcatggctgaaaacaccaacgactcccaggttgtcgagaccgaagaggagctcaccaactacaccaccgagaccaacgctggcgctggcaccggcacctccgcgattgagccgggctacggcaccggtcgccgcaaggaggctgtcgcccgtgtccgtctggttccgggtgacggcaagtggaccatcaacggccgcactctggaggagtacttcccctccaagctgctgcagcgtgaggtcaactccccgatcgttctgctcaagctcgaaggcaagttcgacgctatcgtcctcgttgacggcggcggcaccaccggccaggccggcgccatccgcctcggcgttgcccgcgctctgaacgccatcgatcgtgatgccaaccgcgccgccctgaagaaggctggcttcctgacccgcgacgctcgcgtcgtggagcgcaagaaggctggtctgcacaaggcacgtcgcgccccgcagttctccaagcgttaatttcgcttgtcctgtaccgagcatacaaaggctctccgcggaattccgcggagagcctttgtgtttgtgtcgcgctgtcttgagtgtgactcacacctgcttcatcagcgtgatgctcagcgccggcatggtccagacattgtcgtcgacgggagtgtccggtgtatcatccacaggggcatcgggcatatcagctgatacctcatcccgaggcgcggacgaggtgccgtttgcggcgtgatctgttactggcatcgcgaatttgatggtatccgcttcattctcagtcgaggattccgtacgctgcatggccacttcttcgaccatcttgagtactgtctcgctggcgtccggtacatgctgcgtccagacggtggtgtcaccgttcaaatcgcattcctcgacctgagtgccatgcccggctcggcggccgttgatttcggctgagcaccatttaggcgtccagtgggtgtctggcggcaggcggaatgtgcggtcgtcagcggtgccgttgaccacaatgcacacgtccacctcactgttggacagcaatcgcatggtgaagctacgtacgcccagatcgaaccagtcacgctccatcggcgtggtaccgtcgggcaggaaccactgcacgcggcttgagggcttgagtaggccgatctgggtcagtcgggtgaagaaatcctcgtggtgatacaggtccagtgatttacgcagcgccaccagtcgagacacggtttccaagcggcgcatttcgcgcgtcttgttggtggaatacatccaatcccacttcagccacgtgatgtcgttgtcttggcagtaggcgttgttgttgccgtcctgcgtgttgcggaattcgtcgccggcgagcatcatcggcgtacccagcgagagcagcagcatgccgatcatgttcatggccgcctgttcgcgtgccgcaatgacgtctggatcatcggtgacgccttcgacgccgaaattggcggaatggttcaccgacgagccatcattattgttttcgccgttggcttcattgtgcttggagcggtatctggtgaggtccgtcagcgtgaaaccgtcgtggcaggacacgaaattgatggaggccggagcgccacgccctggttcggtggcgaacagatcggccgagccgcagagtcgcgtggacatctcctgcaaactgatacgcccgaaatcggagccgccgtccacatcctcaagccagaaggtgcgggccgtatcgcggaagcggtcattccattcggcgaacggcacggagaattggccggtgcgccagccgaggttgcccagatcccacggctccataatgagcttcaggttgcccagcagcagatcggaacgcagggcgtagaggaacgggtgatgatgggtgaattcgccttccaggcgggccagcgtgacgccaaggtcgaagcggaaaccgtctatgccgatacgcttggcccagtatcgtaatgagtcgatggcaaaggtgaccacatgcgtgttggtgaagtccagcgtattgccgcaaccggtggtgtcttcgagtcggccggtattggatttttgatggcgatagtaggccaggtcgtcgaggccgcgccagcagaccgtcgggccttcgacgccgccttcgcatgtgtggttgtagaccacgtccatgatgacttcgaagccggcctcgtgcagtgcgcgcaccatgtctatgacttcttggcgcacggcggccgcgcccttctcctgggcggctttagtggcgtaggagggttcgggggcgaagtagctgagggtggagtagccccagtagttcttgcggccgtgttcttgcaggaagagctcgtcctgcttggccataatcggcagcagttcgatggatgtgatgcctagaccctgcagataggcgagcgtggtggggtgtgcgagtccggcgtacgtgccgcgcaatgattcgggcagccacggtgcgttggcggtgaagcctttgacgtgcatctcatagatgacggttttgcgccacggcacatgcgggtgctgcgggtcgccctcatgcttatgggtatcgcgatcgtcgatggccacggacaccggcatatggccgagcgagtctacagtgctcatggcaccgtatgccgagccgattaccttgcggtccacgacatcgcattcataggagaaggcggcgggggtgagctccatggagccgtcgatgcccttgccatacgggtcaagcaggaatttgtatggattgaagcgcacgccgtgtttcgggtcccatgcgccgtccacgcggtagccataacgcatgccgtcccatgctttgggcaggtgcacgtaccacaggccgtagttcggcccggtcatgcggaacaaggtctcgcgcagatacaaatgttcgataatgcgtgtgcataccgggaactcatgaatctgctggataaaggagatattcgggtcctcgaacaggcggatggcgtcttggaagaaagcgctgggctcatcaatgggctccagtacgcatagccaaacctgatcggcagtttcggaacgaacaacgacgtcagccccaccgtcgtcagtgaagtacagccctgggcgagtggcgtaacgatgcaacggtgggtttttcatacctccattgtagacgtgttgtcacttttggtggaagcccttgatttcctgccgcgttccgcagcaccgcagatgccgtcgagataattctcggcgaaccgcaacgcggcaccgatgatgttctgatcttcggcgcagtagctcttgcgcagattgaaatggtcggtgccgaacgggctgcgtgcgatgacgcgcgtcttcagatcctcgatgtcgctgtcttcaagatgctgggctgcttcaccgccgacaatcacgtcgcccgcgatgatggatcgcgcgttgacgatggcctgcgccacgtaatccagccactcatccatgcgctcgcgatgatgccgttcgccctgctcaagcacgctgaagaagccgggaatgctttcgtaatcctcgggcaaggtctccggcgagcagtaggtgtccatgcaaccgcgctggccgcagtagcattcgcggccgcccggcaccagcgtcatgtgttcgatggcgccgttgcactggttcgggccttgatacagtttgccccccgcgatcaccgcgccgcccgggcgtcgctccagatagacgcacaccgcatcggtgagcgtggagtcgaaccagagttcggccatggctgaggcatcggaatcgtggatcatcatgcacgggtaatggaccgattggctgatggtttcgagcgtgagcccagtgttgcccataatggtgccgaagatgatggtggtggcgtcgggggagaggatgccttggatggcgaacgagacgccgagcaccttgccgtgcttcttttcgacgtcggcggcgaagttgttgatgatgccgccgatacgctggtagtaaacgttggtgttgcggtaaggcagggcatcgttgcgtttttcgatgacgttgccgtacaggttaatcgcgcacaggcgcagttcgttggaccgcatcactaccccgatggcagtgcgatgatcgggattgaactcataattttgcgccttgcgcccgccggtggaatcctgcagttcgcctttgcggatgagtccgtcatcttctagtgcgcgcagattttgggtgatggtgggcaggctgaggccgagttcgcgttccagttcctgcttggtgacatggctatggccatacagatactgggtcatggcactgcggttgtgcgctttcactgcggtcgatggcattgccctcatgtttacccctttgtgcgatgagatatatgcaagtttactttatgaaagtggctttcatgtgcctcgacgcggaggttatgaggcaacaatcgtatatttgtaggcgattttgggtacttttttaaaccaactttctagaaatgtggagaaaatgattgcttttgaaaacttactttaaaaaagttctcggattgtgttgtttgcaggcatgtgattttcggtaaaaagtgaacaaaaagtaccaaatcgccggatagagtgaggatttgttcgatatttcgcacaactcgtaacaaaaactgttcaatatcgcacgtgaaacgccgtcgattttgtgcgtatgcatcgcgccggaccgttcagtatattgtgcctcaggtcacatatgcaatgtgacaacgcatcaccggtcattttcggttactgaggcggtatcccgctggtgcaactgaggtgacgaggcgatggcccagaactttgccatataccccaagaagatcgaggaggaccccaagtggcagaagcaaagaagaaggtcgaagctaccaagccgactccagaagagaagcaggccgcagctgaggccgaagttgacgcgctggttgcccgcgccaagaaggctctcgtcgaattcgagaacctcgaccagaagcaagttgatcgtatcgtcgccaaggcctccatcgccgctctgaacaagcacctcgttctcgccaagatggctgtcgacgagaccggccgtggtctcgtggaagacaaggctaccaagaacatcttcgcctgtgagcacgtcaccaactacttggccggccagaagaccgtcggcatcatccgtgaagacgacgtgatgggcatcgatgaggtcgccgagcccgtcggcgtggtcgccggtgtcaccccggttaccaacccgacctccaccgccatcttcaagtccctcatcgccctgaagacacgctgcccgatcgtcttcggcttccaccccggcgcgcagaagtgctccgtcgaggccgccaagattgtgcgcgacgccgccatcgaggccggtgctcccgagaactgtatccagtggatcgagcacccgtccatccaggccaccggcgcgctgatgcagcacccgggcgtggccacgattctcgccaccggtggtccgggcatggtcaaggccgcttactcctccggcaagcccgccctcggcgtgggtgccggcaacgccccggcttatgttgattccgatgtggacatcgtgcgtgctgccaacgatctggtgctctccaagcacttcgattacggcatgatctgcgccaccgagcaggccatcatcgcccacaaggacgtctacgaccagctcatcaaggagctcaaggtccgtaaggcctacttcgtcaacgccgaagagaaggccaagctggaacagtacatgttcggctgcactgccggttccggcgtcaagcccgtgctgaactccgcggtgccaggcaagtccccgcagttcatcgccaaggctgctggcttcgagattccgtccgacgccaccattctggccgccgagtgcaaggaagtctccgacgacgagcctctgacccacgagaagctcgctccggtgcaggccgtgctcaaggccgacaacaaggagcaggccttcgagatgtgcgagaagatgctcaagctgggtgccggccacaccgccgccatccacaccaacaaccaggagctcgtgcgtgagtacggcgtccgtatgcacgcctgccgcatcatctggaaccagccttcctcccttggcggcatcggcgacatctacaacgccatcgccccgtcgctgaccctgggctgcggctcctacggcggcaactcggtgtccggcaacgtgcaggccgtgaatctcgttaacatcaagcgcattgctcggaggaacaacaacatgcagtggttcaagatcccggccaagacctacttcgagccgaacgccatcaagtacctgcgcgacatgtacggcatcgagaaggccgtcatcgtgtgcgataaggtcatggagcagctcggcattgttgacaagatcatcgaccagctgcgcgcccgctccaaccgtgtgaccttccgcatcatcgactacgtcgagccggagccctccgtcgagaccgtcgaaaagggcgctgagatgatgcgcgaggagttcgagccggacacgatcatcgcggttggcggcggctccccgatggatgcctccaagattatgtggctgctctacgagcacccggaaatcgccttctccgacgtgcgcgagaagttcttcgatatccgtaagcgcgccttcaagatcccgccgctgggcaagaaggccaagctggtgtgcatcccgacctcctccggcaccggttccgaggtcaccccgttcgccgtgatcaccgatcacaagaccggctacaagtacccgatcaccgactacgcgctgaccccgtccgtggccatcgtggacccggtgctggctcgcacccagccgcgcaagctggcctccgacgccggcttcgacgccctgacccactcgatggaagcctacgtgtccgtgtacgcgaacgacttcaccgacggcatggccctgcacgcggccaagctcatctgggacaacctggctgagtccgtcaatggcgagcccggcctggccaagaccaacgctcaggagaagatgcacaacgccgccaccatggccggcatggcattcggctccgcgttcctcggcatgtgccacggcatggcccacaccatcggtgccctgtgccacatcgcccacggccgtaccaactccatcctgctgccgtacgtgattcgctacaacggccagattcctgaggagcccacctcttggccgaagtacaacaagtacatcgccccggagcgctaccaggacatcgcccgcaacctcggcatcgacaccggcaagaccccggccgaagccgtggagaacctggcgaaggccgtcgaggactaccgtgacaacaagctcggcatgaacaagagcttccaggattgcggtgtggacgaggactacttctggtccgtgctcgatcagatcggcatgcgcgcctacgaggaccagtgcaccccggccaacccgcgcatcccgctgatcaacgacatgaaggacatcgccgtcggtgcttactacggtgtctcccaggcggaaggccacaagctgcgcatcgagcgcgagggtgaggccgccactgaggaagcttccgagcgttgattgcaggcggtttgtggttggtggcactatcagtagccaccaaccgcggtgttgcagcttagtggctgcatagcgcgacacaaggagcccgaccccattacaggggccgggctcctttgcatatgtggtgctccctcagccagagcaggtacctccatggggtggtaacccactcatggggtggtaacttgcccatggggcggtgaaaaccccatggggcggtgtacgaaaacggctctattctgcggaaggtaaaattttaccgtccgccccatgggccaattaccgccccatgagggaattacctccccatggaatcgctgaagcgtcgctaaatcgccgcaatgatgcagccaaaagcaataaagctggcaaacgcctcggtaatgccggtcaccacgggcttcaaggttgtgcgccgtgtaaccaccggcaacgcaacggcgcgggccaacagcagcacagtcatcgcaatcagatacgggctgcgtccagccggcacggcggctagcagcaatagcgccacatgccatacccacgaagccgccacgtacgaacgcttcccgcgttcccggatcatggttttgaccaccaaaaccgacccatactgcgtcagcgcaaacagcacggtggcaatcagcccgctcacgggcaatgaacccgcgggccaccaggcgtgaaggtcgaatatctggctcaaatctggcatattccgaatcgcggcgcgtgcggcggtgacatcagcggctgcgcacgaggcatgtgctgcgttgatgggcataacacatgccgtctcaacagtgctgccaaacgacgcgatcaccgtggccatggccgacgcggcaatcaccgacacggcattgccccacagcgagcgctccttcctcagccacgaggacagcatcgacagcgcaaccagcactatatataagggagcccaacgcagtatgccggtatgcgtaatcaggaatggcaagccgatgacgatgagcgctacggcataagtgagcatcggcggcagataacggcgtgaaaagtgtgctttgaaccagtgcgcggcgctgaactgcacgcaatagcacacggcccacgtcgccaatagccaaagcgtatcaagattaggcccgccgataaagaagccagccacagcgggcagcataaccattacccatgcgccaggttggttgtcgaaccaatcgcgtttaagagtcttgcggcgggaagtcatatctgtcatgatatcgcagcgaatggttctcaataagaaagatgtgagacctgcattgcgacaatcgaacagacgccgagcggctatgccgcgaggtaatacgaacggcatgagcgcgacacgcgcgaactccactgtcccacctcaatgcttgaataaacaagttgcctgatttgggctcgcaaattggaattaaaaaagcgagcgcgggccgggagtcacttcaagtgaagtgacagccggaaaccgcgcactgatgtcggatgaccgccagaggacgtatgtccaagggaggccatgcgcgccggtgccctagaagcaggttggtaaacagtacaacgaacatcgctagaaagggcggacggcaatggcgggacagaaaatccgcatcaggcttaagtcctatgaccacgaggtcatcgaccaatcggcgaagaagatcgtcgaaacggtgacgaacgcgggcgcaactgttgttggccccgttccgctgccgaccgagaagaacgtcttctgtgttatccgttctcctcacaagtacaaggattctcgcgagcacttcgagatgcgcactcacaagcgcctcatcgacatcgtggacccgacccccaaggccgtggactccctgatgcacatcgatctgcctgcggacgtcaacatcgaaatcaagctgtaagggaggaggaagcattatgtctaatcgcaaggctctgctgggcaagaagctcggcatgtcccaggtgtgggacgagaacggcttcttcgtgcccgtcactcttgtcgacgtgtccaccaacgtggtgaccgctgtgaagaccgaggaatctgacggctacaaggctgtccagctcggctacggcgccatcgatcccaccaaggtgaccaagccgctggctggccactttgctaaggccggtgtcaccccgcgtcgccacctcgtcgaggtgcgcaccgacgacgtcgatcagttcgaggccggccaggaactggccgctgacctgttcgaagagggtgctgaggtcgacgtgaccggcaccaccaagggtaagggcttcgccggtaccatcaagcgttggggcttcaagtcctaccgccgtactcacggttctcacaagaacgagcgccgtcccggttctgtgggcgcatgcgccactccgagccgtattctcaagggcaagcgtatggccggccgcatgggtcatgtgaccgccactacccagaacctgaccgtcgtctccgctgatgtcgagaacggcatcctcgccatcaagggcgccattcctggccccaagggcggcatcgttctcgtccgctcggctgtgaagggagcctgataaaccatggcaaacgttactctgaacgtcaccgacgccaagggccaggccaccggcaccgttgaagctcctgaggctctcttcggcgtttccgccgaggatgtccaggctcacatcccgctgatccaccaggttgtcaccgctcagctcgctgctgctcgtcagggcacccacgccaccaagactcgtggcatggtttccggcggcggcaagaagccgtggaagcagaagggcaccggtcgtgctcgtcagggctccatccgtgcaccgcagtggtaccacggcggcaccgtgttcggcccgcagccgcgtgactactctcagcgcacccccaagaagatgaaggccgcagctctgcgctacgccctgtccgatcgcgccaacgccggtcgcgttgccgtggtggagttcggtatcaccgagccgtccaccaaggccgctgtcgccgctctggccccgatcaccgcggacaagttcaccacggtcgtcttcactcgcgacaacatcaacgagtggctctccgtgcgcaacatcccgaccgttcacccgattttcgtcgatcagctcaacacgtacgacgtgattacctcgcagtacgtggtcttcaccaaggaagccttcgaggctttcgtggctgccaagaccgagccgaaggaggcctgatttagatggtcgctattcacaagcccgctcacgacgtgattcttaagcccgtcgtctccgagaagagctacgccgcttccgaccgtggccagtacaccttcgtggtggctccggatgcgaacaaggtgcagatcaagcaggcaatcgaagagatcttcaaggtcaaggtgacgaacgtcaacaccctcaaccgcgctggcaagaagcagcgcactcgcaccggtttcggccagcgcgcttcccagaagcgtgcgatcgtgaccgtcgccgagggccagacgatcgacatctttggtaactgaaggttagccgagaaaagttaaaggaagaactacattatggctatccgcgtttataagccgacgaccgcaggccgccgcaacgcgtccgtctcggatttctccgagctgactcgttctacgcctgagaagtcgctggttcgcaagaagtccaagaccggcggtcgtaactcttacggccgtatcacctcccgtcatcgcggcggcggccacaagcgtcagtaccgtctcatcgatttcaagcgttgggacaaggacggcgtgcccgccaaggttgccgagatcgagtacgatccgaaccgctccgcccgtatcgccctcctgcacttcgcagatggcgagaagcgctacatcatcgcgccgaagggcatcaagcagggcgacgtcatcgagaccggtgctcaggctgatatcaagccgggcaacaacctgccgctgaagaacatcccgaccggtaccgtggttcatgccatcgagctccgcccgctgggcggcgctaagatcgctcgttccgctggtgctgccgttcagctcgtcgccaaggatggcgcctacgctcagctgcgtatgccgtccggcgaaatccgcaacgtcgacgcgcgctgccgcgctaccgtcggcgaggtcggcaacgaggaccacgccaacattcagctcggcaaggctggccgcgcccgctggatcggccgccgtccgatcacccgtggtgagtccatgaacccggtcgaccacccgcacggcggtcgtacccgcggtggtaagccgccggtctccccgtggggcaagggcgaggttcgtactcgtcgtccgaagaaggcttcgaacaagatgattgttcgtcgccgtccgtccggcaagaaccgcaagtaagggagtatcgagaagatgactcgtagcatcaagaagggccccttcgtcgacgcccacttgcagaagaaagtcgacgagcagaacgagaagggcaccaagaacgtcatcaagacgtggtcccgtcgttcgatgatcacccctgatttcatcggacacaccttcgccgttcatgatggtcgcaagcatgtcccggtgttcgtcaccgaggccatggttggtcacaagctgggtgagttcgcccccacgaagaccttcaagggtcacgtgaaggacgacaagaaggcccgtcgctaaggataaggaatagaacatggaagctaaagcaatcgctcgtcacgtccgcgtgacgccgcgcaaggctcgccgcatggtcgacctcatccgcggcaagaaggcgaccgaagccgtcaccattttgaagttcgcccctcaggctgcggccctgccggtccgcaagaccctggagagcgccatcgccaacgctcgtgtgaaggccgacaaggccggcgagccgttccgcgagaacgacctgtacatcaaggagacctacgttgacgaaggtgtgaccctcaagcgcttccgcgctcgtgcccagggccgcgctgctcgcatcaacaagcgcacctcccacatcacggtcgtcgtggctaacaaggaaggagcccgctaaagatgggtcagaagatcaatccgtttggctaccgtctgggcatcactgagaaccaccgctccaagtggttctccgactccaacaaggccggcgaacgctaccgcgacttcgtgcttgaggatgatcagatccgcaaggagatgagcaaggacctcgagcgcgctggcgtgtcccgcatcgtcatcgagcgcacccgcgaccgcgttcgcgtcgacattcacaccgcccgtccgggcatcgtgatcggtcgtcgtggcgccgaggctgagcgcgtccgcgccaagctcgagaagctgaccggcaagcaggtccagctcaacatcttcgaagtcaagaacgccgcgctggacgcccagctcgtcgctcagggcatcgctgagcagctgaccaaccgcgtcaccttccgtcgtgccatgcgtaaggcccagcaggacgccatgcgcgccggtgccaagggtatccgcatcaagctctccggccgcctcggcggtgcggaaatgagccgttccgagttctaccgtgagggccgcgttccgctgcagaccctccgcgccctcatcgattacggcttcttcgaggccaagaccacgtacggccgtatcggcgtcaaggtctggatctacaagggcgacatgaccgaatccgagttcgaagagcagcaggctcagcagaacaaccgtccgggccgtcgtggtggcgatcgccgcccgcgccgtggcaaccgttccgccgccccgcaggccgccgaagcccccaaggctgaggctcccgccgaggccgctccggctgcagaaacgaaggagtgagcaagaatgcttatccccaagaggactaagtaccgcaagcagcaccgccctgtgcgttctggcatgtccaagggcggcaacgagatcaacttcggtgatttcgccatccagtccctcgccccggcctacgtgaccaaccgtcagatcgaagccgcgcgtatcgccatgacccgctacatcaagcgtggtggccgcgtgtggatcacgatcttcccggatcgtccgctgaccaagcacccgctcggtgcccgaatgggttccggtaagggtgccccggagttctggattgcgaacgtgcgccctggtcgcgtgatgttcgaaatcggtggtgtgtccgaggacatcgctaaggaagccctccgccgcgctatcgacaagctcccgatgaagtgccgcattatcgcacgtgaaggtggtgatatctgatggcagtcggtaccgctgattactccatcaagaatctcaacgagaagaccaacgcggaaatcgaaggcttcttgaagaagtccaaggaagagctgttcaacctgcgcttccagcacgccaccggtcagctcgagaacaccgcccgtctcaaggctgtcaagagcgacatcgcccgcatgtacaccgtgcttcgcgagcgtgagcttggcatcagccaggagccggccgctaccgaatccaaggagaagtgattatggctgaagagcgtaacttccgtaaggttcgccgcggctacgtcgtgtccgacaagatggacaagacgattaccgtcgagctcgagcagcgttcgacccacccgctgtacggcaaggtcgttcgttccaccagcaaggtcaaggcccatgatgaacacaacgacgcccacattggcgacctcgtgagtattatggaaactcggcctctgagcaagaccaagcgctggcgtctcgaatccattatcgagcgcgccaagtaagtaaagttcggcaaggctcgccatttaccggggcattatgggcaaccacgatgccccggtaaatggggagaaccagctcggctaaggagaatcaatgattcagcaggaaacgcggcttcatgtcgccgacaacacgggtgcgaaggaactcctcgccatccgcgtgctcggcggatcgaagcgacgctatgccggcatcggcgacgtgatcgtcgcctccgtcaaggacgccattcctggcgggtcggtcaagaagggcgacgtggttaaggccgttgtcgtccgtaccgtcaaggaatcccgccgtgcggatggttcctacatcaagttcgacgagaacgccgccgtcattctcggctccggccgtgaaccgaagggcactcgtatcttcggaccggtcggtcgtgaactgcgcgagcacaagttcatgaagatcgtgtccctcgccccggaggtgatctgacatggcagccaagatcaagagcggcgacctggtcaaggtcatccgcggcaaggaccgcggcaaggaaggcaccgtcaagcaggtgctctccaacgatcgactgatcgtcgaaggcgtgcagatcgtcaagaagcacgtgcgtgcaacgcagcagggccagcaggctggcatcgtctccactgaggctccgatccatcgctccaacgtgatggtcatcgacccggagaccaagcagccgacccgcgttggcatcaccgttaaggaagaggcgcgtgacggcaaggtgaagaccgtgcgcgtgcgcgtcgccaagaagtccggaaaggagctggcatgaccgatactactgtcgaagcgccggccaccccgcgcttgaaggtcaagtacaacgagcagatcattcctgagctcgagaaggagttcaagtactccaacccgatgcaggttgcccgtgtccagaaggtcgtcgtctccatgggtgttggtgccgctgcccgcgactccaagctcatcgaaggtgccgtcaaggacctcaccctgatcaccggccagaagccgaagatcaccaaggccaagaagtccgtcgcgcagttccatctgcgtgaaggccaggccatcggtgcgtacgtcaccctgcgtggcgaccgcatgtgggagttcctggaccgtctgctgaccctcgcgctgccccgtatccgcgacttccgcggcatcaacggccaccagttcgatggccagggcaactacaactttggtctcaccgagcagtccatgttccacgagatcgatcctgattcgatcgatcacgtgcgcggtatggacatcactgtggtgacctccaccaaggacgacaaggaagcttacgcgctgctgaagcacctcggcttccccttcaaggagaactgatatggcaaaaaccgctcttaagaacaaggcggccggcaagccgaagttcaaggtccgcgcttacacgcgctgccaggtctgcggtcgtccccactccgtctaccgcaagttcggcctgtgccgcatctgccttcgtgagaaggctcaccgcggtgaactgcccggcgttacgaagtccagttggtaaacatcgacgctgaaggtccgcggcccgaacgcttctagaagaagcgtgagggcggcggaaaccatagcgagaaagggcaacaagcccaaatgacaatgacagatccgatcgcagacatgcttacgcgtctgcgtaatgcgagcgcggccaagcacgaaaccgtggatatgccgtactccaagttcaaggcgaatatcgccgagatcctgaagcgtgaaggctacatcaaggacttcactgctaaggaagccaaggtcggccagactcttgaggtcaccctcaagtacggtccgaacggtgagcgttccattcagggtatcaagcgcatctccaagccgggccttcgtcgttacgcgaagtccgactccctgccgatgccgctcggtggcctgggtatcgccatcatctcgacttcttcgggactgctgactcagaaggaatgcctcgaccgaggcattggcggcgaaattgtcgccttcgtgtggtgagaaaggagagctgaaacatggcatcgcatattggtaagctccccatcgccatccctgctggcgttgaagtcaagattgaaggccagaacttctccgccaagggcgctaagggttctgactcctacgtggttccggaaggcatcaccgctgccgttgaaggcaacgagattgtcctgaccgccgctgatgacctgcgtccgacccgtgccaagcacggtctggctcgttccatcatggccggcatggtcaagggtgttcacgatggctactccaagactcttgagatcgtcggcaccggttaccgcgccgtcgccaagggccagggcatcgagttcttcctcggctactcccacaccatcaccgtcaacccgcccgaaggcatcaccctgaaggtgaccgacgccaaccacgtggttgtcgaaggcaccgacaagcaggtcgtgggccaggttgccgccaacatccgcaagctgcgcgctccggaaccctacaagggcaagggcatcaagtactccgatgaacgcatcctgcgcaaggctggaaaggctggtaagtgatatgagcgttgctattctcggaaaaggcaagaaggtagctctcaagcgccgtcacgcgcgtatccgcaagcgcatctccggtacccccgagcgtccgcgcctggtggtcacccgctccaaccgtcacatggttgctcaggtggtcgacgataccaagggcattaccctggtgtctgcctccactcttcaggccgacttcgccggcttcgaaggcaccaagactgaggccgccaagaaggtcggcgagctgatcgccgagaaggccaaggctgccggcatcaccgcagtcgtgttcgaccgcggtggcaacaagtacaccggtcgcgtcgcagccgttgctgatggcgcccgcgagggaggtcttgcactgtgagcgacaacgaaacgaaggaaacccaagtggctgaagaaactcagaacactgtggcgaccgaatccaacaacgaggaccgcaagggtcgtcgtggccagcgcggtgaaggccgtcgtggcgagcgtcgtaaccgtcgtgaagaaaaccacggcgacgagttgctcgatcgcgtggtgaccatcaaccgtgtgtccaagacccacaagggtggccgtaccttcagcttcgccgcactggttgtggtcggcgacggcaacggcaccgtgggtgtcggctacggcaagtcccgtgaagtcccggccgccatcgccaagggccagctggacgccaagaagcacatgttctctgtgcctcgcgtccgcggcaccatcacccacccggttcagggtcacgacgctgctggcaccgtcctgctgcgtccggccgccccgggtaccggtgtaatcgccggtggctccgtgcgcgccgtcatggaatgcgcaggcatcaccgacgtcctgaccaagtcgatgggctccgccaccgccgttaacgtggtgcgcgctaccgtcgacgccctcaagcagctcgaagagcccgaggagatcgccgcccgtcgtggcctggcgctcgacgaggtcgctcccgatgctctgctgcgcgcccgcgccgccggcattgccgaggctcgcaaggctcgcgaagaggctgctgccgctaaggccgccgaagagaaggatggtgagtgatactcatggctaagaacctgaagattaccctgcaccacggcatcgtgaaccgtaccccggctcagcgcgccaccgtcaagaccctcggcctcaacaagatcggtaagaccgttgtccgcgaggacaccccggccaaccgtggtctggtgaacgccgtgcgtcacctggtcaccgttgaggaggttgactgattatggcagataacgaaatcctgcagatgcacgacctgaagcccgccccgggtgccaagaaggaccgcacccgtgtgggccgcggtgaaggctccaagggtaagaccgccggtcgtggcgccaagggccagacgaagcgcaaccacgtgcgtccgggctttgaaggcggccagctgccgctgtacatgcgcctgccgaagcttcgtggcttcaagaacccgttcaaggtcgagttccaggtcatcaacatcgctcgtctcgtggagctcttccccgagggcggcgaggttgctgtggccgacctgatcgccaagggcgctgttcgtgacaacgctccggtgaaggttctgggcgacggcgagaccaccgtggctttcaccctcaagggtgttaaggcttcggcttccgccaagtccaagatcgaggccgccggcggttccgtttccgaggactgattagtcctacggggagcgcaataggctgtacaacccccgcccgccaataggtggacgggggttcccttttctaaaaaattgttgttctgagtgcagagaagcagtctcaacacaatgatcgttttgagtatgcttccccccgttcagtacgacggagcataattcaggtaacattcgcgagacatgaagtggccgaagtaggcactttagactatgctcgtttgttagtttgtgtatttcgcgcgattggcgcgctattgggaggaaatctaggtgaggacactaatccaggccctgaaaaccaaagagttgaggaagaagattctcttcgtcctgttcatcatcatcgtctaccgcatcggttcgttcattccgacccctggcgtggactacaacgtggtgaacaagtgcatggccaccatcggcagcgcctcccaggagaacttcatcggactggtgaacctcttctcgggtggcgccatgctccagctgtctatcttcgcgctgggcgtcatgccgtacatcaccgcgtccatcgtggtgcagctgctgcgcgtggtcatcccccgcttcgaggccctgcacaaggagggccagtccggcgaggccaagctcacccagtacacccgttacctgaccatcggcctggccgtgctccagtccaccaccatcctggtcaccgcccgctccggcgccctgttcaattaccagtgcgaccaggtcatcccggacggctccgtgttcaacctcgtggtcatggtcctcatcatgaccggcggcaccggcctgatcatgtggatggccgagctcgtgaccgacaagggcatcggccagggcatgtccatcttgatcttcatgtccatctgctccggcttcctgccgcagctgtgggagatcggctacggcaccgacggcaccgatggcgactggctgaagttcggcatcgtcgtgggcgtgctcgtggtcatcctcatcttcgtcgacttcgtcgaactgtgccagcgccgcgtcccggtccagtacacgcgccgcatgatcggccgtaagatgtacggcggctcctccacctacctgccgctgaagatcaacatgtccggcgtcatcccgccgatcttcgcctcctctatcctcgccatcccgaccctgatcgcccagttcggcaagtccgaccagtcgtgggtcaagtggatcaacgccaacctggcgaacaccacctccgtgtggtacatcgcgctgtacgcgctgatgattgtgttcttctgcttcttctacacctcgatcacgttcaacccggacgagaccgcggacaacatgaagcagtacggcggcttcatccccggcatccgcgccggcaacgccaccagccgctacctgacctacgtgatgaaccgactcaacaccgtcggcgccgtctacctgctgttcgtggccctgatcccgaccgtgctgatcatggccctcggcctcaacgccaagctgccgttcggtggtaccacgatcctgattatcgcgggcgtgggcctcgacaccctgcgccaggccaaggcccagaccgaacagttccagtacaccggcttcctgttcgaaaacgtggaccacaaagagggctgacgcccgcttggcagcggtcgcccgcaatgggcaggcggccgcgcgaggagtggaacagtccagtggactgttccacgacggagcaatctttcttccgcatataactcaatggctcccttaaccaagggagccaaaaccgtattaataaccgacataaaaggagaccaccatgcgtctgctcatcatgggcccccagggcgtgggcaagggcacccaggctgctctgctcgccgaacacttcaacatccccaccatctccaccggcgacatcttccgctacaacatcaagaacaagaccgaactcggccttgaggcgatgagctacaccgacaagggcgagctggttccggactccctgaccaacaagatcgtcaaggatcgtctggccaaggaagactgcaagaacggctggatcctcgacggctacccgcgtaacgccgcccaggtcaccgctctcgacgagatgctcgccgacctcgacactccgctcgaccacgtggtggccctcgaagccgcccgcgacgtgctgctggagcgtatgaagaagcgcgccgccgagcagggccgcgctgacgacactccggaggccatcgccaagcgcctggagacctatgagaaggaaaccgctccgctgctcgacatctacgaggcccgtggcctgctcgtcgtggtcaacggcgtcggcgacatcgacgagatcagcggccgtatcatcagccacctcgagtagtaggttcggcagcccgggcaacaagccggagtgatgccgaaataccacatcaacgtttccatacccctgtgcgacacgccgagtgttcgtacaggggtatgtgcgtatatagttgacagttggtgtgtcttcggatatgccatagtaatcatccaacggaataggactagaggcacatggcaaaagacggtgtgattgaagtcgaaggacaggtcgtggaagcactgcctaacgcgatgttccgcgttgaactcgaaaacaagcacatcgtgctcgccacgatttccggcaaaatgcgtaagaactacattcgtattctgccgcaggatcgtgtcgtgctcgaaatgagcccttacgacctgaaccgcggacgcattacgtaccgttacaagtaaaggtacacaagaaaaggataaccatgaaggtcagccctagcgtgaagaggatctgcgaaaactgccgcgtgatccgccgtcacggccgcgtcatggtgatctgcgtcaacccgcgccacaagcagcgtcagggctgagagcagattctccagcggcactaagtaaataaggcactctctcacagtgcttcccgcaagggaacgacactgaaccacgggtacgtaggcccgtgccgggtaaccgggcgagcgggtgcaagacctacggcaacaagaaggaatcgcaatggcacgtcttgccggagtcgacatccccaatgagaagcgcatcgagatcgccctcacctacattttcggtgtgggtcgcactcgtgccaaggaaacgcttgccgcgaccggtattagcccggacatccgcgtcaaggatctcaccgacgagcagctgattacgctgcgtgactacctcgaagccaactacaagatcgagggtgacctgcgtcgtgaagtcgatgcagatattcgtcgcaagattcagatcaactgctaccaaggccagcgtcaccgtaagggacttcctgtgcgcggccagcgcaccaagaccaatgctcgtacccgcaagggcccgaagcgcacggtcgccggaaagaagaaggccaccaagtagtcggtggcatgattcgggccacgggatgattttcatcccatcgcccgaacgtcaacaacaaagttcgttactaggaaacgagggtcaatggcagcgcctaagcaagccgctcgtaagccccgtcgtcgcgaccgcaagtcggtcccggtcggccaggctcacatcaagtccactttcaacaacacgatcatttcgatcaccgatccgtccggcgccgtggtgtcctgggcgtccggtggcgatgtcggcttcaagggctcccgtaagtccacgccgtacgccgctggtatggctgccgagtccgccgcccgcaaggcgatggaacacggcgtcaagaaggtcgacgtgttcgtcaagggcccgggttccggtcgtgaaaccgccatccgttccctgcagtctgcgggcctcgaggttggttccatcaccgacgtcaccccgcaagcccacaacggcgttcgtcctccgaagcgtcgtcgcgtctgagcactcagcaataccaaatccatccaaaaccgcctgaccggtgagtgcaccaccgagttcaagctgaaaggataaccacagtgcttattgcacagcgtccgactcttaccgaggaatctctgaatccgcagcgctcccgcttcaccatcgagccgctcgagcctggcttcggctacacgctcggcaactcgctgcgtcgcacgctgctgagctccatcccgggtgctgccgtgacctccgtgcgtatttccggtgccctgcatgagttcaccactctgccaggtgtccaggaagacgtcaccgagatcctgctgaacatcaagggcatcgtgctcaccagcgaatacgacgagcctgtggtcatgtatctgcgcaagagcggcaagggcgaagccgtggctggggacatcaccccgccggccggcgtcaccattgccaacccggagcagcacatcgctaccctcgccgacgatggcgaactcgagatcgagttcactgtcgagcgtggccgtggctatgttcctgcccagatgaacaagcaggacaacgatgagatcggccgtattccggttgattccatctactccccggtactcaaggtgagctacaaggtcgaggccacccgtgtggaacagcgcacggacttcgacaagctcatcctggacgtggagaccaagcccgccatctccccgcgtgacgcggtggcttccgccggttccaccttggtggagctcttcggcctgtgccgtgagctcaacgcccaggctgaaggcgtcgaggtcggtccggccccggtggccgaggagaccaaccccgagatggccgttccgattgaggacctcaacctgacgcagcgttcttacaactgcctcaagcgcgagggcatccacaccatcggtgagcttgtctcccacaccgagcaggacctgctcgacatccgcaatttcggtatgaagtcaatcgatgaggtcaaggagaagctgcagaccttgggcctgagcctcaagtcctcgccgatggccttcgataccaataatctcgaaggtggcacgttcttctcgccggaagacgagtgatctgcctctttgaccaatcgttcgttcactaggcaagcagatgttcgggcatatgcccacctgcttgcctgaagaacggacatataaggagtaaacccaatgcctacacctaagaagggcccgcgtctggcttccagccccgcacacgagcgcctcatgctggcaaacatggcgaccagcctgttccagaacggccgcatcaccaccacgctgccgaaggccaagcgccttcgtccgctggcagagcgcctgatcaccttcgccaagcgtggtgatctgcactcccgccgtcgcgtgatgcgcgtcatccgcaacaagtccgtggtgcacatcctgttcacccagattgccgagcagatggagcagcgtgaaggtggctacacccgtatcgtcaagatcgctccgcgcgttggcgatgccgctccggccgctgtgatcgagctcgtcaccgagccggttgccaagaaggctgttgtgaaggaagctgaagccgccgccaaggttgccgaagaagaagctccggccgttgaggctgaggccactgaggctgctgaggctattgaggctccggtcgaggagaccgccgccgttgaggctgaggctcccgctgaggaagccgctgacgccgagaaggccgagtgagctgaatagcgtttcgctaagctagctgaaagggctggaatccgtttgggttccagcccttttgcgttgttttcatagaatctacaacgtacgtacggcccgaatggcctcggctcttgcggccagctgatcatcggcgggatatgcgatatgctccaaagtcaggccctgcggcgcaatcggcccgcttgagccttcacgtactggctcggccattttgccggcaaaccactccagtgatttgcgtcccgaaccaactttgatgcatgagccgaccagggagcgcaccatattgcgggcaaaggcgtccgccacaatcgtgaacactaccaggccggactccagcgacggagtccgatatgcttcatgcgatgccatctcatccggtactaggggagtgatcggcacccgccgccaataggcggtcttgacttcacggatcgtagtgcctcccggattcggagtggcgaaggaaccaaaatcgtgcaggccgatggtcaatgaggctgcgcggttcataagctccagatccagcgcttcatccacggtaagtacgcatccacgcagacgcgggtcgacctcagacgaacgatcggcgacccgatacacataagtgcgctccaatgcggagaacctggcatcgaagccgaccggagctacggcaatgccatgaatgacgatgtccgaaggcagcacagccttgagtctgcgagtcagcgcctcggtgaccggaatggtcatgtgacctacgcagcgattcagtacctcatcggatacatccagatgcgccacttggtgggaggcatgtacaccggtgtcggtgcgtccagccactgtcaagcgtaacggttcggccgcgtcatcggtcggcacccgcagcaccttgtgcagcgcatcttcaatggtgccttgcactgtacgaagattgggctgtttggcccagccatagaatccgccgccgtcgtaggccaagtcaatgcgcagtcgtgtcatagccattcattgtaacgagtgcggtcggcgagacgagtgcggtcgtcaagatgcgtgcggtcggcgaagtgacctgcctgtaacattctcgcgcgtttgttgaaacgggcccgccttaggttgaaaccatcaaacccggttacggcttgcggcgtcagcgtgcgctcaacacgcctaaccgcttgaagccacagaagccgccacagcaaggagcaggcacgatgatcgaatccgcagcacgcagactggcccatgaactggtaaaccgccgcgaagcgatcaatcgagagctgtcccgcaacggtgtgcgtttcggcatctacaagaacggcgaataccatgaccggctgttcccgtacgaccctgtgccgcgcattatcgaatccgacgaatacgacgaattggagaagggcctgaagcagcgcgtcaacgccctgaacgcctatctgaaggacatttattccgataagcgcattattcatgatggcgtcgtgccggaagaatacgtatacacctcggccggctacttcccgcaggtcaacggtgtgacccctcccggcggcattttcgcgcatatcgccggcgaggacctggtccaaggcgaggacggccgctggtgggtgctggaagacaacctgcgcatcccctcgggtgccagctacccgctgttcgtgcgcgacatcgagcgccgcatctccccgcgcctgttccgcgacgttcgtattcgcgataatcgcgaatacccgcgcctgttgcgcaaagccatggactttgtctccaccgagggcatcgccgtggtactgactcccggccgctacaattccgcgttcttcgagcacgcctatctggcggagaaaaccggtgcggcgttggccttccccgaagacctcgaagtggtggacaacaaggtctacttcctcgactacgccggcaaacgccaccgtgtgggcgtggtttaccgccgcctgtccgacgaattcctcgacccgttcgccttcaatcctgattcggtgatcggtgtgcccggtatcctgtccgcctaccgcgcgggcaacgtggccatcgtcaacgcgccgggcaacggcgcggccgatgacaaggccgtctactacttcgtgccgcagatgatcaagtactatctcggcgaggaaccgattctcaacaacgcgcccacgtacatgccgatgttcgaggccgaccgcaaggaagtcctgaatcggatgggcgagctggtcatcaaggatgtggccgaagccggcggttacggcgtggtgtttggttcgtcgctggatgccgccgcacgtgaggagctcgccaaccggatcaaggaggagccgcgtcgattcattgcccaagaggtgattcagttccgtgatatcgatgtggtggacccgaagaccggcgagatgtcgccgcgcaagtgcgatttgcgtgccttcgtggtcaccggcaagaatacgcacgtgtggtattcgggcttgactcgatactcgtcggtgcccggccagatgattgtcaactcgtcgcagggtggcggatttaaggatacgtgggtgttggcacccgaatccggcgtggagcacgagtacggtgccgaaacgcaggtggcgaacctgctgagccagtcccgccaccattcgttgtcgctggttaccgcttccaaggcagacaacctgtattggctgggtcgatacaccgagcgcgccttcaccacgctgaaccagttcttcccgttctacgatcgtgtgatggacaccgatgtggacgccttccgtccgttcgctcacgcactcgacctgcccgaagatttcgaggacttcgacgggttcgtgaacagcttcctgtacgacgggtccaatcctgattcggtgcggtcggccgtaacttccgcattcaacaacgccgtgattctgcgcccggaattgagctcgcgtctgctgcagtacgtggagttggcgatgaccaatatcaccgatgccgccaaatacgcggccgatgccgaggacatctacaagcagcgcgatattaccgatgacatgctcgctttctggggcggcatcgagaattcgccggtcgaccccacgctgaaggcgttcatcttcatcggcaaatatctggaacgcatcgacctgtacacgcgcttcggcctgacgatggaggatctggaagcgccgctcaagaagctcgccgcctattcgatgaccttggacggcatgccgctgcccagctgcttcgccgacggactgagctggctggtcggtcagctgccgtctcgcggatatcaggaagtcgccgacctgctgaagaagtaccttgacgactactccggccgtgtcagcgcgctggccatcaaagacatgggctcactgagctccatgaacatggacgccaagcgtccctgatcccgacctgacaccctgacgggttcaaatgctatggtggtatggcgaaaaaaccgtgcgcccgagtgccggcctgtgcatatcagcagattgccggaatatatgcgtgggctgtgagcgcacggaccatacctcagccatggctgtagtgttgttatcccgagaatatgccggttgccggctcgtgtgtaagtgcaggagacgttgtgaaaaaactcgtgttcgactatgagatgaggctgtccttcagcgcaccggtcaccgatcacaggttccagcttcgctgtattccctccactggccctcgccaacaggtgattgacgtggaagtgaagattcagcccgaaaccgaactcgaaaccaccatcgactcctttgactccgtggtgatgaccggattcatccctgagccgcacgacatattcagctactcggtgaccggtatcgccttcgtggacaatgcgcatatccataaggaagcctataaaccgctgtaccgattcaattcagcgctcaccattcccggcccgaacgtggaggcgatgattgccgtatgccgcgaacgcttggcggcgctgccttccgacgccactccggtgcagcaggctgccgaagtgatggatgaggtctacaaggcgtttgtgtatacgcccggttccaccacgattcgcaccaccgccgaacaggccttggctcagcgcaagggcgtatgccaggattatgcgcacgtgatgctgtccgtgtgccggcatgtgggattgaccgcgcgctacattgccggtttgcttgggggagagggcgcgacccatgcttgggtcgaggtgtatcaggatggccgatgggtcggactggatcccacgcataaccgattggtggacgacagctacatcaccatcgcccacggccgcgattaccgcgactgcatgctcgacatcggcatcttctctggatacaacgtccagcagtcccaatgggtcaacgcctccgtccacgaacaggtggcataaataaaatttcaagccccctctgatgagctgagccgtgaagaaaacgccggaggcgtttttaggcgaaggcgaacgacagtgagcaaataaaatggcagctggaaagctgtccttaattgcgttcgagctgtcagccgtaaggctgaccgagggagagaccactcaatgcagagtggccccgtcaccgcttctaccaccaccaatattcggattgtcgtcgttgcaacattcggattttggtagttgaagaattcggattttcgcagttgaccaattcggactgttaatcggctcatcgtctgacccatcgcaatctcacacaaaatcgcattatcccacgccgaatcgagctcagcgaaactccgatttgccaggtcggcagaatgtggcataatgaacaagttgccattttggcagcatggataagtgtccgagcggtctaaggagcacgcctcgaaagcgtgtgaggtgaaagcctccgcgagttcgaatctcgccttatccgcctgcaagggtttcgaggtcacctcgaaaccctttttgtttctgcgaaaccccacctttggggctataggccaaaatggagttataggccaaaatgtgtgtccggcggtctagtcgttcgactgccattcgacccgtgtgtggaactcgttccagtcgatgctggtgcctgtattgcttcaatgtttgttgggcgggttcggcagtgtttttcacagccaaaaaaaatcagtgacgaaacacgaaacatcgacttgactaaatacaaacggcgccgccacgaggagcggacccgccccgcggccccgcattcgctgcagcaccggtcggtctcgtccgtcggatcgcagccgatcagccacacgccggcacacgagcccgacgtgacgtggcgttgcgagaccgggttcaacccgagcctgtccagaccgagcagcacccggccgtcgaacgcgctagacttggaaccaagctgcgcggttttcttcgctttttcgatcacacaccgaataaaaacgcacggcccatacacacccaaatgcgaagggccagttatgacccgagaacgcctataactagcgcctgtatgcatgtaattgcagaaatcgacgtcttgtgcatgcaatttgggtccgtaaatagcgcagaaatgcgaggcaatctgcggacgggaagcgggaagggcggttcaggagctttaaatggtcctcttatgcatgcggcctcatgatcgggaaccggctaggaaatacgttgcatgcatttcggcatcataaggcatcggaaaagtcctacggtagcggtcccgcgattcgtcaattgagtgattactcggtactgtctcccgaaccgaccagttttttgctcatacactagttccgggtttcgatgagattgatgatgggcgataaaagggtccgacgcgctaacgtcgggcccttgcgttgattacggggtcgtgcccctaaccaaaggttacgggacgaatcgtatcatgatgcgcggtagtctgaccgtgagcaaacgcactgtgattgtctatatgacggatgcgcgcggtccaacgtgcgtggcctctggccgttacctcttgctaagactgcttatgtaacggtcgttaaagcatgatgtttcctcgctaggtattttgaccgcggcagttgttggatggatttgattcggatgatgatatagcgttgtatcaattgtggttgctgttatttgtatttgttgaagtatgtgagtggcgagtggcgctttacatgttcttttttctgtcttttggtccgattcttttcggcgtgttgccttgaaaatacacgcttatgcagatgttttgcgcctcgtcgttgcatgatttggttctttgttgtatcatctaactaaatgataagtacaatgttgtatcaagttgtactcagtaattatcttccgcgctgaagcggtgatttttacttatctgagacaacgttgtatcgaatttatggaagcaaaggataacaatggcagagcagcagtccaacaccgcctcagattcctcccgtctgatcgtcgacgatgccttcgaagtggctccggtgaatgatcgtctttttggctcgtttgtggaacatttgggacgttgtgtatatgacggcatctatgagcctagtcatcccgaagcggatgaggatggattccgcaaagatgtcattgagctggttcgtgagttaggtgccactaccatacgttatcccggcggcaattttgtgtccggttatcgctgggaagatggtgtcggcccgaaggaaagccgtccgcgtcgtcttgatttggcttggcattccactgaaaccaatcagttcggcttgcacgagatgtctcagtggttagacaaggtcggcggcaatgagctcatggaagctgtgaatcttggcacccgtggtcttgaggaagctctcgatttgcttgagtacgcgaatgttcctagcggtactaagctctctgatgaacgacgtgccaatggcaaggaaaacccgttcggtatcaagatgtggtgccttggcaatgagatggatggcccctggcagactgggcacaaatcagccgaagactacggtacattggctgcctcggttgcggcgggtatgcgcatgattgatccggatgtggagctggtcgtatgtggatcatccagtcacatgatggacacatttggtaaatgggaagaaacggttcttgaaaaggcctatgacagtgtcgatttcatctcgtgtcatgcctattatcatcctgaatttcaggctgatggcactcgtgatatggcaagcttccttgcatccggcgttgatatggatggcttcatcaaggatgtcgctgccgccatcgacgctaccaaggctcgccttaagagcgaccataacgtattcatctcatttgatgaatggaacgtgtggtatatcgatgaagaaccaagcaaaaatccggaaggtattggtaattggcctgtggcgccccgtctgcttgaagatagctacaccgctgcggatgccgtggtctttggcgacctcatgattacgttgctcaaaaacgccgatcgcgttcatgcggcgagccttgctcagctagtcaatgtcattgcgccaattatgaccgagccaggaggtccggcatggcgccagacgacgttctatccattctcgatgactgcgagatatgccaagaacggtacggtacttgagcccaaactgacttcgaatacttatgccacggccaagtatggagaggtaccggtggtcaactctgtggcagtacgcggggccgatggatctgtgaccattttcgtggtcaatcggtcattggaattgtccaatgacttcgaaatccaagtgccggatgatggcaacttcactgaagcgaccgcacagacgctacatgaagaggacttgctcgctaggaacaccttggaaaaccaagatcgcgtgattcttcacaccaatgattctgttacgttcagtgccgacgatgccatcgtacatgtgacattgcctccggtgtcttggactgccgtgcatgtgcggtgatttgaacgggtgaacatcgaaatataggtacgagataaggggaggagcgtcacatgaattgcagccaattcactccatgtgagggacgaacagagattgtcgatgctgatggacgattgatctggcataacgatgacatctgcatggtattcgtagttcgcgataatgctccggttgtgctcgccggtttgtccggatatggtatgcgtcctgcctgcgaattgaacaacgagaaaggtgcgtttcccattgtggaagtacttacttctatctcgggtcgtaccatgaatcatcaacgcttgaccgatactcgggaaggaagtcagctccgttttgtagcagcttatacctatgagcgcggcatgcgtcatgttctcaggattgatcagaaagatgaacattctggcctgttgactgagacggagttctcgatgttccccggagtcagtgccgtgagttgccagtcccgcatcgcatcggaacgccggctgccggtagaagcagtgtcttcgttgaatctcaccgtgccgttggatgccgctgggggtggagttgacggagtcgaggtctactgggccgacagcacatgggccgcggaaaataattggcatcaggcgccacttcgcgagattggtttgccggacatcaataccaacattaatcctcgtgttccgggcgcgcgatttaatctctcttcgcgatccacttggtcgactggagagaagcttccccttggcgttttaaccatgggggaggggattcgtcgctcggctctgatttggcaaatcgaacacaacggtccatggacttgggaaattggtgaaggcatcgatggccttcatatcacggccggcggtcctaatggggatgatcatcaatgggccgttgtgcttgacgaacgcactgattttgtcacagttccagctagctttgccatttgctcaggcggctggcagcaggtagtcgaacaaatgacgttacatcgtcgggcattgcgctctgctcgtttggctgtaaacggtcagaaccatgattccgaacagctggtcatttacaacgactatatgaataccctgttcggcaatccgacggctgataaagaactgccgctaattgaaggtgcaggcaagctcggcgtggacgtgttctgcatcgatgctggatggtatgacagcgccgatggcggctggtgggacatggttggcgagtggaagccctctaccaatcgtttcggcaatcttggcttgaaaggaatcgcttcggccatccgcaaggccggcatgggactgggactatggctcgagccggaagtcgtaggagtacgttctccaattgctaatgagttgccggattccgcattcttctgccggcatggcgagcgcgtggcagacgatggacgttaccatctcgatttccgttctcctgatgcgcgcgctcatatggatgacacgatggagcgcatcatcgctgaattccagccgaaattctttaaattcgactacaacaccgtacccggggttggtaccgaaatcgatgccggatatctaggtgaagggttgcttggtcatagccgtgcttatgtgcggtggctagacgatctcaagcaccggcatcccgagcttgtcattgagaattgtggttccggtgccatgcgtgctgactacgcgatgctgcaacgtctcgatctgcaatcgacttctgaccaatgtgatccggctatatatgctgccattgcagctggagcctcaatgtcgattctgccggagcaacaaggcaattggggctacgctcagcaggagatggatgacgagactgcggttttcactcttgcagcaggtatcgccggtcgtctgtatctgtcaggtttcgtcaaccgaatggatgagaggcgcttgcgtctggtccgaggtgccattgaagcgcaccggcaggtgctgaggaaccagtccggtcaggtgccattctggccattgggacttccggttttttcgggcgattggttggccagtgggcttttgccttatgcggataataacgagaccggctatatgacgatttggcaccgcggcggtgcaaacagcgttgttgtagaagtgccgcaaggtgccactttgagaccgtttttcccgaagccgggactcatcgacaagagccatggtgcagtcgattggcatgtcgagcctcttgatggcacacatgtccgtctgactgtttccgacaatcgtcgcagtgccagagtgtatgcgattgatatgccggattccaccaaataacaacaagatttgcctgcgcaacaccgcgctggcagcaatgataaggagaaagaacatgaagcaccccttcagaagtgcggttgccgcagtcagttcaatggtgatgctgacttcccttgccgcatgtggcggcagcgacacggcccagtccgatgaaaaggaactcacgatttcttggtattactcctctggcggtggtgacacgtgggagcgtgccatcaagctgtacaagaaggaaaatccagatgtcaagatcaatgaagtccacacttcattcccgcagatgcagaagaatgcatcgttgactctgcaggctgacgatgctcctgacgtggccctgtacaaccaggggaccagttctgttggcaatctcgcatcgcaaggtattctggctgacttaagcgaatatgcggacaaatatggttggaccgatacgttgcctgaatccattcagactgtggccaaatataaggccgatgatggtggcgttatgtcctcggacggcgaatggtatggcgtgccagtcaacggtgagttcgttctggcgtactacaaccaggacatgttcgataaaaatggcatcgctattccggaaaccttcgacgagcttgagtccgctatgcagcagttcgtggacaaaggcattacgccggttgcttttgaaggcaatgagacggcttcgcagcatctgtggtatcagctggtactgtctaaggccaatcgccagtttgttgacgattatcaatcctatgagcacgacgtcgacttctccagtgagccattcacctatgctgcgaacaagttctccgagtgggtccagaagggatatcttccgagcaactccggtggtctggtcgctgaggatatgattacacagttctgtgcaggtgaatacccaatcatgttctctggctcgtggtggttcggacgtgtcaatcaggatggcaacttcaagagcacgttccgtgccttgcccggcaacgagaagctgaacaccggtgcaaccggcaaactatgggtggttccggaaacctctaagcataaggatcttgctgccgacttcctgaacttcctgctctccaaagatgtgcagaacatgcttgctactgaagctggtttgccgttcaatgcctctgatgattactcgattgactctttgccggatgagcttaagaatccgctgaagactttcgatgacatgcaggactctgccaaagagttcaacacggtgttcgaacagttgctcgacaacgatgcgattgcgttgtacccggattggccaagtgccggcatgtatgatgctctgaattcggctctccaaggcttgattaacggcaactccactcctgagcaggcaaccggtgaaatcaaggctgcttatgaggaaggaaagtcagatctgggactgtaacgagttcctgtctcttcgactacacgataaagccacgtagtgtggcatggtgtgggatggatgttcattgttgatcatcttcccacaccgtgcctgacacattcgcactcatgtacagagctggcactgtcgccagcccgcatcccatatcgtcggtgtccattgacaaaaggaggagaccatgtctcatggcaacggctcatctcaaggaaagcggcagaagaagcagctttccaataacgagaaaatatatgaaaagcgtattcgtagcggttatggccgttacattgttcccggtgccatcggtaccgtggtgattctgctgattccttttatcgccaatatttggatttcattgcacagttggcgtggtggccgcagcaaaatgaaattcatcggtttggacaattatgtcaaactactgggggatgaaaagttctggacctcattttccaattcgttgtacatgattgtggccatggtaattattccgctgcttatcggtctgattcttgcagcagtattgttcgattatatcggtcgtgaattcggtggtaagacatcgagctttttgagggcttgctactacctgccacaaattcttcccgtcggtgtagccggcattctgtggaattggattcttaattcacagaccggcgcgattaatcgaattcttgccggacttttcggcatggataagactcctgattggctaggcgacccagatcttgcgatttatgcggtgatgctgatgttggtgtggagccagataggatatccggttgtcatcttcatgtcggcgttggggcgagtcgatcccgagctgtatgaagctgcatcgcttgatggtgccgggtggtggcggcgattcagcgccatcacgctgcctcagattaaacctgagattttcgtggtggtactgacctgcactgttgcggcgcttaaggtttttggacctgtttatatgctgaccaagggcggtccgcaaagctccacccttgtgccgtcctactattcctacattaatttcttcggtaaatcacagattggctatggagcggccatcgcaagcgtgttggcgattgtcatcgccatcgtcgcatctgtcatcatggtgttccagaaccgtagcgctgctcgggaacgtgaaggagctctgatcgtatgagcgcatcatcatctgtcaaaacaggcatccaagctcgtatgaatcgtattgaacagcgtgatcgagttaagcagtccaagacgcgcaagcctattaatctattgcgatgggtaattctcattgcatgtgtgttgtttgcgattctgattctctcgcctctgttccttatggtgctcaatgcgttcaaaacgtcacaagattacacacagaacggtccgttgagcctgcctcatgaactgtatttcggtggcttggtgaatttctggaaagcgaccgacttccccatcaagttctggaattcattgtggatttccgtggtgtctgcgctgttgtccgtggtgctctcgctatttaacgcctatgcgctgggtatcggccgtgtgcgtggtagctcagtgattattgcactgttcatgattctgaccatgctgccaggagaaggattcatctacccactgttttacatgttcaacgcggtgggcatgggcaattctcaatggaccatcgtaattatatgcggcattatcaatatggcgtttggcacatatttgctcagctcggtgatgtcgacattccccaaggagctgttggaagctgcacaaatcgacggggctggtcgttggcgcacactccgtgacgtcgtgttcccgattatgaagtcgaactgcgcggtcttgttcatcttcttcttcatttggacgtggaacgagttctacttcaccttgattttcctagtgtctggagatactcagaccataccgctggcaatcgcgtcgttgcagggcgaccgcatcatggacgttccgactatcaacgcgggaagccttatctcccttattccggcgtttgtcttcttcctcatcttccagaggacgttgacgaagggcattaccgccggagctgtgaaataaccgaacccgatgcactgttggccggtggttctcctcctctccttcccactggccatagtgtatcgatgtatctttcgcccagcgtggggcaacaatgaagaaaggcaaacaaatgaaattttccgatggatattggcgtgtgcgtgaaggctttaccgcagcatgggcccgacagacacatgacatcgcgaaaaccgataacgggatttgtgcacatgcttctgcgaatctggtcaatgggcgtggggattccttaggaggtccggtattcacagttactttatcgaccccggccgaaggaatcatcaaagtagtggaagagcattttcgtggagcggtgaatccagatccacattttcatctgaatattgatgaggatgcgaatttcgacattgagaccggggacggggccacggtgtttcgtgcgggctcgctcgaagtcgccgtctccaatcctggcgagatttggtccatggacttccgagcgaatgggcatagtctcactggaacgtcgtacaaggggctgggcgcatataccgaacagtcgactggtatccattacatgcgtgaacagctgcgtcttgccctagacgaaaaagtctacggcttcggagagcgatttggccacttcgtcaagaatggacagaccgtggaaatgtggaactctgatgccggtacctcatctgacgctgtgtacaaagccatccctttctattggacgaataaaggctatggcgtgttcgtaaatcatagcgaagacgtgtcatttgaggtcggatctgagactgtgggcaaagtgcagttttccactaaaggacatcgacttgaatactatgtgattaatggcccggaaccaaaagatgtactacgccgttatacgaagctgaccggacgtgctccctatctgccggcatggtcatacggtttatggctgaccacatcattcctgaccgattatgatgatgccactgtagcgggattcgtggatggcatgcaggaacgagatatcccactatcagtcttccactatgactgcttctggctcaaggaataccatttctgcgacttcgaatgggatggagatatgttccgtgatccgaggggaaccattgccgagcatcaccgtaaaggtctcaaggtgtgcgtatggattaactcctacctgagttccatgtcgccgttgtttgacgaggctatgtctaagggctacttgctcaagcttcctgatggcagcgtttacgagaccgatttttggcagccgggcatgggcctggtcgatttcttgaagccggaagctcgtgaatggtactgctctaagcttgagaagcttattgatatgggtgtggattgctttaaaaccgatttcggagaatcagtgcctactgaagtggtttatgaagatggttccgattcggtcaagatgcataactactacacgtatctgtacaacaagactgtctacgaattcttggagcgaaagcttggcaagggacaggcggtgctgttcgcccgttccgccaccgttggtggacagcaattccctgtccattggggcggcgactgcgaatcgacttatacggcgatggccgagtcgctgcgcggcggcctatcgttgatgtcgtctggatttgggtactgggcgcatgacatcggtggattcgaaggcaatcctggtcctgacctgtacaagcggtgggtgcagtttggtttgctgtcgacgcattcgcggctgcatggttcccattcggtgcgtgtgccgtgggccttcgatgaagaatcctgtgatgtactacgcaagttcaccaaattgaagttgtcgttgctgccgtatctggcctatggatccaaacaggtcagcgaagaaggcattccgctgatgcgtcccatggctttggagttccctcacgatccagcggcagaatatctggatcgtcagtacatgctgggcgatgatttgctggttgctccggtcttttctccagatggagtggttcgttattatgtgccggaaggaacttggacgaacgtactcaatggagagcgaatcgcgggtccgagatggatcgaggaacaattcgattacatgaccatgccgttgctggcgcgtccaggtgcggtcattccaatgcaggaaggacgttgcgacaccgatggggatttgaccgacgacgtgatcctgaagatttatgatccggcggcccttgactcggaatggcgccaactggtcctgcggcatggttttgaggaagatgccgctgagacgatcttccggattcggcgtacgaatgatgtgcttgaagtgcgctgcgattccgtggaagacggatgggctgtcgaatgtggcggtcagcgggttcaagcgcatgccggagccgcaacattgtcggtgcaatgatcccatagtatgcgcaagcatcgtggacgccggaatgatatctatgacggcattccggcgtctgcaatatctgtgtgaccttctgtgaccttgggcttaagatagggggatatcatgggtggataggcgatggtggtgccacgacaagatatgcgaaggagagatatgggcagccgcgtaacgattaaagacgtggccaaagcggctgatgtctccattaagaccgtatctaacgtgattaacaacactggaagaatgcgcccggacacgcgacaaagagtggaaggggccatgcggcaacttggatatacggttaatttgtcggcgcgtgccatccgttccggtggcaccaggctgataggcctgaatatcttcgacttttcgcagccgtttgctccgtatctagctgataaggtcattgattttgccaaggagcgccaatacggggttattatcaatacctatggctccgatggcactggcttggcagatggtattgaagagacctatcgcttgggagccgatgggtggattttctttactgaacgcgctcttgtcgatgacggtgctgcacttgaacagccatatcctgtggtaatggcaggcgattatctgtcttacggcaaaagtgatttggtgaccatgcctaacgtgtcagctgtacagcagaccgtgggcagattgcttgataccggagtcagagctattgctctattgggtgccccgccggggataactgattgggattctttgaaaagtcagaaagaaggcacccaagagttacgtacccagggctatgtacgggcgttcaaggaacgagggcttgacgtggactggcgatatgttattccggtccatggatggaatcagcatggtggtgtgcaatccactgcagcgatgcttgactcgttaccttgccctgaagcagtggtctgtctcaatgacgccatggcactaggtgccgttcatgagctacagcgtcgtggtttacgagtccctcaagacgtgcaactgataggtttcgataatgtgccggaagccgagtactcggtgccggcgctgaccaccatcgatcctcatatcgatgattatgccaagcatgccgttgacatgcttatcgaccgcatcgaaggatactcaggcccggcccgtacgtacaccaccgatttcacattggtggaacgtgcctcaactcgacttgcccactagcatccaacaagttcgcatcggcttcgtgaggagtgtgtgtctactcgaacaatgcggcgtcagtcgctgggtagccaagttggaacgcggtgtaggcgtgcttggcggccagtgcggcgaggatgagcagcgtatcgctctcggtggaagatttcgattcggtcacggccttgatctgcgcgcgggcgcagtccatttcgatggcggcggcggtcggtacggtttggccacttgccttgtcggcgatggtggtggggttggccagtagttggtcgatggcatagaccttttggcgggggtcgctttggccggaagaactggattgtgcgccggaatcatcaaaattgccgttcgccagcgcaaccaactgctgcccggcggtcttatgcatatcgctcaacgccaacgtagccccagcggtctgtcctcgtgcggccaagacctcgatagcgaatccggcgcgatcctcggccacggccatcgcatccaataccgatcggtcaacgttggcggacgtgacgccatcaagacgcgccggcgtcacctcaggcgcggactgcccgaatttatcggccagaaaagccagccattgcttggtctgcgcgtcacgtaacgttccctcggcaaaacgacccgaacaatacccggcaacgtcaatccaagccaggggagcggccagaccggtggcatactgctctaataacggcgtgccttcagccggatgggtggcgtagcccgccaacgtcatcgctttctcgcaaggggtcatttgagcttctgcctcggcccgtccggccagtcgcggcatcgaacacgccgaaagcgaacacagcatcgcgctcgcgcatagtacggatgccaagcgccgggtaaaccgtcctgaagagaagcgtgtctgcatggaaacatacactaatagctaactgtgactactcataggccatgcgccacataacttcataggaggtacggatcgatggaactggacctgacaggaatacacaagctcgccgccgagcaaggaatcgaccccgaaaccctggatgatgcgctggcagaggccctgcgcctcgcctacctcaagaccccgcacgccgccaagcacgcgcgcgtggagcttgacgaacgttccggcaacttcaccgtgtgggccgccgacgaaattccggtcgaacccaccgaagacaacccttaccccgctcccaagctgggcgaggaatacgatgacaccccgcgtgacttcggccgtctcgccgcagccaccgcacgccaggtcatcacccagctgttccgccgcgccgaagatgagaaggtattcggtgcgttctccggccagaagggcaagctcatcaccggcatcatccagcaggatgcttccgacccctccaacgtgcatgtcgcgatgggcgatgtcgaagccattctgcctcgccgtgagcaggtgcccggcgaacgttaccgccacggcgaacgcatccgcgtgtacgtggtgaacgtggcccgtggcatcaagggcccggaaatcgtggtgtcccgctcccacccggagctggtccgcaagctgttcgagcgcgaagtgccggaactggtctccggtgccgtgtccatcatggccatcgctcgtgaggccggcgcccgcaccaagatcgcggtcaaggccaacaccgatggcgtgaacccgaagggcgcgctgatcggccccggcggcgctcgcgtgcgtgccgttatggagaaccttggcccggagaagatcgacatcgtcgactactccgacgatccggccaagttcgtggcagccgcgctgtccccggctgtggccaccggcgtgcaggtgatcagcgagaagaacaagaccgccatcgccttcatccacgacgaccagctgtccctggccatcggcaaggaaggccagaacgcacgactggcagccaagctgaccggctggaagatcggcatcgaatccgccgaggcccatgccaagaaggtcgccgccgaaaaggccgcccaggctgcggccgaggctgctgctccggaagccgaataggccgccgggctcgaagacgaatgatcttcagggcgcattatttcctgatacgagccgcgtcagcaatggcgcggctcgctgcgtctacgctatccagcgctatgagtatgcttgattggcgtatgtgggctggcgcagtgtgcgcgaaatcgcccacaccagagacgaggtaacacgatcatggtcgcacgatgagacagggtaggcttgccgtcatcaccaactgaccacgcccatgcacgcgcgtggtcacagaataggagtaattagtggcgaaaccacgcgtatacgaactggctaaggttttgaatgtcgatagcaaaaccgtgcttgagaagcttaaggacatgggagaattcgtcaagtccgcttcttctacgattgaaccgccggtagcccggcgtctgaaggcagagttcgccaaggacaacgccaagggcgattccaagcccgtgcagcagcgccgcccggccgcaccttcggccccggcttccacttcatcttccgcaccgactccggccgctcccgcacgtcaggcatcgcctgcctcggcacatcagcaggctccgactccgggtgcaccgacaccgcgtccgcagggcggcgcacgccccggcatgccgacccccggccgccacggtcagaacgacaaccgtgagaatggtcgcgataatcgcgaaggccgtgagaacggtcgtcagagtcgcccgaacgatcgccgtaacaacgatcgtcgtaacaaccagggccgtccgaacaatggccagccggttcagcaccagaacaaccgcggcaatgcttcggctccgcgcccgcacgctcagggcggcgccggtgccaatggcggcaatgccgcttcaaatgcgattccgcgcccgcacgctcagggcccgcgcccgggcaacaacccgttctcccgcaagcagggtatgcacaccccgacgccgggtgatattccgcgtccgcatccgatggctcgtccgactgctgataacggtcgtggcggtcgtccgggccgtcccggccaaggccaggggcagggccgcggcttccgtggcggtcgtccgggccaaggtggtcagggcggtccgcgtcccggccagtggggccacaaccgtccgggtcagggcggcggctcccagggtgccggtcagggcggcgcacgcggcggcttccgtgggggccaaggcggcggcaataacttccagggcggcggtgcaccgagcaacggtcccgcacgtggcggcggtcgcggcggtcgcggcggtgccgcaggcgcattcgggcgtcagggcggcaagtcctcaaaggcccgtaagaaccgtctggcaaagcgccatgagtatgaggagctgaaagcaccgaccatcggcggcgttcgcatccccaacggcaacggccagaccatccgtctgcgtcagggcgcgtccctggccgatctggcggagaagatcaacgtcaaccaggccgcgctggtcaccgtgctcttccacctgggtcagatggctaccgccacccagtccttggatgaggagaccttccagattctgggcgaagagatcggctggaatatccagctcgtctccgcagaagaggaagacaaggaactgctccagcagttcgacatcaaccttgacgaggaagaactgcaggatgacgaggatctcaagcctcgcccgccggtcgttaccgtcatgggccacgtcgaccacggtaagacacgactgctggataccatccgcaagaccaacgtcatcgcacgtgaggccggcggcattacccagcgcatcggtgcctaccaggtcaccgtgaaccttgaaggcgaaccgcgcaagatcaccttcctcgatacccctggccacgaggcgttcaccgccatgcgtgcccgtggtgccgagctcactgacgtcgcgatcctcgtggtcgccgccgacgatggtgtgatgccccagaccgttgaggccatcaaccacgctcaggccgccaaggtgccgatcgtcgtggccgtcaacaagatcgatgtgcccggtgccaacccggagaaggtccgcggccagctcaccgagttcggcttggtccctgaagagtatggtggcgacaccatgttcgtcgacatctccgccaagcagaacctgcacgtcgacaagctgctcgaagccgtgctgctcacggctgacgctgagctggacctccgcgccaaccccgacatggacgcccgtggtgccaccgtcgaagcccgactcgacaagggtcgtggtgccgtggccactgtgctggttcagcagggtacgctccacgtgggcgatgccatcgtggccggcacttcgtacggccgcgtgcgtgccatgctcgacgagaacggtcagccgatggaagcggccggtccgtccacacctgttcaggtgctgggcttgacctccgtgcccaccgccggtgacctcttcctggtcgcctccgatgatcgtgccgctcgccagattgccgagaagcgtcaggccaccgagcgtgccgcccagctggccaagcgtcgcaaggtcgtctccctcgaggacttcaagaagaagttcgccgagtccgagatcgacatgctcaatattgtcatcaagggcgattcgtccggttctgtcgaggcgctcgaggattccttgatgaagatcgaggtatccgacgaggtcggcatccaggtcatccaccgcggcgtcggtgcgatcacccagaatgatgtcaacctggccacggtcgacaaggccgttatcatcggtttcaacgtgcgtccgaaccgtcaggtcgcggacctcgccgagcgcgagggcgtggagatcaagtactactcggtcatctaccgtgcgatcgaagacatcgaggcatccctcaagggcatgctcaagccggaatacgaagaggtcgtcacctctcactccgagatccgcgagatcttccgctcctccaagttcggcaacatcgccggcgttatggtgcaggacggcgaggtcaagcgtggtacgaagtgccgtatcctgcgcaacggcgtggccacggtcaacgacctcgagatctcctcgctgcgtcgcttcaaggacgacgttcagtccgtcaaggaaggctacgaggctggtatcaacctcggcaccttcaacgacattgaactcggcgacatcatcgagaccttcgagatgcgggaagtcgagcgcaagtagtcattgttaagccccctctgacgagggggctgtcagccgcagactgactgggggagagacatggtagttccatgattttctctcccccagcctcactgcgttcggcagcccctcgtcagagggggctcaagtctagaaaaggaaattcctatggcaggaaccaacccgcgcgccgcacgtattgcggccttgattcagcgtgtcgtcgcctcctccattgagcgcgaactgcatgacaagcgactcgccagcatcaccgtcaccgaagttcgtgtgaccaacgatttgcagatcgccaaggtctactggacccagctcggccacgaaggccacgaggaaggcgaacgcaagcgcgcccagcaggcactcgatcaggccaagggccacctgcgttctctggtgggccacaaggctggcctgcgcctgactccgcagctccaattcgtgttcgatgaagtgcccggcgaggctcacgagatcgaagacatactcgccgtggccaagaagcgtgatgaagaactcgcccgtgctcgcgccaccgcccagtacgccggcgacgccgatccgtacaagcatgacgacgagcccagcgacgacttcgaagacgactctgacgaggagtagtgtgcttcatacaacacccagcggtctgctcatcatcgacaagccgcaaggcgtgaccagcttcgacgccgtcgccgccgtgcgcggcgcgttgcacatcaagaaggtcggtcacgccggcacccttgaccccatggccactggcacgctggtcatcgccttcggccacgccacacgactgctcaacgccatcgtggcgcatgacaaaacctacgaggccaccatacgcctcggcctgcgcaccactaccgacgatgccgaaggcgaggtgcttgtcgatggtgaagcccgttcccgctggcaaacgctatcagcgcagctgactgagggtggccagagcggcgaaccaacggcgttaccaactgcctcatggcaagacctgctcacacgcaccatcgccaccaatttcaccggcgatatcgaacaagtccccaatacgttctccgccatcaaaatcaacggccagcgtgcctacgacttggctcgcgaaggcaaggatgtggaactcaaaccccgcccggtcaccatcagcgaattcaccgtgctggatatccgcagcggattcgtagcaggggagcaggccgctgaaccattgcgggaagacgcgaacacgggagcgattcccgcacttgatgttgacgtgcggatcagctgttcatcgggcacctatatccgcgcgctcgcccgcgatctcggcaaagaacttggcgtcggcggatacctgacccgtttgcgccgtacgcgagtcggccgattcgcgttgccggacgatgccagcggacttatcgctcctgaggcgatgcttgacacgcgaacccataccgtcaccgcacataccgatcagaagacgttcactaatcgggaagggcaaaccgtcacgcgcaacaagtgcgtattggacactcctgaaggtcttgccggtgacgagcgccgcaactggctgcttgaccatgcccttaccatggaacaggccgctcgaggtgcgatgccggcgcttgacatcactcctgaggaggccagcgaattacgcttcggccgccgtattgagcgtacaatcagcgagcccactgccgccattgtgccgcaaacgcatgatgtggcggcgattatcgagcgtgcaaacgctcatcaggccaagccggtcaccgtattccccctcgcgtaaagtagacgcggtgaaaagtgcagcttgatacaggccgcgcacaacaacgtctatattgcatgaataacatcgcacggataaaaggaacagcacactgatggatatcacgcacctgacccctgacgccgaaggttcgattgaatggccctcgttcagtaacgataagaaggccgtggtgacattgggcgcatttgatggcatgcacttgggtcatcaggcggtgatcaagcgtgtggtggaactcgcgcaccagcatgatgctttttccgtggtgattctgtttgacccgcgccccgcattcgtgcacggctgggtcatctcgcaccatggcgaagagcccgcggttcagaacgtggatgccgaagccttgaccagtgtggatgatcgactgcaccgcatggaacagttcggcgtggaccacgtgctggtggtgcactacacgctggccttcgcagctatgtcatacattttcttccttggccgactcaccggcaagctgggtatgcgcacgttggtccttgggcaggatgccgccatgggcaagggtcgagaaggtgatgtgaagcatatcgccaatcttgccgccgccaccggtgtattcgaacttgatgtggtcgatgaccgtggcccgggtgaagtgcgtattccgcgcgatttcaagccggaagccccgagcgaatggggagagcccgtcgacccgctgaccaatgccaccaaggccgagcgccgcgcatggagcaagaagaaccaggccaaggcaatgcgcgcatggagctccaccaatgtgcgctacctgctggctcatggccgaatccaggacgccaacgccattctgggtgctccgcactccatcgagggcgaagtggtgcacggtgaggagcgtggccgcaccatcggattccccaccgccaatcttggctccgacattgcaggctacattccggtcgacggcgtctatgccggttggctggtagatggtgagaaccgttggcccgccgccatctccattggcaccaaacccaccttcagcgagaaaacagggctcaacgaacgcgtggtggaggcctactgcatcactgacgaatggatcgacctgtacgaccacaaggttcgcgtcgaattcgtcggcttcctgcgcccgcaggtcaagtttgatggccccgaccaactcgtcgacgaactcaagcgcaacgtcgaggagaccaagcgtcttaccgcctgaggcatatctcagggctatttacgcactcccaaggcgtctaatgcgtcggacaatgtgttggactccaccagccgaagtccctcgacatgcaccggcttgcgcagcggaggaatgaccgccgtcgtgaaaccaaggcgcgcggcctcgcgaaggcgatattccatacgcggtaccgggcgaacctgaccggtcagggaaatctcaccaatggcgcacgtggctcgcgcaatgggttttgacgtggcggcgctcgtcagtgccgccactatcgccaagtcggaaccaggctccttggcctggcccccggcaatagtggagatatacaggtcgttggacagcaggttgagcttgctgtgacggtagagcaccgcgaccagcatggcgatacggctggggtccacgccattgaccgcacgacggggtgtgggcagcaccgacgtggtgaccagagcctgtacttcgataggcagactgcgatgcccatccaatgtgaacgtcacgcaggtgccttccacgggtgccgcgttggccgcatcagggccgtctccagacaggaacaatccggcgggatcggtgacctcttcgatgccctcaccgctcatgtcgaaacagccgacttcatcggtcgggccaaaacgattcttcaccgctcgcagcattctcagcgcagtctcgctgtcgccttcgaattggcagaccacatcgaccagatgctccaatgtgcgcgggcctgcaatcgaaccgtccttggtcacatgaccaaccagaaatactggaatgtcaagtgtcttagcggtatctatcagcgcgcttgccacttcgcgcacctgagtcgaaccgccggaaatgccatcgacctcctgcgagacgatggtctgcgccgaatccacaatggccaaggccggcttgttctgttcgatcagccccaatactgtggacaggtcggtggtggaggccagtaacaagttcggctccaccgcattgatgcgggaagcgcgcaaacgaacctgcgcctgtgattcctcgccggaaatgtacagcacggtgttggcgtgtgttgatgatgcgttgccccgcatcggcaccgtgtttgatgtgccgccctgcgctcggcccgactgttgggcagaccgctgacctgcccctcggaacgtactgtctcccgccacaacgcgcgcgatattgccggccgtctgcaacagcaatgtcgacttgccgatacccggttcgcccgctatcagcgttactgaacccggcaccacgccaccgccgagcacacggtcgaattcggaaaacccggtaccgagccgcttgacgctttccgtgcccacttcggtaatcggacgggctgcagatctggcgttgttggcaaccgtaaccgactgcgtgcgtgatgttcggccgggagcggccgtgcgagagcctgccgccggccgagcctcgtgaaattcctcgaccgtgccccactgaccacactcggggcaacggccgtaccacttcggcccgttccaaccgcattcggaacatacatactgcacacttgatttcgccatggtctcaccctaacccaaacaccagcggacggtaaatttttaccgttcacaagagtttcacgcggcttgcgcacaacgactaaaatcacggccgcctagcgtcacgcggctgtgagagaatcggggcatgactaatagtgagaactcctcgaccacgcaatcccatggcaagttgattgcagtggtggttgccgcagctgttgtgattatcctggcagtgctttcggcctttgtgtggccgggttgggccatccagaagaatgatggcacctccactaccacccaaaacagccagcagaaaaccgaatcatccgagccgaccaagccgaccatcgacgccacagctttgccggatgatgccagtgagctgttgaaggccatgccgggcagcgtgctgaattacgcgcgtaccaaggcggatgcctccacgacgtggaattccgcgtcgccgctcgaggagtacactctgacctactccactggtgatgccgccaaggatgtcacgctggtcgccgcgcagtggtcgtcggcggacaatgccaagacccagtacgatgcgttggtcgctgcgcagaccggcgatgagtcggcatccggcaacgtcaaggtttccggcaacgtcacgggcgcgtacgtggtgaaggccgatgcctccaacagcaagaacgccgttgccatctggcagaacgataccgtggtcttccaagctaccggcaccaaggaagcggtcgatcgcttctaccagaagttcccgatgtagcatctagtatcggctgtcagctgctgcacaaacttatgaacgttggggcatccacattgctgatgtggatgccccaactgcgttcagggcatatgcggactatcggcaacatactggttccctctgtctggcaacacgtgtattattgtgcgagttgcaacttttacgattaatcgaaatggaggcttcagatgggttctgtcatcaagaagcgccgcaagcggatgagcaagaagaagcaccgcaaactgctgcgtaagacccgccaccagcgtaagtagtcttacctgcaatcaaggcattagaaaccccgtgatcgttatggtcgcggggtttctcttttgcttggctctttgccttgttcgggcaacagtaaagcccgcacctgcgatgtgcagatgcgggcttggaaaagcttagtgatgtgagacgatcacttgttggcgttggtcatcacgcgcgggccgttcgggtcgccgacgatgaccttgtcgaccatgttgaggaacaggccgtgctccaccacgccgaccgtgttgatgaggtcttcggccagctcctgcgggtgatcgatgcgctccaggtgcaggtccaccacgaagttgttctcgtcggtgcgcacttccttgccgtcggcgtcaagacgaagcaccggcttgtagccgcgggcctcgaacttcttgatgacttggccggcaccgaacggaatgacctcgaccggcagcgggaacttgccgatggtgtccacaaccttggactcgtccacgatccacacgatctggttggagttggtggccacgatcttctcccacagcagagcagcgccgccgcccttgatgccgttgaagttcttgtcgacttcgtcggcgccgtcaatggtcacgtcgatgtggtccacgtcgtcgatgtccacgatcttgatgccgtagctctcggcctgggcctgcgtgcggcgagacgtggtcacgccagtgaactcaagaccttcctcctgatgacggcggccgagctcgtccaccaggaacttcacggtcgaaccagtgccgaggcctgcgatcatgccgttttcaacgagcttggcggcttcgatgccggccgccttcttcagcgcatcctgctgtgccttatccatggtttctcctttgccatccttgcctccgccgcacggatcaacggcgtgaagccttatctcctatcctaacgcgaatgagcgattttgtgtcatcgtgtccgattgcggtacatattcgtgtgtttgggtgtcagtgtcgtacgaatggtgcgttggtgatggtcaggttgccgtcgccgtccacatagccttcgatttcgatgctgcctttgatcggcatcggctgcccgttgaaatacgggctcgttttcggcgcgggggagaaggtcagcgtaccggataccgtcagcccactgggctttgcggggggtacgggttgtgttgattgtacgggttgtgttgattgtacgggttgtgttgattgtacgggttgtgttgattgtacgggttgtgttgattgtacgggttgtgttgattgtacgggttgcgttgattgtacaggttgcgttgattgtacaggttgcgttgattgtaccgctaagggtgacgaagacttggtctccggccttgcggcatccgtctgatccgtcgccgcagccggcttgcgcaaacttgccgcatccgctttgccgtccaataccaattgcacgtctggaggcacatcggtgccatgtgcgtattcggagcccagcagcgactgccagccttcaatcggtagatagccgtcgcgcgcacccgaacggcaatcgcccgcataggtgcgtgccagttcatcgaccagctcattgccttcgttgccggcgtgacctttgacccatcggaaatccaccgggccagggcgttgtgagatttcgcggtcgatcgcctgaataagctctttgttcttcacaggttttttctgtgaatttttccagccgttcttcttccagcctttgacccacttggtcgagcaattgatggcgtattgcgaatccgattcgatgagcaatggctcagggcccggatgcgctcgcaaagcttccaacactgcgcacagttcgccaatctggttggtgccgttggtcgcgccgccggcgtcgtagccgtggtcgtcgtgcttatggccaggcttgccgccggcgttctgctcatgatcggcccaggcccagcccattggcccgtttggattccctaatgcggaaccgtctgtggatactgtgatagtcatgttctccaccctaacgcaagctgtgcaatctcttgctgaagtggggctgcccagcgcgaggcaaaacaacgtagtggagggtgtggataacatcacacctattgactttgcttgaaaaacatgccatcgcgcgtgaataggtgagcgctcacaagaaaaacaagacatttcctctctgtgggtgaggccggcaacaatggcgcatccggtatctggaatgagaataagggactgtacaaaaccagtgacggcaacatcgaaatcctcaaaccagaggcggacagcgatggttcgacctccacggccgcatccaagggcaccatgcttatcgcaggcaactccaaaaccgtggcactcggtccaggcggcatggccttggctcccggcctgccgctcggtcttggctggttcatccgacgccgtttaggattggatgcctccgacattctggaccgtaagctcggcttgaagtaacggctggttcggacgtgattgctgtcacgtcctgatcatgacgacagcgcgaaggtcctcatcggtttacgtcgatgaggaccttcgcgcgcattaggggagtctgttgcgggctgcgctacgcgggtcatgctgcgcgggcgtgctatgcgaacaaactacgcgaacaagtcgttcagtgcctcggcaatcgtcggatgcgtgaacaccatatcgcgcaacgtgctggccggcgcgtcaagatccatcgccaacttgacgatattgatcacctcgtgcgactcgacggaaagcagcatcgcacccagaatgcggccagtattgcgttccacaatcgccttcatcagaccatccggtcgccgcattacctgggccttcggcacagcggccaccggcaatcgcttgaccacataatccaatccagccgccttcgcctcgcgctcattcaatcccacgcgcgagtaaggcgtggcgaggaatgtgcttgacggcacatgcttgcggtccttcaccgtgtacggacggtcggaaccattgagctgcgaccacaccacgcgatagtcatccagcgaaatgtacgtgtgctgcgggccgccgttcacatcgcccagagcccaaatgtcggctgctgtggtgcgcagaagctcgtcgactttcacggcaccgcgttcggtgagctccacgccagctgcctcaagatgcagtccctcgacgttcggcgtacgtccggtggccaccagtaccgcgtcggtggtcaggcagaatcgggcttcagccggctcggcgaaccgcggctcgccatcgtctgatggtttcgtttgaacgtgtgacatcgtggcgtgatcggtcgggttgctagtggggctggtggttgttgtagtgtcggtggcaccggtgatatcggtatgagcgttcccggtgccggcgggggtggaatcgcaagcttgcgatgcgccgcgagtcatacccttcaccgcaacggacaacctgacgccgccgtcagcagcaggcgcgatggccttggtatccgcgttgaacaggaacttgacgccctgcgcttccaactgtgcgcgaatcgcggccgccacatccgcatcctcgcgcggcaggaactcggcattgtgctgcagcacggtaaccgccgtgccgaaatcggcaaacatcgaggcaaactcaagtccaatgaatcctgaaccgataatcaccagtcgctgcggcatatcgtcgagatccatcagtccagtgctggtgtagacgccgggcgtagtgtggataccgggaatatccggaatgcgcggcgtggcaccggtattgatgaagatcttgctggcggtcacggcgaccgggccctcagcggtggcgatttccacgctatgagggccggtgaagtgagcacggccggtgattacggtgatgttgtcttggtcggcgagcttgtgatagttcttgtcgcgcagcatcgaagtgacgcggcgcttctccttgatagcagcctcgaacgctgcttcgcgggtttcgggagtactgttcgcgccatcccgccgcgcctgttcggcggacaaaatcagtgacttggacggcaagcatccgatattgatgcaggtgccgccgtacatgtcggcgcttgcctcggcgacgacgaccttgcggccggctgcactgagcttggcagccaaggttttgccgcccttgccgaatccaatgatcagggcgtcggtggtgatagtgggggaggtgctgggtgtgctgatggcattgggtgtgctgatggacatggttacttccttacgtattcgagtgataagagtgcgttgtgctgatgtgttgtgtgccgtgcggcgtctgttttcttctttgactgccgaagcgttatcgactgatgctggctaggggaaacgcgcgggattattagcctttgcgctcgctgaatatctgttcggtgatgtcgtggatggtggtgtgttcgagttgttcgaggcaagtgcggttgagcccggcatagatgtcgttcatcactgcgcccattgaagatgacaccagacagtcctcgtgtacgtcgcccggtgtccagttcactttcacaaaagtggtgccggtggcttccgctaccgcgcgcaaagtgatttcggcggcgggccgggccagagcgtacccgccttcagcaccctctttagtggcgatgagtccggctgaggcgagcggtcgcattactttgcgcacgcgcgccgcattggtacatatgttctcggccaggatctgactgggcaggtgtgtggcgcgatggtcaaggtagaccaatgcgtgcactgccagtgaatggtcgccgttcatgaaacgacctccttaccgagtcgatactgtagctatgatgtgtacagttatgatactgtaatcatatcagatacagttagtgtgtcaaatcggggttgaagaggtgggtgactatgtgtataagtgaggtgtccacatggttatccacaatgaatgtgcgtaagtgaagctaggaccacatacctcggatcggcttccgtttccgcacccactacccatatggtggtgtcatgaacaggatgaccgacggcatcaccaactatggagctctgccaggctctatatacgatcagcctccggaagaatcggaggcagtttttgttccgcccgaatttgcggggtcattttctactgactcgaaatacccgacttctcgcgactcgtcatcgccgaacagtggtgcacatgattctgcagcgacaccgaccatgagcgaaagcctcgcccagcgcaaacgcgacatggtcgcacgctgcactgaggaagcgaaacgggcgggcaagaagctgcttttcggcatgaccacttccctcgctctgcaatccgtaccgattcccgccgattgcgacctcgactcggccaagctgcacactgtatccagcgttaagagcaagcggtttcgtacacgccatgcaccactgcaaacgcatatttggaaacatgcggctaaagccgccaatgtggaaatgaaccaacacgtgtttgcgctggacctgtttcacgtatgggctcaacttgccccgtatgtttcttttgagtccctgattgtgctcggggatgccgtcatcgctgctacgagcaaacagccagtattggccaaggatcgtgatgctgctgcaatctatcaggatctggtgaggttcgtggagcgatttacccgattcagagggcgcccgtcctgcgttcgagcattgccgctgatatcacctggtgctgattcgcccaaagaatcagaagaacgactctctctggtagcgcatgggattccacagccggttgcgaactatgtggtgccggatgcggcttttgcatctggagctcccataacgttggacttagcgtggccagagttcaaggtcgctgttgaatatgatggcgatcatcatcgtacgagtaaggctcaatggcgccgtgaccaagagaaaaggggtgtgctggtcgggcggagatggctggtcttcgtcgccacggcggcaagtatcgctaacgaggacgctcgtgctgaattcgctttcaacgtggcgagggcgcttgcttcgcgcggtgccgtattcgagtttcatgtagttgccatgtctcttgaagagttgtcgcagagcctgctgtgaccatgatgtccgaaatggactgatgtaaaggcaatatttgtacgacctgttgttgtggtgtgtgcttgatattgcatgccgttcgattgcgatgcctcgtagtgatggatttcgtgaatgactagtgttcgattgtggagggaaatgtgtcatagtggtcgattgggggggcggtgcattgggcgtggatttgcgccaatgggtgtgggacgctacgcgtgttttgccgatttttgcgtggcgtcccacggcccctcgggtaatggctgtgacgggtgtggcaggaatggcgtctttccggggtttccagtttgagtgtgtgggatggggaaaatgtaaaacgattgacttagctgttgtcccacgcttttgtgggatggcaactctggaatgggcaaattcgtcgtggcgtcccacaacgatgttaaaactcgaccatgatgcaagccgaccgaacgcttcggtggtcatctggccgctgtgaccccacaatgatgatgggaaactcggtcataatgtaggcaggcgaacgtttcgcggccatatggccgtcctgccctgcagtgatgttgagaaaatgcggtcacggtgcatgaggagaaccgttgacctgcgtgtttcagtggtcgcgaactgcatatgcgctaaaaaaagctctgcagtggattgcatgaatccaatgcagagccttattggttgctgtgaacgcggctaacgcagcgatttcactcgctcagggccttgtctaccacgacggtggcctcgtcgagcaccttgtccagagcctcgggggagacgaaggactcggcgtacaccttgtagatgttctcggtgccggaggggcgggcggcgaaccagttgtccttggtggtgaccttcagaccgccgatcttggcgtggttgcccggtgcctcggtcagcttggcggtgatgtcttcgccagccagctgcgtggcggccacatcatcaccggtcagcttggcgaacttggccttctgctccagcgtggtcggggtgtcgacgcgcttgtaccaagactcgccgaagcgctcgacctgctcctggtgaagctgggccgggttcttgccggtcttggcggtgatctcggcagccagcaggtcggggatcagaccatccttatcggtggtccacacgcggccgtccttgcgcaggaagctcatgccggagctctcctcgccgccgaaggcgacttcgccgctgaacagcgggtccacgaaccacttgaagcccaccggcacttcgatgaccttcgcgttgatcgatgcggccacgcggtcgatcagggaagaggagaccagcgtcttgcccacggctgcgccctcaggccagcccggacggttgccgccgaacaggtactccacgcacacggcgatgtagtggttcgggttcatcacgccccagttcgggcagacgatgccgtgacggtcggcgtccgggtcggtgccgccgaccagatcgtacttgtcccaagcgccggcgttgagctcgtcgaccaggcccttcatggcgtacggggaagacgggtccatgcggatcttgccgtcgtggtcgatggtcatgaagcgccaggtcgggtcgacctcaggacgcaccacgccgatgttcaggccgtacttctcgttgatgagcggccagtagttcacggaagcgccgccgagcggatcgatgcccagacgcacgccggagttgcggatcacgtcgaagtcgatgacgttctccaggtcgtccacgtagtgctcgcggaagtcgaagccctcgacgtactcggacttgatggcctcctcgtagggcacacgcttgatggacttgaagttgccgagcagctcgttggcgcgagcggcgatggcattggtggtctcggccggagccgggccgccggtgacggggtcgtacttgaagccaccgtcggtgggcgggttgtgggacggcgtgacgacgatgccgtcggcgaggccctcgccctcgaagcgctgggtgccgtcggccgcacggttgtgggtcaggatggcctgggagaccaccggggtgggcacgaagtcgtcacgggaatcgacgcgcacgtgcacgccgttggcgacgagcacctcgatggcggtcttcttggccgggccggacagcgcgtgggtgtcggagccgaggtacagcgggccggtgacgccggccttcttgcggtattcggcgatggcctgggagatggcgatgatgtgggcctcgttgaacgaggtcttcagggacgatccgcggtggccggaggtgccgaagatgacacgctgctcggggacttcgggatcggggacgaggtcatagtatttgccgataacctcatcgacattgatcagatctgctggggtggcgggctgacccgcattgtttgctaccatgctccctattctgccacgttttttcgccacgttgggtacgattatgttaagagttgtcaacttttgtgcgaatcgtgtgccggttgtctagcgcttggtcatttcctcctcgatttcctccagcgacttgccgttggtctcgggcaccaagcgcatcacgaacgggatggacagggccgaaaacacgccgaaaatcgcgaacgggccgcccacattgttgccgaacgcatcgagcagcacgaggaagaactgggagacgatgaagttgcccagccagttcgccgccgagccgaaggaggagccgatgccgcgcacgctcagcgggaagatctcgccgataagcacccaggcgatcgggccccacgagaccgcaaagccgaggatatagaaagcgatgagaatcatcgtcggcacggccagcacggccacgtcgcccacgaagttcatcacggcgagtactgcgagcgaaacggtcatcacgatggaaccgaagatcagcacgcccttgcgcgggaagcgatccatgataagcgtggccacgatggtgctcacgaagttcaccacgccgatgcccaccgacacccagattgcgtcgccttcagggaagccgaagcctttgatgaacacctgcggcaggaagtagatcaccgagttgatgcccacgagctgctggaacagcatgatgccaatggcggccaccagcgccggacgagcgatacggaacagttcgcgcacgccacccttggtgtcctgtgcggccacggccttgatttcgtccagctcaatctgcacctgggtctgatccacgtccttgcgaatcagcgtaagcactttgaaggcgttgcaggtgtcgcccttgttcaccagataacgcggggattcgggcagcagcaggccgccgagcagcaacaaggcggccggcaccagcgccgaaccgagcatccagcgccagtcgcggatgccgaagaggttgtggttcaggaatccgaggttggaggcgtaggccagcagaatgccgaaggtgaccatgagctggaagagcgtggacagcgagccgcgacgctccttcggcgccagttcggccaagtacgccggggtcagggcagaagccgcgccgaccgcgaggcccaggatgatgcgggcgcacaccatcatcgcgaatccggtggaggaggcgcacaggcctgagccgagcaggaacagcagcgcggagacgatgagcagcttcttgcggccgaaccggtcagacagcgcgccgatcgacaacgcgcctgcgcacgagccgatcagcaccgaggaggtgatgaagccggtctgggagacgctcaggccgaagtctgattcgataagcggggaggcgccggagataatgccggtgtcgaaaccgaacagcatgccgccgagcgcgccgaaggtgaagatgaatgcgctgttgagcgggaagcgcgtggagaagccgcgtgattcggcggcttcgaggtcctcgattgcgtttgctgccgcgtttgtggccgcgtccgccacctcggccacgccggtttcgatggtttcgattgcggtggccgctgcaccggttgcgccggtctcctgtgccgcggatgccgtctgcttcgatacgggtgatgccgttgtcgtcgtcattgccttgtcctttcgccgttgacgggccgcgcctgccgcgtggcccctctgccgcatgcaaggtcaggcttcgattgcctgaagtcgcccgaaaacaaaaaaagacctggaacaacgtggaattcgcatattacgatacgcaaattccacgtcactccaggtcttgcctcattttgagtaacaaccctgctacgcaacgtgtgtgaaagataggatacgactttctcggtcgcgacactccgaataggcggcaaaaaacgatgttttttgacaacgattgcaggattctgcatggtggaatgaagtcggaatgggcgctgcggcaaatacggagaacgggtgcggcggaacaccatagcggaacgctatcgcggagcaccgtagcgcatagttgccgtttcgcgatgctttgccggcattgccgtgcttttggggcacccagcgccgataatggaacacagtggcatacggcagcaaggaggaaccgtggcgaacgcatcgaacgcaacgcctgcagtgattgcggcgtgcatcgttgatgccgtcggcggctccgcgaacatcaccaacctgacccattgcgccacgcgactgcacttcgaactggacgacgccggccaggtcagccagcacggtctcgaatccatccccggagtcctcggcgcattcccgcgaaccggcaatcgttatcaggtcatcatcggcggagcggtcgcctcggtgtacgagcagatcgttcggatgcaggcagcgcgattgactccggcaacgcaattaccatcggcggcgtcgcggccaacgcagtccgcgcaatccactcagtcaacgcaatccactcagtcaacgcaatccactcagcctacgcagcctacgcagtccgcgccgaacctttccgacgacgtcgcaccattgcgcgataccgacaccgagcagagtcacggcccagccaatacatcccgtcacttcatgcctcgtaccatccgcgagtggggcagtgccgcccgtgcccgggctgccgcgtttttcgactacctgtccgactcgttccgcccgattctgggcgtgctactcggtgcctcgctggtcatcgccatcgtcaacgtgatcgttgcactcggcattgtgcctgatggcgagacgtccaccggttggatactactcaaggcgatttgggagggtgtgttcaccgttctgccgattatgatcgcttacaatgcggccaagaaactggacgtcgacccttggctcggcggtgcgattatggccgcgcttatgaccccgcagcttactggcgtgatgtccggaatgtccgggacgtccgtatccagcgctctctccggggagattcaatgctcggccaccgccgtattcggcgccgaaacctgcaccgtgtcggcgttcggcataccgattcaactcaacgactacagtggcaacatcttcgtaccattgctcatggccgccgtgctcgccgtggtctaccgcgggctgaagcgcgtcattcccgacagcgtacagctggtgttcgtgccattcctctcactggtcgtcgtttttgcgctcaccatactggttatcgggcctctgggaatatggctcggcagcgggctgggagcggccacagcatggcttaacgcgcacgtgccattcctgttcgcgctcatcatcccgatgctctacccgtttctcgtgccgctcggtctgcactggccgttgaacgccctgatactgatgaacattcagacgctcggctacgacttcgtccaaggtccgatgggtgtatggaacttcgcctgcttcggtgccaccgccggcgtgctcgtgctggccgtacgcggcaaggattcggccatgcggcagaccgcggtgggggcgttgctcgcgggattgctgggtggcgtttcggaactgagcctgtacggcatccatctgcatcaccgccgcgtctaccgctggctgctcgccggctgcgcggccggcggagtgaccagcgcggtgttcggctggctgttcccgtccgtgctgccatccggccagatggtccggggcgttacgactacggcattcgccttctcctcgttgctgacgattccggtgttcgatcggatgtgggtgtacgcgctgtccatcgccgttgcgtttgtaatggcgatggtgttgacggtgttgttcgggtaccgcacgccgtcgcgcgccaccaagacgcagatggtctcggcaaacgagaacgcacgcccgcaggatatggcgagggggattgacacgaccgtgtcggatgtggagtctgcggaagattctccatcgcgggctgcccctgatcgggctcttgactccaacgccatcttgtcgccggtcgccggccggctggtgaatctggaagcgactggcgatccggtgttcgcctcccgcgcgctgggggagggcgtaggcgtcgtgccggagacgaccggtgagacagccgtgctcgcaccggtcagtggcatgctgaaaaccgtggcccgaaccggccatgccttcggcattaaaaccgatggcggcatcgaggtgctggttcatatcggcattgacaccgtcgatatggatggcgagggattcgctgtggtcgtggctaaaggcgagcggatcgcggcgggagagccactggccaccgtggatttcggcaaagtcgcggcggccgggcacagcgttgtggtggtggtgacggtggtcaacgccgctgaactgaccgtggtcacgccgttgatcggcgacggtagcggcgacaacaacggcggtgactgcaaaaccgtatcagccggcagcccgatcatcgatgtggaacaatgacgttgcgaaaggatgccatggaaatactgcgagtgttcaacaacaacgtcgtgctcgccaaaggcggcgacggcggtgaggtgattctcaccggccgtggactggggttccaggccaagccggggcagacggtcgacgagtcgaaagtcgtgcgcaccttcgtgccgtcggacgggcgtgacccggaccatctggcgcagatgctggcggacattccgcccgaaatcatccgcgtggtcgtcgaatccatgcaggaagccggactgggggagcgtgagaccggcagcaccacgctggtcatggccttgtcggatcacgtggcgaatgcggtggagcgggtgcggcgcggcatcgacattacctacccgctgctcggcgaggtgagcaacctgtacccgcaggaatacgcgcaggggcgtgcgatgctcgcatcgctcaatgcgcggctcgacgtcacgctgccggacggcgaggccaccgcgcttgccatgcatctggtcaacgccggcttcgccaccggcgacctgtcctatacgtatacgatgacgggcgtgatccagcaactgcttgacattatcgaccacagctacggcatcacgttggaccgcagttccgtgaatgtgggcaggttcatcacccatctgcgttacctgttcgtacgcatccaccagcaccagcaactgacggatgagccggcaccggtgatgaaggtgattcgtgagtcctatcccgccgcgctacgatgcgcgcgaaccatcgcctccctgctcgaactgcgcctcgacacggatatcagcgacgacgaaaccgcctatctggcaatgcacgtcgcccgagtcaccggccacgcatcgtagcggatcagcgaatcggctcgagcgtgccggtcatttcggcgaaatccgaggtggcgtttgaggcagcggcctgtgcggtcttttccagcgcggaggcgtcgggtacgcgcacgatcagcgcgcgatgatccactgagaaacgaatatgtttggtctccggtagcatgtcgccgtccacctgcgctttggccggcttttccaatgtgatttcggcactgacgccctgaacctgttcgatggtcgagttcgtggacagcgggttctgttcgggcttgccgatgatcgtctggtgcaccacgtcgccgaacaggttggcccagccgaggatgccgccggtggtgtcgatgatttcgaagtccagcagaccatcgtcataggatgccgccggcatcagcgagaacatgggaatctggccgcagttgccggccatcaccgtgcggaaatcgagattcttgatggtgtgggtcgagccgtcggcgctggtgactgtcagcgtgccgcggaacttcggcgcgaacaggttcttcacgccgcccacgaagtaggcgagccagctgatgttcgccttgagctcggggttggtgtcgtcgatcatggccgcatcgaagccgatgccggcgatgatgaggaaggcgtggccgtggtcgtcctccgggtggtcgagcagggtgagacggcccatgtccaccaggcgggagccgtgggaggtggccacggtcagcgcggcgtcgatatcgtccacgggaacgcccatattgcgggcaaacaggttgccggtgccgatggggatgatgcccagcgcatggccggtgccggagacggcgctcgccaccgtgcgcaccgtgccgtcgccgccgaccgcgatcaccacgtcggcgccgtcctccagcgcctcaagcgcgcagaccctgccgtccttgtcaagctgggtgtcgtagaagcggatgcgattgagccccttggcctcgcagaacctctggatatgcagcctgcgggcttcggcctgcggtttggacggattcacgatgaaggcgtactgcacctcgtcgtcccggcgcttctccagcgtctgagccagcttgcggcggcgctgcgcgcgcagagcgatgacgatgacggcgatgagcaccaccacaatggcgattgcggcgatgatcagaaacacggtgagggcaggctgaggcatggctcctattgttatcggtggggaggtcgtttgcggccatggtgcgccgtacgtgaacatttcctgcacgcaacagccccgtggggcgtgattatggttcaatcgcgtctcatctgacgaaattggccgggtggacccgtccgcggactttcccgggcttccctgtgatttccgcgtgactcccgcgcattcggccattgtcggtgtctgcttacgcggctagtctggtgcccatgcttgatattcaattcatccgtgaacacaccgatatcgtcaaggaatcccagcgcaagcgcggcgagtccgtggagctcgtcgacgaagtgctctcctccgacactgcacgtcgtgaggcgctgaaggccttcgaagaggctcgcgcccagcagaaggaaatcggcaagaaagtcgcctccgccccggcggacgagaaggccaagctcatcgccgaaaccaaggaactgtcccagaaggtctccgaatacaagtccaaggccgattccgcagccgaggaatacaccaccgccatgtggaagctctccaacatcgtggagcccgaagctcccgaaggcggcgaggatgactacgtggtcgtcaagaaggttggccagattcgcgacttcgcggccgaaggcttcgagcccaaggaccacctgaccctcggcaccggcgtggccggcatcgatatgcgccgcggcgtcaaggtcggcggctcccgcttctatttcctgcgtggccaggtggcccgcatgcagattgccatgctcaccatggccgtggaccaggccgaagagcacggcttcacgctggccatcaccccgacgctcgtgcgccccgaggtcatgcgcggcaccggcttcctgaactcccacgccgacgagatctaccgtctgcgcgagcccgatgaccagtacctggtcggcacttccgaagtggcgctcgccggcatgcacgagaacgagatcctcgacctcggcaacggcccgctgcgctactgcggttggtcctcctgctaccgccgcgaggccggtgccgcaggcaaggatacttccggcatcatccgcgtccaccagttcgacaaggtggagatgttcgtttacgccaagcaggaggactcctacaaggagcacgagcacctgctggccatggaacaggagatgctcgccaaggtcgaggtgccctaccgcatcatcgataccgccgccggcgacctcggttcctccgccgcccgtaagttcgactgcgaggcttgggtgccgacccagggccgttaccgcgagctcacctccacctcgaactgcaccgagtaccaggctcgccgcctgaacatccgcgagcgtatggaagacggcggcacccgcccggtctccaccctgaacggcacgctggccaccacccgttggctggtcgctatcatggagaaccaccagcagaaggacggctccatcgagatcccgaaggccatgcgcgcctacatgggcggcaaggaagttatcgagcccacgaagtgggaggcctgagtctcatcgtgctttagctccctctgatgagggagctgtcagcgtagctgactgagggagagattactgagggagagatcgctgatagccagcaggcgaatccaagaccgaccgcactgccgaatatcaacatccctcccttctgtataatgaatacttgcgcgtgtgaacgcgcatcaggacaggtgtctgagcggcctaaagagacggtcttgaaaaccgttgaggggcaaccctccgcgagttcgaatctcgccctgtccgcgaaccgaggcctgggcaacatgcccaggcccttttttctttttctggaacctgtcttcttgattgccgccggggtgctgatatattggtttgtgatgccgtaacatgcggtgtccccgttgatatgacgggccgatcggcgtgagccgataagaaaaggcccgacgtttgcagcatcgggcctttgcgttgattaccggcttgcgcctttaatcaacaaggttgcaagatgaatcatatcacgatgcacggtagtctgaccgtgaacgggcgcaccgtgatcgtccatatgggcgatggcgaggcgaacgccacggttgacggcacgcacttcaacgtgcgtagcctgtggcagctctaccagttgctgagactgctcgtgtagcgtctcattaaggtgcggtgcccccctggtcgggtatcgcgccggcgacctgaaaaccgataatgttggcaagtgcttgcaatttgcggtggacgattgcaagctaacgtcttggattgttgccgctatccaatatctcattaggcctaccggtggaccaaaagtacgttgctttgtaaggggagttaatgaaatgaacaaactcgcacaatcgagcatcgaaccggtttaatgctactcgcctcaacgggacgcgcggtaattgttagctaagttgacaataaaagaatgagggcatacattagtaatcagtcatcacactgagatgatgatttcactacgaaggagtagagatatggtatctcgcaataagcgcatcgtggctgcttttgccgcggtagcagcaatgggaatgggcttggccggttgcggcagcgacactgccggcgacacgaagaccaccgatgatggtggcgtggtcaacatcacctacatgcaccgtctgccggattccgagggcatgactctggtcaacgacatcgttgccaagtggaataagcagcatccggatattcaggtcaaggccaccaagttcgatggtaaggcctctgacatgatcaagaagcttgagaccgacgtcaagtccggcgaggctccggatctggctcaggtcggttacgccgagctgcctgaggtcttcaccaagggtctgctgcaggatgtgacccagtatgccgagcagtacaagaacgacttcgcatccggcccgtacagcctggttcaggttggcggcaaggcttacggcctgccgcaggacaccggcccgctggtttacttctacaacaaggctgagttcgagaagctcggcatcaccgagattccgcagaccgccgatgagtttatcgccgctgccaagaccgctgccgccgctggcaagtacatcatgtcctaccagcctgatgaggccggcaacatgatctccggtctggctggcgcctccggtggttggtacaaggtgaagggcgactcctgggtcgtcaacaccgagaccgatggctccaaggcaaccgctgacttctaccagcagctgctcgacgccaaggcagccaccaccaacccgcgttgggatccgtccttcgatgcatccatcaaggatggctcgttgatcggcactgtggccgccgcttgggaagccccgctgttcatgacctcctccggtggcaccggctccggcgaatggcaggtcgctcagctcggtgactggttcggcaacgctggcaagaccggccctgacggtggttccgccgtggccgtgctgaagaactccaagcacccgaaggaagcaatggagttcctggattggttcaacacccaggttcctgatctggtttcccagggcctcgtgccggctgctaccactgaagacgctgagactccttccgagtggtccaccttcttcggtggtcaggacatcatgaaggaattcaagaccgctaacaacaacatgggtgacttcacctacatgcctggcttctccgcagtcgccgccaagatgaacgaaaccgccgccaaggccaccgatggctccggcaaggttgcagacatcttctccgacgcacagaccacctctgtggatacgctgaagaacttcggcctgtctgtttccgagtgacattaacggttagggttccttccagccgctgatatcctcaaccacacatcgaaaggccggagctcaacactccggcctttccttttactcgagttcggttcgtcattaattgtgtttgatctgactgcatcgattcgaactgcattacgtactttctatttctcactgttcttttgaaagacaggtttccctatgactgcaacaacaaaaacggcgaagacgggggtcgccaggcgtgccgataagccaaaggcttctgatgctgtgaagcgtgagaatcgtaccggctgggccttcatggcaccgtttggcatcctgttcgctctggtatttattcttcccatcatttgggctatttattccagcttcttccgccaggtcaccacgggcggtggcgcatacggcggcggggaactggtcgataagttcgtcggacttcagaacttccaatacgttattacttccggcaacttctgggctggcgtgggcagggtagtgctctacaccgtgattcaggtgccggtcatgatcatcgcggcacttgctctggcaatgctcatcgattcctatatcgtcaagcacatcaccgcattccgtctgagctacttcctgccgtacgccattccgggcgtggtcgcatccatcatctgggtgtacctctacaacggccagatttcccctatcgttaagggacttgccgccatcggcatcaaggtgaacttcttcggcgacaatgtggtcctcggctctatggccaacatcacgacctggaccttcaccggctacaacatgctgatcttcctcgccgcactgcaggccattccgcacgatctgtacgaggccgcacgcatcgatggcgccagtggcttccagatcgccatgaagatcaagctgccgaacgtgcgtgcagccgccctgcttgccatgctgctctccatcgtcggcaccatccagctgttcaacgagccgcaggtgatgtcgatttccgatccgagcatttccaagtcgtacacgccaatgatgatggccctcaatacctcgcagggcacgctgaccccgggtggtgacggacctgcatccgctgtggccatcgttatggcactgatcgctggcgtactcgccgtggtctacacgctcgttgaaaggaaggtgaacgcagaatgagcaccgtagaagctactgataaggaatcccgcgcggtcgcacgcgctcgtaagaaggctgacaggattcgcgacaagcatgccaacgacctgcctcgttccatgcagccttccgcgctggtcaagaccatcaccatcgttgttctggtcttcgcgctgatctactttctgttcccgatttactgggccatcatcgcctcgaccaagacgccgagccagatgaccggcagcaacggtctgtggttcgccgtgggtctgagcgatttgcctgccgccatcgccaagaactatggcacgctgattggttggacccgtggccagttctggcgctgggtgctgaactccctgatctactcgggtgtttccgctctggtgggtacgctcgtggctgtgatggcgggatacgctaccgcaaagttcaacttcaagggtaagaaccttgccattggcgtgattatgggctgcatgctgatgccggccgctctgctgaccattccgcagtactccatcttccatgccatgcacctgaccaacacgatgctctccatcatcatcccgtgctgcgtctctccgttcggcttcttcctgggccgcgtatacgcgcagacctcagtgccgaacgagctgcttgaggcggcgcgtatcgatggtgcaagcgaagctcgcatcttcttcaccattgtgttgaggattctggctccggcaatggtcacgatcttcctgttcctgttcgtggccacttggaacaacttcctgctgccgttgatgatggtctcttccgacaccttgaagccggtgaccttgggtctgtacggcatggtctctctggctaccttcactgatcgtggcgctctgatgatgggtgctctgctcggtgtgctgcctgtgatcgtgctcttcctcggtctccagcgctactggcaggccggcctcgccgctggtgcggtcaagggctgacgcgttaagcggacagcccggtgggctgtctgtagcgtcggcccgagcgaggcggtagccgagcgaaggcagcattgagtctcgccgtaggcgagtccttaattgcaggggccgaaggcgacgcgttaagcggacagcctaagaccaataattcccgccgtccggtgcctcgtgctactccttccggcgccggacggcttctcaacaataagtagcacgcaaccataccgatccagagccttcctgattcttgtcatgagattgtcggtgaaactgaccgggaagctccggtgatgttcaattcgctcttccggcgttgccgtggggctactctcaaggatttatacagtcaggatcctggacgcccgacggttgtgtcggattcttgttttatatgcatatattgtttacaatttaattatccaaaaaaataatcaatgtcctcaaaggagagactatgactagcaccggccgcttcaccttgcctagcgaggagaattttgcggagaagaccaaggagcttgccgaactgtggggagcggacgccattcgtaactccgatggcacgcatctggatgaggctgtgcttgccttgggcaagaagatttacagtgcgtatttcccgactcgcgcgcataacgagtggattacgctgcatatggatgagacgccacaggtgtatctgctgaccgatcgcattctcgccgaatcggatacggttgatattccgctgatggaaagcttcttcgctgagcagctgaagccgaatcgtgatgccgaccctcacaagtattgggaggttgtagaccgcaccaccggcgaggtcgtcgattcggcgaactggacgcttgacgcggacgaggacaccgtgcatgtgagcggcgttgccgcatggcatgagtacacggtgagtttcctggcctacatcatctgggacccggtcgagatgtacaaccatctgaccaacgactggggcgacaaggaacacgagatcccgttcgacatctaccatccggccacccgcaagttcgtgttcgacacgttcgagcagtggcttaaggacagcccgcagaccgatgtggtgcgattcaccacgttcttctaccagttcacgctcctgttcgatgaaaagcgccgcgaaaaggtcgtcgactggtttggttgcgcctgcaccgtaagcccgcgtgcgctggatgatttcgaagccaagtacggctaccgcctgcgcccggaggacttcgtggacggcggtgcctacaactccgcatggcgcgtgcccagaaaagcccagcgcgactggatcgacttcctctccggcttcgtgcgcgaaaacgtcaagcagctcgccgacatgtcccacgccgccggcaaagaggcgatgatgttcctcggcgaccagtggatcggcaccgaaccgtacaaggacggattcgacgaactcggcctggacgccgtggtcggttccatcggcgacggcaccaccacccgcatgatcgccgatattccgggcgtcaagtacaccgaaggccgcttcctgccgtacttcttccccgacacgttctacgagggcaacgatccgagcatcgaaggcctcgacaactggcgcaaggcccgccgcgcgatcctgcgctcgccgatcagccgcatgggctacggcggctacctctccctggccgccaagttcccgaagttcgtggacacggtgacccatatcgccaacgaattccgcgacatccacgaccgcaccggtggggtggccgccgaaggtgagctcaacgtggcgattctgaattcctggggcaagatgcgctcctggatggcgttcaccgtggcacacgccctgcccaacaagcagacctactcctactacggcattctggaatccctgtccggcatgcgcgtgaacgtgcggttcatcagcttcgacgacgtactcgcgcatggcatcgatagcgatatcgacgtaatcatcaacggcggcccggtcgacaccgcattcaccggcggcgacgtgtggaccaacccgaagctcgtggaaaccgtgcgcgcctgggtgcgtggcggcggcgcgttcgtgggcgtgggcgagccgagctcggcaccgcgcttccaaacgggccggttcttccagctggccgacgtgattggcgtggacgaggagcgctatcagaccctttcggtggacaagtatttcccgccggtggtgccggaccacttcatcaccgccgatgtgccggtcgacccggcggcccgcgaggcttgggagcaggccggctaccgcatcccgctgagcggctgcggcggcggccagtccatcaagccgttgggcggcatcgatttcggcgaacccgtgctcaacacgtatccggtcaatggaaacgtgaccctgctgcgcgcggacggcggccaggtacagctcgcgaccaacgattatggcaagggccgcggcgtgtacatctccggcctgccctattcggcggccaacgcccgactgctggaacgcgtgctgttctacgcttcccacaacgaagacaagtatgcggcctggagctcgtccaatccggaatgcgaagtggcgcacttccccgagcaagggctgtattgcgtaatcaacaacaccgatcagccgcagaagaccacggtgactttggccgacggtaccaccgaggacttcgacctgcctgacagcggtatcgcctggcgtgaagcctgatcccgcgttttggagaacggacccatcatgactgaaagcaatgaagttttattcggcatcgcctcgcattttgcgctggaaggtgccgtgaccggtatcgaaccttacggagacggccacatcaacaccacctatctggtgaccacggacggcccccgctacatcctccagcagatgaacaccagcatcttccccgatacggtgaatctgatgcgcaatgtcgaactggtcacctccactctcaaggctcagggcaaagagacgctggacattgtgcccaccacctcaggcgccacctgggccgagatcgatggtggcgcatggcgcgtctacaagttcatcgaacacaccgtgtcctacaacctcgtgccgaacccggacgtgttccgcgaagccggcagcgcattcggcgacttccagaacttcctgtccgaattcgacgccagccagctgaccgaaaccatcgcccacttccacgacaccccgcatcgtttcgaggacttcaaggccgccctcgccgcggacaagctcggccgcgccgccgcatgccagccggaaatcgacttctatctgagtcacgccgaccagtatgccgtcgtgatggatgggctcagggacggttcgattccgctgcgcgtgacccacaatgacaccaagctcaacaacatcctcatggacgccaccaccggcaaggcgcgtgcgatcatcgatctcgacaccatcatgcccggctccatgctgttcgacttcggcgattccatacgctttggtgcgtccactgctctggaagacgaaaaggacctcagcaaggtgcatttcagcaccgagctgttccgcgcctacacggaaggcttcgtgggcgaactacgcggcagcatcaccgcgcgcgaggccgaactgctgccgttcagcggcaacctgctcaccatggaatgcggcatgcgctttctcgccgactacttggaaggcgatatctactttgccaccaagtaccccgagcataatctggtgcgcacccgcacccagatcaaactcgtgcaggagatggagcagaaggccagcgaaacccgcgccatcgtagccgacatcatggaggctgccaggtgagccgtcagccgaaccatacccgaaccagcatgatggaggcagagcaatgaacgatcagctgaccgaggtatacgccagcatcgacgccctgatcgattatgccttggcccatcttgaccttgacccacgcaacgcagactggacccgcaaccaaatcttcgccctcttccgcctagattcctaccccggacccaaaaccacaacgtcggcggcgtcagtgtcagacgtagtccaagacattgttggcagccgaagccaggccccctatggcgaaaagacccccgaccccctgctcgccgccttccgcgccgccgccacaaccgccggccttttcaagccggaggaaggcccggcctacgccgacaccatcatgggcatcctctccgccaaccccgctgatctcgacgaccgattcctgctcgtcgagcaccgggatggcggcatggccgccatgcaatggttctacgactactgtgtggccaacaattatgtcaagcgtgcccagctcgaccggaacccgcgcttcgactcgcacgggctgacggtgaccatcaacctcgccaaacccgaattcaagaacatgaagaaggcggcggccggcaacgccgtggccggcggctacccgaagtgcacgatctgccatgagaacgagggcttcgccggacgtgacaagcgcacgctgcgcaccttgccggtcacgctcggcggcgagtcatggttctggcagttctcgccctacggctacttcgaccagcacggcatctgcgtgaacaccgaccacacgccgatgcatgtggaccgcgacaccttcggccatctgctcgacttcgtggaccgtttccccggatacttcctcggatgcaacgccgcgctgcctcgcatcggcggctcggtgctcgcccatgaccattaccagggcggcggcgaactgctgccgatgcacaaggccgccacttgggccgccttcacacttgccgactatccggacgccgtggttgaaatccttgactggcccggcaccgccgtgcgcgtggtgtcgaagagtcgccagagcatcatcgacgtatccgacatcatccgcgaggcatgggtcggttatgacgacgcggcgaacggcatcgccagccatgacgcggatggcaaccgccaatccgccctctcgcccagcgcgatcatcaccgaacgcggctatgagatgagtctcatcttccgcaacaatgcgatcagcgacgagtacccggaaggtattttccatgcacaccccgaatactggccggtcaagcaggagccgatcggactgatcgaagcccaaggcctgttcatcctgcccggacggctcgtcgaccagctcggcatcgtcgaggaggcgctcgccgaaggccgcgatttgcccgatgaagtcagcgaattcagtctcgaatggggcgaactcgctgaaacattggccggaaaccgcgaccgcgaggccatccaccaagccgtacgtgacgagctcggcagcgtctgctaccgcatcctcggcaacacggccgtcttcaagcagaaagccaccacgcaaacattcctcgaaagccttggttttgccgctaggtgaaacaggtcaagtgaagtaagctcaatactgaaggaaaaaccgaaggcaagtccttccaaaggagggaatatgactactgttctggttacgggcggtgctggattcatcgccacccacaccgacatcgaactgctcaacaagggctacgacgttatttccgtagataactacggcaactcgtcgcccgtggcgcttgagcgcgtcgagcaaatcaccggcaagccggtcaagcgttatgacggcgacgtgcgcgatgaggcgctcatggaacgcgtcttcgctgaaaacaacatcgactgggtcatccacttcgccggtctcaaggccgtgggcgagtccgtggccaagccgatcgaatactacgacaacaacctgtactccacgcttgtgctgctcaaggtgatgaagaagcacaacgtcaagaagatcatcttctcatcctccgccaccgtgtacggcacgccgaaggaactgccgatcaccgaggagacgccgaccggcggcaccaccaacccgtacggcacctccaagctgttccaggagcagattctgcgcgacgtgcatgtggccgatccgtcctggaccatcgtgctgctgcgctacttcaacccggtcggcgcgcacgagtccggcctgctgggcgaagacccgaagggtatcccggcgaacctcaccccgtacgtggccaaggtcgcggtcggcgagctcaaggaagtccaggtctacggcgacgactacgacacgcccgacggcactggtgtgcgtgactacatccacgtggtcgacctggccaagggccacgtggccgtcattgaccacatcgacaaggaaggcgtgttcgtctacaacctgggtactggccacggctactccgtgcttgaggttatcaaggcttacgagaaggccgccggtcatccgattccgtacgcgatcaagccgcgtcgccccggtgacatcgccgcctgctacgccgacgcttccaaggcggagaaggagcttggctggaaggccgagctgaccatcgacgacatggccgcctcctccctcaactggcagaccaagaaccccaacggtttccgcgacgcggagtgatatgagcagatgagctccctctgatgagggagctcatctgtcgtttatcacacaatgcgcctatcggcggcccagcgggtgagctcggtgcgattcgaaagctgaagctttcgcaacaccgagctcacgtgcgtttcgaccgtcttgatcgaaatgaacagttcggccgccacctctttatacgtgtaaccacgcgcgatcagccgcatgacctcctgctcgcgggcggacagccggtccagctcctcatcatgagcccgtgccgcaccatcagcgccgccatcagaccccgccgccggcacaccctggaaggtcgaaagtacaaaaccggccagttttggcgagaacacggcatagccctcatgcacctgcttgatggatgaaatcaaatcagcgccggtaatcgtcttggttacatagccctgggcgccggcgcgaatcaccgaccccacatcctgcggcgcatccgaaaccgacaatgccagaaacacggtagtgggggagtagggccgcgatttggcgaggatctcggcaccgccgccaccctcgccgccgggcacatgcacatccagcaacaccacctgcggcttggtctgtgcgatcatcgccaccgaaccgggcacgtccgccgcttggccgacgatatcgaaggaatcgcgcaacgtggcgattacgcccgcacggaacatctcatggtcatcgaccatggccacacgaatcttggctgtctcgttctcgctcatcgatgttctccctgcgccgctttcagcgcgatcggcatatgcattctgacctcggtgccccagccggccctagacactatctccactgtaccgccgcgccgtttgatgcggccgataatcgattcgcggatgcccagccggtcgggcggaatggcgtccatatcgaagccttcgccatggtcgcgcacgaacacttcaaccatcgtgtcgctggcctcgcaatacaaagacaccggctcgccgccatgcgtgaccgcattgaccaacgcctgacgggtggcgtccagcagcgcatcggtctgggcgctcggccgcgcgtcgcccacggtgaccacctcaatcggcttgccgtgctcgtcctccacctcggcggcgatctgcttcaatccggctcccaccgaacgatccgatgtggaacgttcctgatacagccattcgcgcagctcgcgctcttggctacgcgccagggcgaatacggtggtcggttcctcggagttcagctgaatcagcgccaacgtttgcagcacgccatcatgcagatgggcggtcatgtccgcgcgctcctcttcgcgctccttcaatgcctgctcgtgggtgagtcgttgcagcatcgcgttcgcccacggcatcaccgccaccacgataccgacgatcatcacgaatccgctggcaacaatgcgtcgaggagaggtgccccacccaggaatgctgacattatgcacatacaatgcccatcccatgaaaatcagtgcgatgccgcccaacatagacaacagctgcgtgcctcgcggactaagattcatccatgccagtgcgatgccgcccaaccctaccagcagcggaaacacaatctggacatccgcaccggtgctggtgagcaacagtccagtggccatcaacgcgaaaccggccaatgccacgacggccggtttcggagcacgttggatggcctcggacaatgattccggtgcggcagccgattcgtcgtcatgagcggcaagtggctgattgcctcgcgcaagcggcgcctgattaacgggcactgtgcgagccgcagccgccaccgggtctccggcaggcatgaacacccacaggaatacataagcgatgatgcctgcgccgtagaggacggtcagtgcgatgaacgcaatccgaacccatgccacgccgatgcccaagtgcagggcgatgcccttgcacacgccggtgagccaacggccctgccgggggcgcatcaacggcatgcgcgcgggcagcaatggttcgggagatgacgtcatactcctattgtgccgcgctcagggcgttgcggccggggttttacccggtgttcagggaacaatcagggtgttccccgagcgttgtggcagtggtcgggcggtgtaatggaatcatgagcaatccaaacgcgaatccatatcagccacagccgcagcctggtccgcaaaaaaacaagacatcgcgacgcttcttcacttgggtgcgatccagtggactggttcgcggcgacgaccggtggatcggcggcgtatgcagcggcatcgctttacggcttggctggagccccacattagtacgtgcgttggtgattgtatgtacattgttcttcggttttggcgcagctctgtacgcactcggctggtttctgatgccggatgtacgcgatgggcacatcttggccgaggacctcattgccggccaatgggactggaattgtctgggatgcttcctgttcctcgccgtggcaatcgtgattccaggtgcggggtggggttgtattgcgctcgccgccttagcgctatggctgttggccaaaagcggcattcgccagcaggaagggtacggattcggggcatctgcgccgcgaccggtttcacagcctgtgtcatatccagccgcgcaaccagtacctcaatctcctttgtattcagctccgcaaccttttccacaacctgtttcacaacctgtttcacaacctgtttcacaaaccgcgcctagtgtttcacagcctgtttcacagcctgtctatcagtcgatgcccagcgtgatgccgggtactgtgcccggcgcgatgcccggcacagtacccaacgggccgtttgcccccgaccgtatgaatgcgacggcctatgcccccaccgagtccaagcgccgcaagccggcgggcccaatcgtggtcttgagcatactgggccttaccttcctctcctttgccggtctgatgggactgatttgggtaaacgacatgggcattatcggcattatgcgtctgggcaccatctggattgccgcagtatgcatagtgatggggctggtggtcatcattctcggattcagaggacggcgtaccggtggtctgattcctctcggactggttgccggtggatgcgcgctctgcatgaccatcatttcaggcacgtatggcgtgtactaccgtgatcttggtgccagcggcatcaatactgttgtttcactgagccaatctgtcagtgcgagaaacagcgacggcatgaacgatgtgcaaaaggatggcatcttcgttgccgatgccagcgatgccacgtttgaaacattgcagcaaggtgtggcgttcagcggtgaaaactacaacaccgatcaggcaatcattgattggtccgattgggacaagacacatggaccgcacacggtgaagatgctggatggcaaaacttccatcagtaattgcccggtcggtaccatcaccatagccgcaacacaggcgcaagtgcatatcgttctgccggattcctgcacttacgccttcggcaccgccgactcctactactccacttcgagtgacgttggcggcaaatacgagatggtatacaacaactacatgggtccaagctttgttttcttcgaagctgaaagtgccaccaatgggcctgatcacgaatggttgtataaggaatccgccatgccggacaacggcccagaattaaaaatcaatattccctatgtggtggaagcacgtgtcaacgtggtgtacgcctccgattgggaaggctctacgttccagccgcttgccgatatatacgacggcaacagtacaagcaagaacacaaccgaacaatcggaatgatcaagccgttgcaactaggagatggaatcatgactgatgaaaccaaggaattcgcctccatcgaggaagcgacaccgaccacggccataccttccgaaaccgacgcgaccaccgcgaccacaaccatggtgaccgtcgatgaccgaaccgataccacggtgctgccatccgcagcggatgatgacgaaacggctgtgctgcccgtccccgacaatcatgcggatgcgtcggtctcggatgtggatacgcaggcaacagctgcctctccatcgcccatcgaaccaaccacagatcggattgccctggaaacagttgccgatgccgtggagggagatggtgggccgattccatctgccgatgatgtgccgatgtacgcagcatcttcagcacgacctccctatgggcagtctcagaccgccggcaaaccatgccagcctggggggagctccaagaacgtccagagcgccaagaacgtccagaatgctaaggatgtcaagagtgccaagaacatccagaaacagagcaccagcgcgcctactgtggtattcggactattaggcgtgattatcggcgtgatcgcgctggttttcgggtacatatctccggatcggatgatttcgttgttctcgccgaatccgcaattgctgacggctattatttgcgccgtagtgggactgattctggtaatagtggccgttgtatgggccatagtcggtgccgtcaagaagagaaaatagcgttacaaaccattgcattacggtcccagtagaagcacattatgacgggagccgaccgataagagccgaccgttctatgctgatggggggaggcatagtaactatgaagcggatttcggtgcggcgggtagcgagcgtcatcgtcaccgcgatggcgatgacgctggtattcgccacacttggctgggcgatgatgccgcaatggaacacacggccctacaccaagcacatcgttatcgcttctgccgacaccaccatcacccctgcccatgcgaacattccccacgaggggcgatatcgtacgcgtgaaacccgactatccatcaagaccggcgacggcgtcacgctacccgccgtactacgtgaaccggtcggcgctcccgggccacgcccggcttgtctgttcattcacgggtccggtaccagtggtgccgaggatttcggcgatattgccaacgccatggcctctgccggtatcgtgaccttggtgccggccaagcgcaacgacaactacaccgtgctgcatcgcgactacccgcgttttgctcgcgaatacgggcgttcgctcgacgtgttgcgtggcagaatcggcgtggaccccgccaaaaccggcatctacgccgaatccgaaggcacctggatcgccacgattctaacctcgaaacggcaagacattgcctttgccatacttacatccgcaccggtgttcaatggacgtgagcaaatggccatggctgtcagcgcctatacgcatgaggccggcgcgcccaagcccgtggtcaaagacatggccaaattgatgtcgctggactacgcgccatttgatctagcctatgccgactttgatgccgaccggtatctgaaatccctcaccatgccggtgctggtgaactacggcacctacgatacggccatgcccatcgaacagggggcgcagcggatcatcgctacggccaacaagtccggcaacgagaacgtcaccgtacgctattttgccggcaaccatcagatgcgggctggtgagggcttattcaccccgaacctgccattggccgaaggctatacgcaagcgctggaaaattgggtgaacggtgtgactgccggaaccaaagccgatggatgggcaacgcctcaagtcgccggtgcgacacctcaccagcgcttcgccgcgtcgcaacgtaccagatccggtatcgtcggctcgcttggcgtgctggccggtctgatggtggcagggcccgtgctgatcgtgatggcggcgatattaggtattggcttgactgtgttttcttggctacagacgttgctggccgggcgacgtagtgtggcgactgtgcgggccgtgcatgcgacgccgagtgagctgggggccgcccagcggcgcatgttgcacggcattgccggcttatctgccggtatcggcacagcggtgatggtgattactgggctgttgtacggctatatgagcgccgtaggcgtatcggctgtattggttatgcctcaaccgcggctgtttgccgtcggatgggtggtgctgcgaatagcgaccatgctgttggtggtgctgtttgcttgggaaatggaacgtgtctggtattgccgcgccgatatcgtcggtgtgcggcgcgtcatatgcgtgatggtagcgctcggcactctcgccacactgatgacactggcattttggggcctattctcgctgtaattctgccgatgtgcgctggtaaatggggcctggcgggcaggctgcgttggtggtctgggtgtggccggccgacgtacatcagtcggggtgtccgatacacagtgaatggctgagtattacgcttgggaggcttcggcctcctctaaggtgtcgaaaccgccgagctggactgtgtgcaacaaggtttcctcagtgatattgcgttgcgggctggctacggcgcgctcgccaatcatcgcttcgtaacgttcgaaggtctggtcggaatacgtaccaagctcgccgcgcagataggtttcgaatgaggtggcagatggtgtgtcttcggtggtggtgagtgcgcgcatcgcctcgccgagcttggggtagcgctcgcggaaatccttggcccaggcgacctgctgggcgatgacctgttcctgacgggccgcgcgctcttcagagagacgcggaatatacggctctatgttcttcgtgaaattttccgatgcggtggaggccatcatgcggccgtatttttcggtcacgaggttgcggcccacgtggtcggccgcgtcaagatcagcggcatagctggtgagtaatggccgctcccatgtgaggaactgggccaaccgcatctggtggaacaccggccagttgccttggcatgccgcgcgtccaccctcattgttggtgcgctggaactgatcccattcatgacgcacaatagcctcgcgcagttcatcatcagtcagttcgttggtcatcgacgttcctttcgctgatacctccctctgatgagggaggtggcacggcgaagccgtggcagagggagcttgaatctacaaacttttaagcaccggatcatcagaggcgatgtggtcctcgacatacgggcgctgccattcgaggaaggtctcgccggacgtggtcaggtgttcgcgtttgagttccttgacgatatccaccgcaatctgctccacaatatcgttgattttctcgattgctggagccgcgcccttgccgccttcgccaaatccggccccgccatagcaggctgccgaactcaatcgcatcacggtttccaactgttcgcccacgttcggcaacagcgcgaacatcgagccagacagcttgcgcaatgctgcgaactgccacttgtaatacggcatatagcccaccaccatcggcacgttaaccaggaacaccaacgaggcggtggcctgcacgaactcgtggatggacagccatgcggccgcgccgtcgccgcgcttcaacgaacgcggcagattatattgaccggcctgggcgatcatgccgagtcgcttggagatcagcgcgagccgcacatcgtcgggcatgttcttgaacccttggcgcgtcttggaaaacagaccggtgggatcggcgaacacctcgccattggtggcggcggccaaggtcgattcctgaagcattagccactcatgcggcgcggtctgcgccggcgcagtgcgatacccggtgatcgactcaaagaagtcaccgatgcggaacacgccgtcacggcgattcgcgccctgtgcgcgcggcgtgacgggggagagcggtgcatcaatcggagtcgtcatcgcttccgccacatcagaggacgccgcgcctgactcggcagtggcggtatcgtccgtagcggtgccgggggtgggtgcgtttgccgcatcgggtatgacggtggagcctgcacctgcggaggggaatgctccggaagcatcggacctggcatgcgcctcgaacgtcacgcggccttgcgcatccacgctgaacttgcgcggcagtgcctcgtaatcgacctcaagttgctcgccgatcgccgcgtaatcctcatccgtaagccacaggcagaagcgcgggccgaaatcgtggtcctgcgaatacgcatcatcgaatccgtagcattccgagccatgacccaccagaccggcggcgatacgcccggtatactgcggatacttcgccgcaatcatcggcttgcccatctgcgtccagaacgcgcgggccagcttcagtccggacaccgggcatgcggaaacggcctcggccgcgtccgcagaaccggtcgacaccgaaacggtggatggggaagatgccgcgttcgcaccggtcttgccctgtgccgggctgttcggcagccgcgagccggactggggcagcgcgcctgcatcgccagcaacacccgcattgtcaaccgtcaccccggcctgcgccgccgcttcctcggcctgccgcagattgtcggcggtgatacgccagtaatcggtgtccttgccgtaacattcctcgatcacggccagcgcatgccggtatccagtaaccgcatccgcataccgtctctcggcaaagcacacctgcgcgaagcccgccagtgcggaggcataatgcgcggaatgttccagatggccggtgcgatagatttccagcgccttggctgcatgccaatgcgcgtcctccaacttgtgttcggtcagcagagtcaacgccagattcgtgtgcgagctggccacgtcgatatccgcgtccgggttcacgctcgaggcttcgataatgcgcagcgcttcacgcaactccagttccgccttgtcgggccgattcgtctcgctgtagagcatcgacagattgttgtgcagtgctgcgagcctacggtcggtgggtgccagcgaatgccggcagacactctgcgcctgatgatacaaatcctcggcctgatcgtattgtttggccgcgcgcatcgaggtggcgcaattgattagcgtggtggcccacgcctcggatgtgccggtggtcaagcccatacgagcggccagttccagcgctcgctgcacaatccactgattctccttgtgccgaccttgcgagcgatagaagcccatcgtttcgttgagcacggtgagcagtccggcctcgtcgccggcgttttccgcgtccaccatcgcctgttccaagtatgggccggcttcggtggcagccgtgtggcgatcgaaaatcgcgtccagtccgttcaggaattgttgggtatcaaaggttgcgggcgattgatcggcatcgtccgcaacctggttcgccgtggaatcggcaccttgtgctgcggccgccgcatcggtgtcgtcggcatcgtctggaccatgcgcgaattgcgcggcgaattgtttgagcagtgcttcctcatccataccgccagacctccctgaatcgtgtctgatttcagtctattaatactgtgaacaaacacgtcagggagtttgctgtgagcttggtctcagtccaccttggtttcgcgcatgcggtgaatggcgtcggtatcggtttcgcagcgccacgagtagaaggccagcagccctacggcaagcagagccagcggcataccgcccaggccggtatagcgatagttcatcgagaaggtggtgagcatcgcgccgccgacaatcgagccgatggcattgccgaagttaaacgccacctgtacagccgcgccggcgatcagctcgccgccgccctggccggcttcggtcatcagcaattgctgtggagcggaagtaaagaacaatccgatggcgatccagaacgtcagtacagcggtcatcggctgattacccggagtgataagcaccagcaacaagccgaggcaggagatggactgacctattgcggccgcgccggcatgcctccaatggtcggtcagacgacctccaagcagaccgccgatgaccataccaaagccggcaagcatcatcagcatcggcaccagggaagacgaccatccgccggttttctgcagccaaggggagacgtagctccaccagcagaacacaccggcattgccggtgaacacggcggccaaaatcacccacgggccacggcgggtgaggaacttgaactgaccggcgatgcctgcgtccttgatcggtgcaacgtacggaatccacgccaacgccagcacaattgtcattgccgcccaagcggtcaaaatgccgaaggcaagacgccaggaaaggaactcggccatcaaggtgcccgccggtacaccgagcatattggccacggtctgtccggtgaccatcacggatacggcctgcgcctccttgcctttctccgccagagtcttggcgatgagtgtggctgtgccgaagaatgcgccgtgcggcagaccggcgacgaatcgtgcgacgaccagcatggcggcattgacagagaatgcggaagccagattgcccaccaaggcaatcaccataaacaatatgatgaggctcttcggcggcaccttgcggccgaataccagaatcagtgtgccgaagcacacgccgatcgcatacgcggaaatgtaatggcctgcggtggggatgtccacgccggtggcggccgcggcctgcggcagaatgcccatcatcacgaactcggcggcaccgagaatgaacgcgcccgaagccagtgcaagcagactcttcttcatggttcctctaattacttcagtattacttacaaaaacagtgcggcaatcgattgattcgagcgatatattacggtggtctgccaacaaatacgggggcttgccgtgatgtggtttgtcgctgtgtgcggcgggttgtttatcgctgttcgatcgcttggtttgattgttgggacaggaaacgaaaaaccggattgctgattcctcaacaatccggtccagttgtcgggctggcgggatttgaacccgcggcctcttcgtcccgaacgaagcgcgctaccaagctgcgctacagcccgtttggcaacagacgtagatattacattgtggtggtggacaatgcaaatcggcatgtcgcgagtgttgcgtgatggtggattcgccatgtgtacaggtctctcaagccttgtgcagagccggttttgcgtcatgtgagcgggtgttcagatggccgtgcggtctgccgggctcataatcgccggccttgcgtacactgatgaatcatggctgaagttgtcgaaaataccgaaaacactgagaatgaaaccccggccgtcccgcagatgagcaccgtcgaacgtgcggaaatgctgctcaagcaggacgccaccatccgcgagaagatcaagtccggtgccacgctggacgaagccgtggacccctccaacaaggagttcggcccgctggctcaccccgagcaggtgcagatgcgcgtggccaagcgcgcgatgatgcttgaggccggcattgccccctacccggtgcacttggacgtcaccgacaccatcgaggcggtccgcgccaagtatgacggcaagctcgaggctggcgaagagaccgaagacatggtcggcattgctggccgcgtgctgttcctgcgcaacgcgggcggcctgtgcttcgtgcagctgtccgccggtgacggcaccaagattcagggcatgatctccaagaaggagattggcgccgattcgctcaagcagttcaagcagctcgtcgaccttggcgatcacttgtacctcaagggccgcgtcatcgcctccaagaccggcgagctgtccgtattcgccactgagtgggctatcgcctctaaggccctgcagccgctgccggccctgcacaaggacctgaacgaagacacccgcacccgcaagccgtacatcggcatgatcgcggacgagaacatccgcaacatggtgcgcaaccgctccaaggccgtggcctccctgcgccgcacctttgacgaccacgacttcctcgaggtcgaaaccccgatgctgcagaccctgcacggtggcgcggccgcccgcccgttcaccacgcacatgaacgccttcgaccttgacctgtaccttcgcatcgccccggaactgttcctcaagcgctgcctggtcggcggcatcgatcgcgtgttcgaaatcaaccgtgacttccgcaatgagggcgtcgacgccacgcacgcccccgaattcaccatggtcgaggcctaccaggcctatggcacctatgattccatcggccagctggtcaaggagctcgtgcagaagaccgccatggacgtctacggctcgcacaaggtcaccctgctcgacggcaccgaatacgacttcggcggcgaatggaagaccatcagcatgtacgactccctgtccgaatcgttgggcgaggagattgtgccgaacggcggcccggacgcccccggcacctccgttgagcacctgggcgccatcgccgacaagctcggcgtagagcgcgacgacgtggagaaccacggcaagctcgtcgaacacctgtgggagcacttctacgaggacaagctttacgagcccaccttcgtgcgtgacttcccggtcgaaacctccccgctggtcaagggccaccgcaccaagcccggcgtggtggagaagtgggatctctacgtgcgcggcttcgagctggctaccggctactccgagctcaacgacccgatcgtgcagcgtgaacgtttcgtggctcaggccaaggacgcgctcgctggcgacgaagaggcttgcgacatcgatgaggacttcctcgaggctctcggcgtgggcatgcctccggccggcggtatgggtatgggtattgatcgactgcttatcgccttgaccggtgccacgattcgcgagaccatcaccttcccgctggtcaagccgctcgttggctgattaggcatactctggctcccctcagagaggggagccgagttatatatgaaaggattgcttatgtccatcggcttgtgggttcggggcgcgcgtcccaagaccttggccacttccatcgcgtcggtgatggttggggcgacgatggcatacgcgcatatcgagcagtcgggcacctgcatcgcaatatatcccgaaccggcctcctgcgccacggcccgtgaacagcagaccctgctgatggaccgattctggccggtgaccatcctgtgcctgctagtcgcgctgttcctgcaaatcgccgtcaactatgcgaacgactattccgacggcatccgcggcactgacgccgggcgtgacacggacgaatcgaaatcaggcaaaccccagcgactgaccgcatccggactggtaccggccaagcatgtactgttcgcggcgatgatttgcgccgccatcgcctgcatatgcggtgttgtggcggtcgtgctcgcccaagcatggtggttgctggccgtgggcgcggcctccttgctggccggctggttctacaccggtggcaagcatccgtatggatacgtcgggctgggagaagtcggcgtgttcctgttcttcggcttggctgcggtattgggcaccgaatacgcgctgtgcggcacggtggacgtcggcggactattgggtgctgtggcggctggcctgttctcctgcctgatcatgatggtgaacaatatccgtgacatcgacgaggatcgtgagcatggcaaacacacgttggccgtacggctgggggagtccggcgcgcgtacgctgctgattgtgtgctgcgtcatcgcatggatcatcgccctgctgatgtgcggcacattatggtggccgtggggtgcggtgctgttgctctcgggcactggaatacctgtgcgcatggtctccagcgtgaataaacgtcaattccgcccggctctgcccgccgccagcttccagatcttgctgtttgcggtggtgctggcggttgccgtggcgctatgagagcgaaataataagacgaatactcgtgtttgggcgcacgcggctgtagactgaaccgtatgacttataaactagtactgctccgtcatggacagagcgcatggaataaaaccaaccagttcaccggctgggtcgacgtaccgctgaccgagcagggtgaagccgaagccaagcgtggcggcgagctgctcaaggagaagaacgtccttccggacatcgtgttcacctccctgctgcgtcgcgccatcaacaccgccaacatcgctctggatgccgcagatcgtctgtggattccggttcagcgtgactggcgtctcaacgagcgtcactacggcgctctgcagggcaagaacaagaccgagatccgcgaagagtacggcgacgagaagttcatgctgtggcgccgttcttacgccaccccgccgcccgagatcgacccgaacgaccagtacgcccagaacaacgacccgcgctacgccggcgatccggttccggaagccgagtgcctggccaacgttgttgagcgtgtgaagccgtacttcgagtccgccatcgagccggagctcaaggccggcaaaaccgtgctgattgccgctcacggcaactccctccgcgccatcgtcaagatgctggacaacctgtctgaggaagagatcgccaaggtcaacatcccgaccgccatcccgctgctttatgagctggacgagaacttcaagccgatcaagccgcgtggcgagtacctggacccggaggctgctgctgccggtgccgccgctgtcgccgctcaaggccagaagtgagcctaagccgctaacacggtacaagctgtaaggggagtcgcacataatgtgtggctcccctttgctatgcctgccaaatcccccatggggcggtgattaccccatggggcggtaaaaccctcatggggcggtatgtcagaatggcttaattccgcggtttcacatatccttcaaaccgccccatgggcaagttaccgccctatgggtgttttgccgccccatggatacgccggtgtaccgcccaaaagcaacaaaaaacggcgtccagccgtagccggatcgccgctttcgggcatcctcctcaaaccacaggagaacaagtgttcagttattcgcccaatgtgagaacaagtcccaatcagtcgatgtcggtgccctcgtcgcgggtcggctccttagtggggtcgaagccggagacgatgtacaccacacggcgggcggcggacacggcgtgatcgccgagacgctccaggaagcggcccagcagcacgatatccacggtctgctgacgggtgatgtcatcggacagcgctagatcgaaggtctggtggtgcagattgtccagcttgtcgtcagccaggatgatggcctcggcggtcttggcatcgcgatcgaagagcatggccaccagctggtcagcggtgttgtccaggaagtcgatcatctcggcgaacaccggttgagcggattcaggaatcgcggcggccggataggtgcggcgagcggcctcggccacgtggcgggcaagatcgcccatacgctcgaacgtggaagccagacgcatggtggaaacgaccacacgcagatcggtggccaccggattctgcttggcgagcaacttgacgcactggtcaatcacagaggactccagggcatcgatttcgatgtcgccgtcaatcacagtctgtgcggcttcaacgtcctgattcagcagggcttccccagcgcctttgatcgccttgcgtacgttctgcgccatacggtcgaggtcgtcagcaacctgcttcagctcctcgttgaaaataacgcgcatttctctagcctttcatgcttgcttattgcaacctgtaccagtgtattattccagtacttgttccccacttcaacgtaggtaatggcaacctcaagttgttctactgttcattgggttgttcacctgaaattcatgttaccggcgtgccggcaaaccgcaatcccggcgtgtggtgtgaaagaatgggggcatgacacagatgccgctcgtcgccgcgattgctcttattgtcacggctgttttatttgtggtaggaatcatcacgctcatcgtgggatttgcgacacatcgagtgtccatggaatcgccgctggccgatgatgacgacaatgacgatctgtccgacgacaccgccacgctgctgtccatgctgccaggtgcgtccgtggtggtcgacgagcacgacgaggtggtccgctgcaatcccgccgcctaccgcctgggtgtggtgtcagatgacgccattgcccagcagcatgtgctggatgccattcacgaggcgcgcaagtccggtggcaagcgccagttcgacttgaccaccgatactccggagcggtacgtcgcagaccagaacaagggcgatcacgtcgccacgcagtccgtccaccgccccaactggctgaaggtgactgtagggcgtatcaacgagcagttcgtcatcgtgttgattaccgatgtcagtgatgtgattcgtttcgctcaagtgcgtgactcgtttattaccaatgtgtccgagcaattgttgggccccactgaggctctggccaaactcgccgattcgctggagtccggcaatctggacgaacagcaggtggctgccgacgctcgccaggtgcgttccagctgcagcaagctcaaccacatggtgtctgatttgctgctgctcatacgcgcgcaggagccgattacgccgtcttccgccaaccgactgaacgttatggaacagctcagggccacggcggcgcgactggagccgcaggcagccgaggctggcgtgcagctgaacatcaagggcgacgatgatctagtcatcaatggtgaggcggaccagatcgacagcgccgtgaccaagctcatcgaaaacgccatcggctattccaaggaaaatggcgtggtcagcgtgtccgcatccaaagacaaggatggcgaccgcgcggtgattcgcgtgattgaccaaggcacgggcatcgctaagaaggaccaggcgcgcatcttcgagcggttctaccggggcgtggaacagagcaatcgcacggcggatggcgtgggcctaggcttggccatcgtcaagcatgtggcgctgacccatcatggcgatgtgaccgtatggagcgcgcccgggcaaggcagtacgttcagccttacgttgccgttggcacagtgaggtaaggaattggtggcatgccttgcatgccaccaatgctgtttgatgagcgacctgcggccgcggtctctccctcaatcagctacgctgacagctcccgtcatcagagggagcttgtgttgcgttactgtccgaggcggcggtagtcccagcggtcgaagtattcccagaccagcagtagcaagccaataatgacgccggccacgcacataatcaccaacggcattacgctgtagcccacggccagcagaatcagcacgacaatcaacgccacaatccatagaccggtaccgatggcaaacaccttacgcagatccacccgtacgggcttgggtgcgggtttgcggacggcagggtcaatgagaggcgcgaacttcatactcatgcactgtagtaagagtagggaggggcgtcaaacatccctccctacgatttattcaatcggcatcagttgagaccgatcaatgtgcatggcatatatggtcggcaatgcggggcatatatgccatcacaggtgctcgaccacgtagtcgacgcacttggtgaaggccatgacatcagccggttccaccgaggggaacacgccaacgcgcagctggttgcggcccagcttgcggtagccggcggcgtccacaatgccgttctcgcgcaggatggacagtacctgagaggcctggactcgctcgtccagatcaatggtgaccacggcgttcgagcgtgcgtccgcatcgacgacgaacggagcggcgtattcggagcgctcggcccacgagtacaggatggatgcggacttggcgcaacgtgtggtggcccaggcgaggccgccgttgttgttgagccagcgaatctggttttccatcatgatcagggtggccacggcgggcgtattcagggtctgatccttgcgggagttgttcagtgccgtggtcagcgagaggaacggcggcacccagcgatgtgcgccttccagatgagcgcttgattcgacgcctgccgcacgatcgatagcttcgggggagaggatggcgacccacagaccgccatcggcaccgaaggccttctgcggtgagaagtagtagacgtcggtctggctgatgtccacaggcaaagcgccggctgcgctggtgccgtcgatgacggtcaaggcaccggcttcacgacttccggccacgcggcgaatcggggcggccacaccagtggaggtctcgttgtgagcccagcaatatgtgtccacgccctcggtgagctcaggcagacggtaagtgcccggctcgccggggaacagcaccgggtcttcaaggaagggtgcgttcgcggcggacgcggcgaacttggcactgaacgagccatacgtgccgaatgcggcgcgacgggtgatcagcgaagcgcaggcaatctcccagaacgcgctggcgccaccgttgccaagcgccacctcatacccttcaggcaggtggaagaactcgcgcagaccttcacgaatcgaagcgaccagttgcttgactggtgcctggcgatgtgatgtgccaagcagggtggtggcgccggcgtcgagcgcggcgatctgttcggggcggattttgctggggccggagccgaagcgaccatcttcgggcttcagcgactcgggaatactcagtgtgatagtcatggtttcaagggtagaccagtgttggggaatatcgcggataatgctcggtgtgcgggattactgcggggttactgcggaattccggggtgccgggcggcagtggtggcaatgcggaatgcagtgcagaatgtacgcagcacatcatggctacggtgtgtcggaatgacatgagttagtgattcttccgataaccggatagtgaggttcgtgaacgggcggaaacaaggcagttttttcacccggccgcacggttacgtaaatcgtttgacacacccggatggtgggggatcacattgaggattgacctctgttcgttgtacagtactcaattgtgacggtcatacgaggtcatcgaaatgaccccgccgaacccatccaaggagttaacgtagtatgaagcatgcttcgcataaagcgaccacggtctcgcgccagaagttcagcttagcgaaggcattgtttgcctccggcaagggttctcattccgttcgtgctgtgcgtgcggtgcaatccgctggtagcgacgccgttgttttggggcttgatccggccattgccgagaagatcaacgaaatcgctccccagacccgccgttccattcgtgaggccgctcgtgccgctgaacgccgtagccatattcttgcctcggcctcactggccgctctggtcggcacggccgcaggtgctctcgcattttccaacaataaagacgccacgaactcgttcgtggctgatccggccacgacgaccacgcagattaagcgcatcagcgatgtgactgcggcttctcgttccgaagcacgtactgatctgagttcatcctccgttaccgcacagtccaccaatgaaggcggttgggggctgagcaattcagacagcaccttggacgccaagctgatgaatcgcaataatgcgaacaatcctgtggtgtcggctctcatggatgccgatggcgatgctgtgccggctggcttcaacccgaaccatgccgttggcaccaactccaacaactatccgtggggtcagtgcacgtggtacgcgtaccagcgtcgtgccgaactgggactgccttccagcggcaacttcggcaatggtggcgagtgggcggcgtcagcttccgctctgggctattgggtggacaacactcctcgccatgtcggtgatgctgtggtgttcgctcctggccaggccaatgccgatggcacatacggccatgttgccgttctggaaaagatcaatgccgacggctccattgagatctccgaatccaatgccaagggattgggtgtgatttcgacccgtacgttcagcgccgccgaagccggtaagttccagtacgttcactactgattcatttcattggcttacattcggtgattactgttcggatgtgacgtcgccctatcggcaatcgttcgcgcgaaatgacatttcaagtgttgcggccgcgtattagtccgaactgacctgtgccgacacgccgatatatcccaatagctccggggtgttttatttcttccatcctgtacgagttaatgcgcaccgtgtagggtgatggttctatgaagaccaaaactgtagcttcttccattgttgccgcgattgtctcctgtgcctgcttgtttatgtttgttcctacagcaactgcagctgagggtgttactgtgacttccaccaagtccttcccctcgtacacccaggtgcgcaaagatctgacgactgaagccactgccacgagcgttgaggacaatgctgattggggcggcattgagaacctcgatgtgccgcagacggaatctcaggcggaaaaggatgccgcagcggccaagaaggctgccgaagaggaggccgagaagcaggcggaggtcgaggctcaggcgacccaggagcaggccaacgccgcgagccgtaatgagtctcgctcttctgttacttattccgatgccagtggttcggtttccgctggtgccggtgcctctatcgaccgtgcgtattctttgatcggacagagcatggactgcaccgcattggtcagtcaagcgttggcggcccgtggcattaacttccacggttggcctgaagagtacgtcaatgttcctggtggccacgtagtcacagacggatccctgcagccgggcgatattctgatttatgccaacaccggtggatggaacggtggtgcacactacgatcatgtggcgttgtatgtcggcaacggtcaggcggtccatggtggatggaatggctatagcgtggctctcgctagtgccatgaccgaaaagctcaccatcgtggtgcgtatcccgtgatgcagtcttattgattgatttattgcaggcctcggatgccgatcggtatccgaggcctgttgcgttctcctgccgaatgatgcacccgcgacatcatcttcgaaatgctattcctgttatgaaatcgacccatgtgtgctagtgtatggcgttgatgatgagcgttaagactattatttccacatcagtggcgattatcgccacgggtgccatgtttgcgtgcgtagccccgtttgcctctgccgattccgcgcagacgagtgctgtggtgtcctcacgttctttcccgaaggcgagttcggtgaagaagaatttgttcgccgaatccacctccacctcggttgatgagaactctaaatggggtggcatcgagactcttgatgtgccacagaccgagtctcagggcgagaaggaagctgctgcagcggcggcggctcagaaagccgctgatgaagctgctgcagcccagtccgctgctgctgcggcagccagccgctctgaacagcgtgcgtcgattccacaggttgacttgggtaaaatgactggcactggcactggcgctgagcttgctagcttctcactgaagttccaaggctatccgtatgttgccggcggcaacactccggcaggatgggattgctccggttttgtgcagtacgtcttctcccagtttggcatctccctgcctcgtacctctggtgctcaagccaccgtgggtactccggtcgcaagcttggcggatgccaagccgggtgacattcttgcgaatggtactcatgcggccatttacatcggtaacggacaggtgatgaatgctatgaacccggtgcagggaacggcagtaagcgacgtttccgtattcggtggagctggatattccattcgccgcgtgatgtgacaagaattatgcggtaagcgaattcgtattaaggcacgtcctttggggtgtgcctttttcgtatacgcggatttctttttgagcggaggataccggccaaaccgagtgtcgcggggtattgttgagatacgcggtattcgtgccgcaataacttcaaggaggtcgtcatgattaacgacaaggctattctcgtcggcgttgacgggtcgcatgccagttacaaggcaacatggtgggccgcgaattatgcaaagcacgcggggctgacgctgcagattgtctgcgcatattccctgccgagctatgccgccgtttcgttcgatgccacttacacggcgatgggggacgataacgccgcgcattccgatgctcaggagattctgtccaaggccaaggccatcgcagacgagcagggcgtcgaagccgccacactgattgttaccggagatccggcatcggtgttcgtcgaattgtctcgtaactacaatctgatcgtcattggcaaccgtggcaagggcggtctggccgagcgcctgctgggcactacgtcctcatcgctgccggcatatgcttactgcccgattgtggtggtgccgtacaccgatgatgacggtaacctgatgcacctgaacaacacgatcaccaaggtggccgtcggctccgacgaatccaagtggggtctgaaggcgctggacattgccgccgacttcgccacgtgctggggtgcggaactggacgtgatttccgctgtgccgaacctgaagggtgtggacggcgaggacgccgtcatggagtcctacaaggacgatcttgaggtgcgcatcaagccgttgcaggaatcgcatcctgatctgaagatcaacaagcagatcgtttccggcccggccgtgagcgccctgaccaaggccagctacgatcacgatgtggttgttgtcggctcccgtggtcgcggcggcttcactggcttgctgctgggctccaccagccagggcctgctgcagcatgcggtcggcccggtgtacgtggtgccacgcaagtatgttgaggccgcggaatcgcgtctcgacaccgtgccgagctcgcccgccgaagtgcctaccaagtcgctggaggagattgccggcgtcgaggagattccggtgtccgcagccgagcccgaagtcgcccagcagatcgaaaagaccatcgatcccgatcgccagtaaagtccgaatatacggaaagaggctcccgccagggagcctcttcaatttatatcccgtctcagtgcttgacggtgacgttcatgcgcaccggggtctcctgcacgtaggtgtgcttgaccgtgcaacccttgtcgatatggcgggtgacgcgctccttgagcttgtcggcatcctcctcggacagaccggcgtcggaagcatcaatcaccacctgctcctcgaaaccggtgtaggcgtcgttctcagggtcgtacgtgccatccaccacaatcttggcacccttgccctcacccagcgtatgttcgatggcgaactggctggacagcgcggcgcaaccggccagcgcgaccttcatcagatcgcccggcgtgaactggccacgatccttgccgaacttaatgtgtgcgccatcgtcgctgaacgcatcccacgaaccgtccttgttacgctcaacccacagtcgcttacccatagctgctcctttattttcagccgccggcgatctggcccatcgccatgccagcgggggagcgcggcacctggccgctctcccgcatcagtggacttctctattatgcccctaagctacactggtgcacatggctttgaccgaagaacaactcgcagatattcgctcccgtatccccgcacgtcccgaaacggacattccgatgccctatgaggacctggtgcgcaagatcctgaccgaaggcacgctgaagtccgatcgcaccggcaccggcacgatttccctgttcggccagcagatgcgctttgacctgtcgaagtacttcccgttgctgaccaccaagaccgtgttcttcaaaggcctggcctatgagctgctgtggtttttgaagggttcctccaacatcaactggctgctggagcacaacgtgcatatttgggatgagtgggcggacgagaacggcgatctgggcccggtctatggcgtgcagtggcgttcctggcccgcgccgacccccgaggacccgaatcgcaccatcgaccagatctccaatgtgctcgacctcatcaagcatcatccggattcgcgccgcatgatcgtctccgcgtggaatccggccgaggtggagaagatggcgttgccgccctgccacgcgctcttccagttctacgtggccgacggcaagctaagctgccagctgtaccagcgttcctgcgacatgttcctcggcgtgccgttcaacatcgcctcctactcgctgctcaccatgatgatggcgcagcagaccgggctcaagccgggcgaattcgtctggaccggcggcgactgccatgtttatgacaaccacgtcgaccagttccttgagcagctgggccgcaagccctacccgtacccgaccatcgagatccgtaaggccgattccctgttcgactaccagtatgaggacttcaaggtcgtcggctaccagcatcaccccactattaaggcacctgttgcggtctgatgctgattaccatttcgtggacagtgaagactgtgaaggtgacggcccccgagtcttcgctgtccactacactaaggcccagttccgcaatccaggaggagtaagcgaaatggagcatgacagtagccgtagcggctatcacgaacccgagcccggatctgccgggctgtctgccactgaagaagactggggtgacgattatcccaagaccttctcggtgaatcttatctggggcgaagcccgtgacaaggaaggtcgcgccggtgccatcggcctcaatggtggcatgccttggcactgtgccgaggatatgaagcatttcaaggagctgaccgtctcccatccggtgattatgggtcgtaagacctgggaatcgctggggggcaagtaccggccgctgcccaaccgcgacaacatcgtcgtttcccacgatccgatgtaccgtgcgccgggggccactgtggtcaccagtcttgacgacgcgctcgatatggcccgtcaggaggcgattccggacgacggtctggaccgttcggagatttggatcatcggcggcgcccagttgttcgccgaggctttgccgttcgcggacaaagcctatgtgactgatctggccgccaccgtggatgccgacagctacgcgcccgatatggcgtcgctggtcgaggccgggatgtggcgggaagccgaagtgggcgagtggcatacgcccgccaaggaggagtccggcatcgattcctatcgtttccgtatcttggccaaaaccaagtaagcatgcgaatccggcttatgccctttatagcggcatgagccggattcatattcattcgaccccaacaatacagtcgggccgtgtgcggcccggtgaagcccgattgaggattgattcaaagctatgagcaatacccagccctacaccgtaatgaccgtctgcaccggcaatatctgccgttcgcctatgggtgagatcattctgcgtcacttctttaatgagcgcggtcttggcgaccaggtgaacgtggaatccagcggtgtgtccgacgaggagtggagccacccgatcgacccgcgtgccgtgcgcgtgctacgcgaacgtggctatggtgatgagattccgcgtgaccacttcgcacaccgcatctcgcgtgaggaaatcgaccgtaccgacctgttcctgccgatgaccgcctcccacatgcgcgccctgctgcgcatgctgccggccggcaagcgcgccgaagtgcacatgtaccgcagcttcgacccgaatctgcccaagccgaagcccggccgcgaagatcagatcgatctggtggacccgtggtacggcggcaagcacgagttcgaggtcgccatcgaccagattgaggaagtcgccccgtacatcgtcgattgggtggcgaagcagctgtaggaatcggcctgtggccgatgctgtgtgtttcgcagtcttacgactgcgggtctctacctccgtcaccgcttcgcggtgccgcctccctcgtcagaggaaggtacagaagattacctccctctgtaagggaggtgctgagcatagcgaagcggagggagagactaacgagtcgggtgcctcagaacaccagttgcaccagcaacatatatacaattgtgccgccggcgattgaaagcagcatattgcgtttccatacgtgcagcagcacgatgacggtgcaggcgatgagttccggaaggccgtgtgaaccggtcagaatcggggtgttgcgcagtgcgtataccaccagtagaccggtcatcgcatagggcaggacctggccgaaatactcgatgatgcgcggcggctgcttggactcgggaaacaccagaaacggcagaaaacgggtgcacatcgtgcccagcaccaccgtcacgatagtgattgcgccttgccagatggtcatcgtcatcgcgtctgtccttccttctgctggtccgctgcgtggctcatggcatggtttgccgtggcttccggggcgtcggcggctggccgcaacacgtccagatgcgggcgcaacgcgacgaacagtatcagcatggcgatcatcgagggaatcatgaaatcattggccccgaatatcagcaggcaggccagtgatgtcagcacaccgatgacggcggacagtcgctcgcgatgcttgccgtcgagccactgatcgaggaaaatcaccagaaacagcgcggtcagtacgaaatcaagaccgtcggtattgaacggcagatgcgcgccgatcagcccgcccagtgtggcgccggtcacccaatacagctgattgcacagcgtaacccagaagtagaaccagccacggtcgatgccggcggggattttcgcggtggagttgatggcaaaagtctcgtcgcacataccgaaaatcaggtatgggcgcttccagccgagccctttgaatttgccgagcatggatagtccataaaacaggtgacgggcgttgaccatcagggccagcagaaagccggcgagtgggttgaacgcggagagcagcagattcaccgtgacgaattccattgaaccggcgaagatgaacgcgctcatacacatcggccatacgaaggagaagcctttggtgcccatgagaatgccatacgaggcgccgagaaacaggaaccccaggcaaatcggtatggtcagcggaaacgccgctttgagcgccggcagccaggcgttggtgttggcgttggcggtgtctgccatgtggatgatgttctccttgtacaactggtctgccggccgatgttcgccgatgatgccatatgcggttatacacgcatggtgtcgataaacggggtgagggtggcgtcgggaccctgtgcgcgaagtcacagtgtggaggatgtcacattgtctacggtgggatagtccttgtggcgggcgcgaacacgtgctgagatgaaaccatgagcacatatcaagcgggccgaatgctttcagacctggtcccgcgaatacgaaaagacctcggtcgctatgaccgaggtctttagtgaagtacccccagagagagtcgaactctcgttgtcagattgaaagtctggtgtcctaaccgttagacgatgggggcgaacaactcgaattactttacgggaggttgttcggttatgcaaatcgacggcatttcggcgtgtcgcaatcagttcagggtaacggcctgataggtgaagtcatgaatcacgcggccggcggccaggcccttcttctcgaagttggtgagcacgcggccctcgaatcgctcggattcggtgaagtcggcgtgcggcatatcggcggccatgtcggcattgcccttgcccacgtgctccagcggcaggctgacggttacgctgcccaggttcttccagccatcgaggccgtccatcacctcgtgcacgtgcagggcatagtcctcgatgtcggtggcgatacgccagacgccgtctgtgaccagcgcgcgatgaatgtcgccggccatggccttctgcacgatgcggcgcttgtggtgcttcttcttgggccaagggtcggggaagaaggtccatacctcggccacggtgccggccgcggtcaccttgaacagctcgggcgcattgacctgggccacgcgaatgttggtcagcccctgcttgccggcgagcagcagcgtgtgggccacgccggggtcatagacctctagagcaaggaagttcgtctccgggtgggctgcggctgctgccactacgttttctccctgcccggtgccgatttccacaatgagcggattatcgttgccccatgcggactccacgaacgcgcggtcgagcgtgacgccttcgcgcacgtccagcaggttgccggccgcaatatccaacagatatgtgccggcatagttgtcccatgcgcgctgcaggcgatcgtccaaacgtccggagcggcgtacgaaggagagcaccttgtgcagggggtgcgccggtgcctcggtgtggtctgtgcccatcgcggcgacgggatcgattgctgtggattcgggattggtcatatattcctcggattttccttgtgcgccgcaccgctgttcattcattaggtcgatttggcgttcattaggtaggtggtgtgcgataccaaccaccatatcaagccgtttacccggtgtccgtgcgggccggctccgggccgacctacctaatgaacgccaaatcgacctaatgaatgcagatattgccggacgacaccaccgttttgtgcgattatgttcgtgtgatatactcaaattgtttcaaaaggtaacaaagcggaccaaaagtgaacagccgctgaactccccacggccgacacttgcaacccgcacaaggaaaggtcaactatgacagttctcgtcaccggcggctgcggctacatcggcgctcatgtcgttcacgcactccatcaggccggcgaaaaggtcgttgtcgtcgacgatctgagctacggcaagcccactcgcatcgaaggctcccgcctgtacggcatggatatcgccgccccgggcgccggtgagcgtttggccgaaatcctcgatgccgaaggcgtcgactccgtgatccactttgccgctcgcaagcaggtcggcgaatccgtggagaagccgctgtggtactaccagcagaacatcaacggcatgctcaacgtgctcaccggcatgacccagtccaagaacgccaagaagctcgtcttctcctcttccgccgccacctatggtgtgccgccggtcgatgtggtgcctgaggatgtcgtcccgatgctgccgatcaacccctacggccagaccaagctgttcggcgagtggatggcacgcgcctgcgagcagccgttcggcatccgcttctgcgcgctgcgctacttcaacgtggccggctgcggtccggtggagcttgaggatccggccatcctgaacctcatcccgatgctgttcaatcgcctcaagcagggcaaggctcccgccatcttcggcgacgactacccgactccggacggcacctgcgtgcgcgactacatccacgtctccgacttggccgacgcccacatcgccgccctcaagtacctcgaccgtgacgagcgcaagtacgacgccttcaacgtcggcaccggcgaaggcacctccgtgcgccagatcgtcgacgaagtcaagaaggtcaccggtctgccgttcaccgaggctgtcatggcccgccgcgccggcgacccgccgcacctgatcggctccccgaagcgcatcaacgaggagatgggctggcatgccaagtacgacgtggaagacatcgtcaagtccgcgtgggatgcctggcaggccaaccccgaacaccacatcgacgtcgacacctggaagcaggctgactgagattgacggtcactttgcggtggatgccgcgaagcgtttccgtccataagggcgtggccggggttccggtcgcgcccttcgtcgttttgtggatgtttgtgacagacgtgttcgcgtgctggtgatagcaaaaaccttgaaattatgcggaacacgccgaagtttgcatgactggcgaatttcagtaatatatacatctgttgcctcacgcaagtgagaacaatggccccgtagctcagttggttagagcgccgccctgtcacggcggaggtcaccggttcaagtccggccggggtcgctggaatggttatgaagcccggattatccgggtttttgactgttcatggctctgtagctcagttggtagagcgagcgactgaaaatcgctaggtcaacggatcgacgccgttcggagccaccacaatgaagccccgccttgtgcggggcttttgcatatccgtcacgtatctactccggcgggctggccggtcaatgcaaaggctcgcgttcgccaacaactgtcttcctcgccgcaactatgcacgccaacagcaccaatgcgaacatcgggttagggttaaataaagaaacgtgggtcttatccgcgcgtgtcatggtcggtgcgatcgtccgccccagccgtttctggggctgtggcgctcatagagtcagtattgcagaaaaagcacctgcgaaatgcgcgtgcgaagggaatcgtgtgggacggcacgtgattttgccgattttcgacgtgccgtcccacagcgttcgaagaacgccctcagagctgagggcaaagaacggctctattctgcggttctcggcttatgtcatgcgggatagcagatacgtcaaacgattgatgtatctgctatcccacacttctgtgggacggcagatgaacaatggtaaaaaccgcgtgccgtcccacaaaaaggaatcaggcctgccaccattggcgcagggggtaccacttgccgtccgggtgggccacgcgatccggcttgacggccaagaactggtgaatctggatgccgtcgagctcgaagttcagagcgcaggcggccatgtacataccccataccttggcgcgttcaaagccgacctgcttgaccgcgtcgtcccaatgctcggagaggttctggttccagtgatgcagggtgagcgcgtagtgctggcgcaggttctcctgatgcaccacgttgaagccggcgtcatggatgcacgattcgatgaagccgggcgcgccgagatcaccgtccgggaagatgtaacggtcgaggaattcgtcggtaccgggcttgccgtgaggcttgtcatggctgatggtgatctggtggttcagcagtcggcccatcggcttcagaaggcggaacatctcttcgaagtagctctggtagttcttgacgcctacgtgctccatcatgccgatcgagcagataccgtcgaagtcgtgctcaggcacctcgcggtagtcctgcacacgcacttcggccagatcctgcagcccttcacaggcgatccattcgttggcgtacgcggcctgttccttggaaagggtgacgccgagcgccttgatgccgcgacgggcggcggtgatgaccatcgaaccccagccgcagccgatgtccagtaagcgctggccgggctgcaagtccagtttgtcgagaatcaggcgcagtttgttggcctgtgcgtcttcaaggctcatgtgttcgttgtcgaataccgcgcaagtgtaggtcatggaggatccaaggaagtcggcgtagaactcgttggacatgtcgtagtggaagctgacggtttccgaatcggccttttcggtgtgcggcatcaggccacgcttgatacgggcgaacttgctcgggccctcggtggcgggcaccggcggcttcttgaagccatggctcaggatgccggcagatacgcgggcaattgatgtgggagtgagtgggcgaacgtatttggacagcgacaccagcttgcgcatcgccggatacgggtcggcgtagtcaatgccgtccacgtcgaaatcgcccagaatgtatgagcgcacgatgccgatttcattcgggtgcgcgagtagctggtacatgcagttcggcgtggcgattttgaccttcaaatccgcgtctgccgggccgaaatgcgagccgtcgaaagcgtcgatacgaacgggagtggcggggtcgagaaacagggacgccatctcgccgaccgtcatagccttgccatttgccattatctacctcattctcttatgatgatcaccccaactgtcgaggtatcttagtcctcttcaggagactgaaaccgttgaatacaccatctggtgaaccagttcgcgttcggctgatgaagcacgaatggaattaggcatctcgcatattgattgcgctacgcgcgaagtaggcggatgagagacgagtttctcggagagcgtcagatgactccggaaaatggtcttatcgttgagatttcgggcgatggaactggtttggtcaatggacaataattcgacaagtgcggaattccgccatttcttgccattattttcagtgttgttctttcagcgtgttttcaggtgaatgctcatgcgcggagtagactggggaaccgttggaccactcaaagacagagtgaaccaccagttaagacactagctcaaaaggagagcccctatggtgtaccgcatgattttcaaccagactgcatacttcggacgtggcgcgatcaaggagattccggccgtcgccaagcagcacggcttcaccaaggcatttatcgtcaccgacccggtgctgctggagaccggcaccgccgagaaggtcaccaaggttctggatgaggccggcctgccgtacgaggtgttctccaacgtcaagccgaacccgccggtcgagtgcatcaaggacggcgtcgccaagttcgccgagtccggtgcggacttcctgatcggcctgggcggtggctccccgcaagacacctgcaagggcatcggcatcatcaccgccaacccggagttcgccgacgtgctttctctggaaggcgtcgcggataccaagaacccgtccgtcccgatcttcggcgtgccgaccaccgccggcaccgcctcggagacgaccatcaactacgtggtcaccgacacggccaacaagcgcaagttcgtggctgtcgacccgcacgacatcccgatcgtcgctttcgtggacccggatctgaccgactcgatgccgcgcggcctgaaggtcgccaccggacttgacgccctgacccacgccatcgagggttacattaccccgggtgcctggagcctgtccgactgcctgtccatgcagaccatccgcatgattgccaagaacctggccaagtccgccgacggcgacattccggccggcgagcagatggcctacgcgtcctacatcaccggtatggcctactccaacgtgggcctcggtctggtgcacggcatggctcacccgctgggcggccgtctgggtgtggcccacggtgtggccaacggtattctgctggccccggtcatggaatacaacaaggacttcaccggtgagaagtaccgcgacatcgccgatgcgttcggtgttgaggacgcctacaccggcgacctggagaaggtgcgcgaagaggccgtgcaggccgtccacaagctgaccgtggatctgaagaacccgaccacgatttccgaagtgggcgccaccgaggccgaccttgagccgctggctcacgatgccttcaacgacgtgtgtacccccggcaacccgcgtcaggcaaccgaagaggacatcctcgcgatttacaagtcgctgatgtgatcagtcaatgacagtaaacattagctccctctgatgagggagctgtcagcgtagctgactgagggagagaagttgcggcgtagccgctgaataataggtatcggcctgcgtccgattcaatgttttagcgactgcgtcgcagtctcttcctcagtctcacttcattcgacagctcccttatcagagggagcttgcataagcagagggggctcgtatatctagctacttttcgtgcttttcgtcgtagacttcgtcggtgggggtctcgtcgtacagctgcttgccttgcgcctccgccagttccatctgctcgttgatccacgcggcttcagccggattgatatccgcggaattcagcactttctgccacaccgggtagaacatatgcatcgccggatacatggcggtgaacaacacctccggcttatgcgtgcgcgtatgttgcggatgcgcatcaaacgtattcttaaaacgtcgcatgtagctcaggaacgaactcaacgacgtatccatccgtcgcgcactcatcgcggcgatcatgcgcggcgagtacacggttttcagatccttgcccatcagatgcagggaaatatcgatatcctcatgcatcacatcggccttatcccggcagacctcattcgcaatctgatgccaggccgaagcgcgcaaggccatattcgagccgaacagcagcggctggccgccatcggcgcggtagattcgcttgcgtaaggaattgtcgcccttcaacccgaaatggcgtgagggcatgtcgtaatacatcaccggaccagtggcacccatcgcggccgggtcttcggtgaagatgccggagaccacctccacccagtcaggccggatcatacagtcggcgtcaaaacggcccagcacatcgccggtcgcggcgttcaggccaaagttgcgggtgggaatcagcccctgttcatcgttctggtgcaacagtttgaccggggcctcgggatgttcggcaatgaactgttcgacaaccgcacaggtgttgtccgtagaacgattgtccaccaccagcacctcatgcggcatgatggtctgacgggtggcgttcagcaggcagtcgcggatgcgttcggcttcgttccacgctgggatgatgatcgaaacgttgagcataacatcaacaatagaaaagcgggtgtacgccgccggcgtatccgagcttcaaacccctcgctacaatggggagccatgagcgaacgcgtgcgaaacgtaaacagcaccgacacgttgagaaccggtgccgcagaggccggggcagacccggacgacgagaatcgtatcgactttggtactttgttccccgccaagggagattcccgtaggccaccggaatggttcggccgcgcgctgctgtatgtggcccttgccgtcatcgtattcatgttctgctggcgctcgtggggcgacatctcctatctagtgctcgacatcatcatctcgctgttcctggcgctggccgtcgaaccgttggtggtggcgctggtggctcatggctggaagcgtggcgtggcttccgccgtcagcttggtgggcgtggccgtggtcgtgggtgtgctgctcacgctatttggcaacatgttcgtacagcagatgattgccatggtccgcggtttgccggccatgtatgagcagattcgtgagttcgtggaccagtatgccacgttcaagatgccggaaatcagcaatctcggcatggaaatcttcaacaatatccagacctcgtgggtcaccgattttgccggtaccgccatgagtacggtgggcggcctgttctccttcctgctgaacctcatgaccgtggtcatgaccacgtattacatctccgccgccggccccaaactgcgccgctccttctgccagtggctggcccccaacacgcagcgccgattcctgctggtgtggaccgtggcccaaggccagatttcgtccttcctgttctcccgttcgattctggcgttgatcaacgccacctgcactgccatcttcttagagattctgcatgtgccctactggctgccgttggccctgttctgcggcgtggtatcccagttcatccccacggtcggcacctatatcggcggcgcgctgccggtgctgttcgcttggggcaaccgcggatggacgtacgccgtggcggtgctggtgttcatcatcgtctaccagcagatcgagaacctgattctctcgccgaggatttcgcagcgcacgatggatatcaacgcggccgtcgccttcctcgcggtgctggcgttcggctcgctgttcggcgcgtttggcgcgttcctggcgctgccggtcaccgcatcgctgcaggccatcttccgtgcgtacaccaagcgctatgagctgattgactcaccactgatgaacgatccgactccggagaagaagtccaagatcgtcgaggcgtccgaagcgttcggcgagcatgtgctgcagccgatcggcgagcacatgccgcgtgcggccaaggggtccaccagccgtgtgccgatgaatgaggaactgcgtttgctgcaggaacagatctatgcgattccgccacacgagacgaaagaatccgatttggacgattccgccaccgtggcgattccgcagcgtggtgccgcggatacgcagcagtctgagcagcccaagcaacgcaagcaaaccaagcagtctgatcaatctgcctccagcaatcctagggcggggtggcgctgatgaccctgctttccgtactcgatattcttctggtaatcgtcggtggtgccggcatgatatatcagggactgtgcatcgtgatgtccctgttcgccaagcccgtgcgcttccccgacgccccgatgaccaaccggtatgccgtactgatctccgcgcgcaacgaagaaaacgtgatcggcaaccttattgggtcgattcgcgatcagacctacccgtccgacctcatcgacatctggctggtggccgacaactgcaccgacaacaccgccgacgtggtgcggtctttgggctgccatgtggtggaacgccacaatcttgaactggttggcaagggatatgcgctgacgtatctgttggggcatatgctcgacatcggtgtggccgatgattatgaggcctacttcgtgttcgatgccgataacaagctggacaagcattacttcgaggaaatgaacaaggcgttctgctccggattcaagattctgaccagctaccgtaattcggtgaatctggcggatagctgggtgtcttctggttctgcgctgtggttcatccgtgaatcgcgattcctgtctaactcgcgtatgattctcggttcctcttgccatgtgggcggtacgggattcatgttctcccgcgaggtgatgaagcggaacaagggatggaagttccacctgctcactgaagatcttgaattcactatggattcgattctgcatggcgaccgcatcggctattgcggtactgcgatcctctacgacgagcagccggttaccttctcgcaaagttggcgtcagcgtttgcgttggagcaagggattcctgcaggtattccgttattatggctcggcattgctgaaacgcgcggttcgcgaacgtgatttctcctgcatcgacttcaccttgatgctgtgtccgtttaccgtgttgggcgtgattcgcgcggtgatgggcttgctgttcgccgcgtgtggcttcgtgagttggtcgagccagctgcaatcgctggccggttggtccagcggcatcatcacatcggtgttgggtctgatggcattggctgcattgaccatcattgtcgagcacgaccagatcggtgccacgaacaaggagctgctcgcctatgtgctcagcttcccgatttacatgctcagctacgtgccgatttccttccaggccatcttcgccaaagcccagtggaagcccatcgcacataagggctgaccgagtccgctagtccggagctgctcagcggggcaatccaacagcaacccgggggtgctgcgctgagggttgactggtgggctagagtagatgcatgagcttagacaatactcaaaggaatgtcggatttcagccgccgatgatgccagccgccgctcccgcgtcttcgcagtcgcaacagccacagccgcaagcatggccgccgaacccgaatacggcggtgtccattcgcggcctgttcaagcacttcgaccggaagatcgccgtcaacgggctcgcgcttgacattccaatcggctcgttctacggactggtgggccctaacggcgccggcaaaaccaccacgctcaatatggtgaccggtctattggtgccggacgccggcaccgccatgattctgggccatgacgtgtggagcgacgtgaacacggccaagcgcatgatcggcgtcatgccccagcccgaccagatcttcgaccgactgaccggtttgcaattgctcgtctactccggcatgctgcgcggcatgagccgcgaggagaccacgcgtcgcgcccaggacctgctcaatgctttcgacttggccggggccgccaacacgatggtcaccgattactcggccggcatgaccaagaagatctgcctggcctccgcgatgattcacagcccgcgcattctggtcttggatgagccgtttgaatccgtggacccggtgtccagcgccaacctcaaagacattctcatcgaatacgcgaagactggcggcacggtgatcatctcctcacacgtgatggcattggtcgaaaagatgtgtacgcatgtggccgtaatcaacgacggtctggtatgcgcggccggcacggtggacgaggtcgctgctggcgaagaactcgaagaccgcttcctgcaactagtcggtggccgccacgaagccgcccatctcgcgtggctcgatggcgggcaggcccaagcccaagcaccaacttcggcccagacgattcagccgattctgcctacgcccgccacacccaccgatgaggcccgccaatgatcaagaccgccatcaccctggtccgcctgcgctggacgctcacgctcgccaccctgcgaaaatcggcgtggcagaccgtcgcctatgtcttttccgctgtactcgcggccggcaccatcatcggcaccggcgtgctcgcatggttcatcggcatactgccgcccttcaccgtgaacgcggatggctttccgctgaacatccttggtcccggaggcatcgtcaacatagtcgtcgtgctggtcggcgcgaccatgaccatcttcatcggcttcatccagctcatgatgcttggcgaaggctccaccatgaacccacgcaaattcgcgatctacggcatcgccgaccgcaacctgcaattcggcttgctgctttccggcctgtccggcatcccctcccttactggcgtggcctcactgatgctctggacactggcctatcggcatatgggaccagccgtaatcatcagttccctcctcgccgcagtgctggccgtcatcaccatgatgagcatctccaaactggtcatcgccctatccaccacgctggtgaccagcaaacgcggcaaaggcgcgttctacatcttcatcgtgctgactttcgtcatcatctgccagttgccgaacattctggtcaactccggcatagccttcagcctcaacaccgagacctggggcgcggcgaccgccatcgccgcatggacgccgttcggtgcggccttccaactgccgttcgacgcgcttaccggagcttgggcggtgctgatcgcccgcatcgccatccttgccgtcacatggatcgtctgcttcgccgtatgcacttggtgtctgaggcatgaacggctcaccatcggcgcaaacagtccgtccgagaccgccaaaggcatcggcgcattcgcatggatgcccgattcggcatccggcgcggtgtccgcacgcctgatcacctatctcaaacgagacccccgccaagccatgaccttcgccatgccggtcctgttcctgatcatcttcgccttccaggcgcacggcatcagcgcggtcgtctggcagtcgctgatctggtgtggctggttcatgtcagtggtggaaagcaacgggctcgcatatgacggccgcggcttcaccatggaagtcatcgccggcgtgcgtggccggaccgacagaatcggccgcgtgcgcgtctacgtcggcatcatggtcgtctacatggtgctgctctatctcgccggcatcgtgctggtcggcgcactgaccggccgctgggcgcagcccgatgacctcgtcaccggcctgatcttcctcgccgtgggcatgggcgtcgccttgagcggcctgggcgtggccgaagtcacgtcctgtgtgctgatgtacccggtcgcctcaatggacaagccgttctccgcgcctcaaggccgcgccatggcccaaggcttcttcccgttcgtctacgtgcttggcagcctgctgctgatgctgcccaccggcatcgtggcgctggtcatgctgctgacgggagccgaaggcggcatatggctggcgattattccggtcgcactggccaacggcatcggcatcctggcactcgggacatggctgggcggtaagctgatggatgcgcgaatgctttcgattgtggcagcactcgactcgttcgcctcattgcagaaatgatcgccttggcataaggagcacgatggtatctacagcggtatcacgccgtcagcggcgtgaagcgcaacggcggacccaacgatcgcatcgccgaacactgaccgtcatcatttccgcactgaccaccatcgccctgttcgcggggtactgcgccgccgacatcaccgacgtggcccccggattattgacgttgaagcccgtcgccgcacctgtttttgccgatccagccaccgccaaatcaggcggcaccgtcgccggcaccttgaacgcgaacaaggccattgattccacggccgcttctgcgctggtcaacgaattgctgtccgcgcaaggcgtgggaaacgatacgtcggtgatcattgaagacgcccaaggcaccgtcgctgccgaacatgagtcgaacactccacgcgagcctgcatccacactgaaaacgctgaccgcgctcgccgcctcatccaccctgaatatggcatccaccttggatacccaagtgttcctcacccaatccgatgacggcaccaatacgttgaccctcaaaggcaatggcgacatgctgctgtctgcaggcgattctgacgccaaccataccaacggacgtgccggtctgaacaccttggccaaggccaccgtggccgcgctcgcccagcgaggcatcacttccgtcaatctcgagtacgacgacaccctattcggcgactcacgcattccggcaggtctgtcggaaggcggcgcagtcttaagcgactacaccgtctacttcacgccggtctcatcaatggcgattgatggaggccgccaatacaccgccgatacgcctgcgccggccgaccccgatgattcggccggatacccggaactgtcccagcacgccgccagcgacgtggccacgaaattcgccgaactgctccaatcgaacggcgtggccgttaccggagacgtgacggcaaacaccgctccatccggcgaaacgcctttgtcttcggtgagttcggcaacactgtccgaaatcatggcatacacgttgcggcattcggacaatacgctggccgaggagttcggcagactcaccgccttggcgaaatcagcgacaaacagtcctgaaggcggcacggaagcggtcaaatccactctgaacgatctcggtctcgacacatccggtctgaccatggccgattgctccggcctgtctcccggctcccggctcaccgtacgcacgctggcggccgtccaacaacgtaatctgaccaccgagagcggtgctgctggtgcggaaggtctatccatcgcgggattggtgggcacggcgcaggatcggtatacggatgatgccgtggctggtctgctgcgcgtcaaaaccggcagcctcggcacggttacgtcgatggccggcaatgtgtcccgcaccaatgggggagcgttgtcgtttgccgtggtggtcaacaatcctgaggattatgccgccgcgcgtagcgccatcgactcgtttatcaccaagctcgcggggctgtaaaagaggcatcaagggccatcaagggctacaaaggccgtaaacgtccataaacgcacgagtgcctataaccagaaaaaaggtggtgagtacatggcatattccgcacgattgcgcaaggccgtaggcgcggtccgcgcaacgctgagtgccgtggaactatgcgatgtgcaggctcccgaattcgcgcagcatggggaccatgccgttgccgccgatgcgccgctcgtgctcgtggcctgttcaggcgggcgcgattcgatggcactggctgcggtgagccatatcgtatgcacgtccatgggcgtgcgttgcggtgccgtgattgtggatcacggcttgcaggcaggctccgaacgggtcgccagcgaggccgcggatcgttgccgcgcgttgggactgggcccggtcatcttgcgcaacgcaaccgtacaggcgcgcggcgagggcctcgaagcggccgcacggcaggcccggtatgacgagctgtgcgccgcggcgcatgaatcgggtgccattgccgtgctgttggcccacactatggacgatcaggcggaaaccgtattgattggcctgctgcgcagtcgaggcgtggatgcgttggctggcatgccgcaggtcttcacacgcagtggcgcgacttttgcgcggccgctgcttacccttactcgagccgaaaccaccggcatctgtgaagacttaggtgtggaatattgggatgaccccaccaatggcgatgcggtagacggcgagttgccgaacgactatccgttgcgctcgcgggtgcgtcacgacctgctgccggccatcgaacgattcgctggattcaatgtcacccgccatttcgccgaaagcgcacggttggccagaatggataaggagtatctggatcagcgatccgacgaggtgatgggggaggcggttgcggcagttgattggccggcatcgtcggcagcggtatcgaccgatgcgccacgagcctgtgtggcaggcgataccaacgattcgagccatggcatcggcctgatgatcagcgtcaaacgtattgcacgtgagccagaggcgattcggttgcgggtcatcgctcacgcgctgagccaagccggtgtgaacgccagtgctgcccagattgccgccatcgaccggctggtcgtcgattggcatgggcaaggcggcgtctcacttcccagaggttattcagccaatcgcaagaaacacgtcattcgcgtgtgccaagatggagcgcatgcgaatcgctgacgttgaggaagatattgaccacgagctggtcagcaaagaacagattgatgccaagatccacgagatggctgctctcgcgagcgaggattaccgcgataagaatccgctgctcgtcgcggtgctgaaaggggccgtgaatacgctggtcgcgttcacccaggccatgagcattcctgtacagatcgacttcatgagcctgtcgagctatggctcgggcacagtgtcgagcggtgaggtcacagtcaggcaggatttgtccgccgatgttcgcggacggcacattttgattgtggaggatattgttgattcaggacgcacgctcgcgtggctggtcgcagaactgaaacgtcgtggtgccgcttccgtggaagtcttcgctttgctgagcaagccttcccgccgagaggtggacgttgatgtgaagtacgccggctatgagattccggacgagtttgtcgtcggcttcggcctcgactttgacgaacgctaccgcaacctcgattcgatcgcggtcctcaagccgtccgtctaccaaggagtgcaagcatgagcttcccgcaagggccgggtaacggcaataacccgaacccgaacaacaaccgtaacaacggcaacccgttcaccaacccgttcaaccgtggcaataacgggaacaatggcaaaggcaacaaagagaaccgcccgatatggcagtccccctggctgtggggtgccgtgctcgtggtcatggttgtgctgatgttccagatgttcgccggcggtggcaccaaaaccatcgatactaaagatggtttcgcgctgatcaatcagggcaaggccacatacgccgagatcacggacaacaagcaggtcgtccgccttgagctgaagaatgactacaccaagaagaacgccgacaccggcaaggtgaccaactacggcaagaacgtgcagttctactacactttcgcccagggcgcacaggtggccaaggccgtggagaacggcgatctcgaaaagggctggacctcgaatatcgagcagaccagtgtgatgagctacctcatcacctcgattctgccgttcgtcatcatcctcgccttgttctggtggctgatgagccgcatgggcggtgccggcggcatgctcggcatgggcggcaagaagaacagcggcaagctgctcgagggccagacccccaccaccaagttcgccgatgtggccggtgaagacgaggccgtggccgaagtcgaggaaatcaaggacttcctcaaggatccgtccaagtacaaggcgctgggtgcgcgcatcccgcgcggcgtgctgctgtacggccctcccggcactggtaagacgttgctggcccgagccatcgcaggtgaggccggcgtgccgttctactcgatggccggctccgacttcgtcgagatgttcgtcggtctcggtgcctcccgtgtgcgtgacctgttcgatgaggccaagaagaacgctcccgccatcatcttcatcgatgagatcgatgccgtgggtcgcaagcgtggctccggtatgggcggtggccacgacgagcgcgagcagacgctgaaccagctgctcgtcgagatggacggtttcgacaacgacaccaacctcatcatcatcgccgccaccaaccgtcccgacgtgcttgaccccgctttgctgcgtccgggtcgattcgaccgtcaggtgggcgtggccgcccctgatctggaaggccgtgaggcaattctgagggtgcacgccaagggcaagccgttcgtaccggacgtcgacctgcatatggtcgccgtgcgcacgccgggcttcaccggtgccgatctggccaacgtgctcaacgaagccgcgttgctgtgcgcccgtgccggtgcccagttgatcgacaaccgcgccatcgacgaggccatcgaccgcgttcaggccggaccgaagcgcaagtccaagggcatggctctggaagagctgcgcaacaccgcataccacgagggtgggcatgcgctggtagccgccgccctgaacaacaccgacccggtgaccaaggtgacgattctgccgcgaggccgcgccctcggctacaccgccgtcatgccgacctccgaccgctactcgcagtcgcgcaaccagctgctcgaccagatggcctacgcgatgggcggtcgcaccgccgaggaaatcgtcttccacgacccgaccaccggtgcctcgaacgatatcgagaaggctacgaacatcgcccgtacgatggtgatcgaatacggcttctccgacaagctcggtgccatcaagtggggttccgacgatgaccagaccactgtgatggacggtctgcagccgcgcaagtactccgaccgcaccgccgaagtgatcgatgacgaagtattgaagctggtggaaaccgcccacaccgaggcgtggaccatcatcaacgacaaccgcgagatccttgacgagctggtccgccagctgttggtcaaggagaccctgaacgagaaggaacttgcggcgatcttcgcgccgatcaagaaggctccggttcgtccggtgtggttgtccaacgaccgtcgccccgactcggacaagccgccggtggagatccccgaaagccttaagcgctcggtcggcatgaagccggaagagtagacacgatgacgattcggcccgacctgttcatgtggtttctcacgtacgcaggccggtccgacgtcgttgtggacaatgacaagggagagatgagatgaacgaatatatagagtcttgccatcgggagaaacacacatacgacgaggaaggcgtgcgcgaggccgtacgcctgttcctgaagtcgattggcgaggatcccgagcgcgagggactggtggaaacgcctgaccgtatcgcccgcgcgtgccgcgagctgttcgccggtctgcaggcttccccggccgatgtgctggagaagcacttcgacgtggataccgacgagctggtgctggtcaaggacatcgaactgtattcggtgtgcgagcatcacctgctgccgttccacggcgtggcccatgtgggctatattcccgccaaggacggggtgatggggctgagcaagctcgcccgactggtcgaggtgtatgctcgccggccgcaggtgcaggagcgtttgacccagcagatcgccgacgcgctggtcgagtatgcgggcgcacgtggtgtgattgtggtgaccgaatgcgagcacctgtgcatgtcgatgcgcggcatcaagaagtcttccgcccgcacggtgacctctgcggtgcgcggcatgctgcgcaatccggccacccgagccgaagccatgagcctcattttggataaatagtgtctactaagctccctcatcatagggaactcacttgggacctacatagaaggggaaacataatgactgatttgcaggcgttgcatgacagtacgcacaccatggtgatgggtgtgctcaacatcaccgaggactcgtcctcggacggcggcctgtggttggacccggccaaggcggcacagcacgggcgcgacatgatggccgccggcgcggacatcatcgacatcggcgccgaatccacgcgccccggcgccaagcgcgtgtctgaggccgacgaattggtccgcatcaccggtgccgtcaagacattgattccggccggtgccatattgtccatcgacaccacgcgcgcatccgtggccgccgctgcgctgagcgagggcgcccagatcatcaacgacgtttccggtggcacgctggacgccgaactgccgcacgtggtcgccgaccacgactgcctgtacatcgtgcagcattggcgcggctggctcgccggttccaagggcgcgaaccccgatcaagacacctccgtctacgagcacggtgtattgaccgacgtacacgacgaactcatgcgccaagtcgacggtgtgctggccgccggcgtaaagcctgagcgcattatcatcgacccgggcctgggcttctccaagcccggcatcgagcacaacctgccgctgctgaccggactcgagaccttccgcgccactggatatccggtgctgatcggccagtcccgcaaacgcttcatctcggcgatgcttaccgaggcgggcgctgccggtgctgatgggccgatcatggcccagcgcgatgacgtgaccgcagccttgtccgccctgtccgccgaacacggcgcatgggccgtgcgcgtacacgacgtggccaaaagccgcgccgccgtcatcgccggcaacacctggcgcgaatacgcatgattcccctggctccctgttttggttgcttctaggccttggctcccctcgggcgaggggagctggcgccgaaggcgactgaggggagcatttgagcagaaagccttaccaatggacaccatcacacttaccggcgtacatgccaacggcacccacggtgtgctcgccttcgaacacgaacggccacaaaccttcgtcgtggatgtcaccctgcaccttgatctggccgcagccggtcaatccgacgatctcaacgacaccatcgattacggccgtgtggccaaggacatcacggctgtcatcgaaggccctcatgtggacctgatcgagcgtctggcccaacgtatcgcggataagatccttgccgatgcgccggccgtcgcctccatcgacgtcaccgtgcacaagcctcacgcacccatcgtcgtggcttttgcagatgtatcggtctccatctcgcgcgtgcgtgccaccgataatggacgcactgctgaagagcatgccatccataacgcggtggtggccttgggcggcaatgtgggcgaggtggaatccaccttgcgagccgccgttcgggagattgacgcgttgcctggcacacaggtgaccggtatctcaccgctttaccgcacggccgcgtggggcatggccgacggtacgccggatttcctgaacgccgtggtggagcttgaaaccacaatgggcagccacgaattgctcgccgcgttgcaaagcatcgaggcgaaccatgggcgaattcgtgagaatcattgggattccaggccgttggacttggacattatcgactttgatggcatcaccagcgcggatccggatctggcattgccccatccgcgtgcttggcagcgtgcgtttgtgctggctccttggttggcattgaatccgaacgccaaactcgccggagcccatgaggggcctgcagccgatttgctggccgccgcaccggaccgtaacgccgtgcagctcgagagcgaagactggatgctcggcgggcatgcagtcaagcaaaaatcagcgtcggagtcggcacccgtctcacgcaaggcgattatttcgctggattccacctcgcaggatgtcgaacggctgttccgcgaaaccatcgtttccatcgacagtgttcctggcaatcaggtacagggcatctcgccgctctaccatgtcagccatttcgacggcccggacgcgatgagcgcggtcatccaaatcgaaaccaagttgccgcccgccgacctgattgccgtattgggcagcatcgaaagtgttcatgatctggcagtcgaccttgaccttgtcgacatggaaggcgtgacttccgacgagcccaactgcagcattccttggccgtcggcccgtaaccatgcgtcggtattggcaccttggctggatatggacccgaatgcttctctgggcggcgacccggtggccttccttttggccatggcaccggatgccggacaggtcggattgctatcggacaactggatactgtcgaacagttgagctgatggcggaaccagttacgaacggtaggctagaaaccagacggtgacggaccagtctccggcctcgaacagccgggcacggcagtgacgaaaaccaaatcaagatgaacagcccaggcgcgagggccgttcgcaaacagcaaacagcaacgcaacgataaggaggccggacatgaaaacacggcgaacaccatggtggcagtatgtgatcggtgccgtgctgggcctgttggcgggtatcggtctggcctcctacggcgaaagctcgggactgtcgctgattggtgcgccttggattgtgaccggattgctggccgtgctgggcgttatcgtgctgatcttggccctgcaagtgcataaatacgcgaataccgaccccaagaagcgtccgcatagcttcatcaatcccactatcgcggtgtatacgctggtgctggcaaaggcactgggattggcgggcgcaacgcttgccggctggtatggcggtcagattgtgatgagcctgagccatatcgaggcggatttctatgcacacgccgtcaccgagtgcgcaatcgcggccgtggtgtgcatcgccgacatgatcatcggcattatcggcgaatggttgtgccagctaccgccgaacgaaggccccgaaaacccgaaaatcaaggaagccaagcgccgtagcgacatagcccaagcctacaaaagataatccgtgataagccccctctgacgagggggccgtaggcgtagccgactgggggagagaagaaaaaaccacaccatcggccaagccgattcccgctattcctgcggcacgcgaaccatagcttcctgagcgatggccgccaccaagtcgccattctgcgcatacactttggcgatgccgagtccgcgcccgtgcgcggcgataggcgtatcctgcacatacaaatgccattcgttgatatcgatatcctgataccaccacatcgaatggtcgatggacgcataggaaatgcccggtgtggaaatcgacagtccggcgcggcgcagcaccggctccatcatcacctgatcgcagccgagtgccagcatcgcacgatgcatgacctgcggcacatcgacgtggccatcggccttcatccacaccatctgcttgccggaatcatgctcggcggaatctttgtccgcgcgcagcatcacggtcggcgtcacgtggcggatatcgaacggcgatttctcggcatagtaattggcgaacggcgacttttcggcgaacggctgcatgagttccttggcggaagtcaacgtttcgggatcgggcaggttttccggcatcggatcggcaaattccacaccctcctgaccggtctcctggaaggaggcgatggccgtgagaatcgacccctcggcttgggtgacgttgacccgacgagcggagaacgagcggccgtcgcgaaggttctcgacgtcaaacagcaggtcttgacgaatatcgccggcggcaatgaaatagccatgtaccgaatgcggcaggcgtgaagggcccacggttttggacgcggcaatcaccgactgggcgatgacctggccaccgtagacgcggccggtggggaagtacatactctcgccattgatgtatgtgtgattgcggtaagcggaaggctcgcccaactccagcaccttcaccagatggtccaatggagttacggtggttgcctgagccatggcgttcctcgattcttgttctgctgtgttcgatattcggttatcgtattccaacctatggttggcagtctatccggtgggggttaagagttccgggagcgaaatgtaacgagactgtttggaaggtaaacggttggttatgcggtgcgttgtcgctacgttgccgctacgttgctgctgcgctgccggtgtgttgccgtaggcgactgtgggattttatgggatgcggtgcggggcagccatggggcaattatggggaaagccgcccctgagggacggctttcgacgtataaagcacgttgtggcactaatgccggcgtatctcagccgcgcacaagcttcttgtgcaggcggtgcgggcgggccgcatcctcgccgaggcgtgtcaccttgttctcctggtaggcctggaagttgccttcgaaccagtaccacttggccgggttgtcgtcgtcgccttcccacgcgaggatatgcgtggcgacacggtcgaggaaccaacggtcgtgggaaatcaccacagcgcagccagggaattcgagcagcgcgttttcgagggattccaaggtctcgacgtccagatcgttggtgggctcgtcgagcagcagcaggttgccgccctgcttcagggtcagggccaggttcagacggttgcgctcaccaccggacagcacaccagtcagcttctgctgatcggcgcccttgaagccgaagctggccacataggcgcgggtcggcacctccacaccggccacctcgatgaagtcgaggccgccggacacggcttcccacaggttcttgttcggatccaggccctcacggttctggtccacgtagctgattttgacggtgtcgccgatcttcagctcgccgctggtcagcggctccaggcccacgatggtcttgaacagcgtggacttacccacgccgttcgggccgattacgccgacgatgccgttgcgcggcagcgtgaaggacaggtcgtcgatgagcacacgctcgccgaaggccttgtggatgtggttggcttccagcacggtggaacccaggcgcgggccggccggaatctgaatctcggagaagtcgagcttcttgttgttgcgtgcctcgttttccatctggtcgtaacgctccagacgggccttgttcttggcctgacgggccttgggggaggagcgcacccagtcgagctcgttcttcagtcgcttggcgagcttggcgtccttggctccctggatctccagacgcttggccttggtctccaagtaggtggagtagttgcccttgtacgggtacaggtggccgcggtcgacctcgcaaatccattcggccacattgtccatgaagtaacgatcgtgggtgacggcgatgactgcgcccttgtactggtgcaggaactgttccagccacaggatggactcggcgtccaggtggttggtgggctcgtcgagcagcagcaggtccggggcctcaagcagcagcttgcacagggccacacggcggcgctcgccaccggagcacacgttgaccggggtgtccggatcggggcactgcagggcgtccatcgcctgctcgagctgggagtcgaggtcccagccgtcggcggcgtcgatctcggtctgcagcttgcccatctcttccatcagggcgtcgaagtcggcgtccgggttggccatttcctcgccgatagcgttgaatcgggcgaccttctcggcaatcgggccgaacgccatcttgatgttctcgcccacggtcttggtgtcatccagcggcggctcctgctgcaggatgccgaccgtgaagcccggggtcagcgtggcctcgccgttgctcacggtctccaggccggccatgatcttcagcagggtggacttacccatgccgttcgggcccacgacgccgatcttcgcgccgggcaggaagctcagggtcacgtcatcgagaatcacgcggtcgccgtaagacttgcgggccttgatcatctgaaatacgaattctgccatgttgtgcagttactccttaaaaaggggttgaaattccgctgtttctttagtctttagtttgtgatggatacgctgtgtgcagcgcggagcacgcccccgaatcacggatcgcggtgcgccgcgtcaggcctgtgccgccctgtccgcataacgatcgaatccacgccaaaccaccgcccaccatggtatcggaagggctggaatggcgggcgtcgctatggcttggaggggtaatggatgggcctgacattgccgtggcgcgacgcgccgggcggcgcgccgtggtccagtgatgctgtagtatatcctcttgtgcttcattgaggtacagatggccccgtagctcagttggttagagcgccgccctgtcacggcggaggtcaccggttcaagtccggccggggtcgccaccaagctcctgacaaatgtcaggagcttttttgttcttttgccgtatttcgtggtgtagggcgaaatatggggttataggccaaaatgtgtgtctggtgtttagtcgtttgatggccattcgactctggcatggaagctgtttcagtcgatgccgatgccgtatcgcatggaaataccgaaggtttcgtgctggccttggggctctgctcgacacgccgatagtctgaatgacaacgtttgctattgaatgacaacgttagcgttaacagtgcttataaatggtgaaaaacgtgtgcagggtcacattggcagaacgtgcgcgagatatgacaaatcatgaaaaatacgctatgggaggtcatggcaactcgttactattttcgctgtctcgtacgccacacaagccttcaaggagtaagccatgaccacgctcgccattgatatcggaggaactaagatcgccgccgccgtctgcgatgaaaacgatagcatcatccagcgctggcgcgtccccacgccgatggatgccgacgccatcaaccagcacatcgccgaggtgtaccgcgaggctgtggccgccggacacaccgatatcgaggccatcggcatctccgccgccggcaacgtgagcgccgaccgcaagacgctcaccttctccgccaacatcccggcctggatcaactacgacctgtccgagcacgtcggcgcgctgatcgaccatgccgtgccggtcgttgtcgagaacgacgccaactgcgccggctggggcgaatacgtgcacggtgccggccagggcagctccaacatggtcgccctgaccgtgggcaccggcctcggcggcgccatcgtgatcaacggtcagctgtaccgcggctccttcggcatggccgccgaactcggccacctgccgatggtcccggacggcgaccactgcggctgcggcctgcgcggctgcgccgagcgctacacctcgggcacttcgctggagaacttcgccaagtccgccgtgcgccgtcgtccgcaggatgccaagcgtctcatggagctgtgtggcggcgacatctccaagctggaaggcccgatggtctcccaggccgcccaggaaggcgacgtgctcggcctgtacgcattcggcaagatcggcgaatggctgggccgcacgatggccgcagtctccgccgtgctcgatccggacctgtttgtgatcggcggcggtgtggtggccgtcggcgacattctgctggagccggcccgctacaactaccagcgtttcctggaaggcagcgcctaccgcggccatgccaagatcgtcgccgccaccgccggccaagacgccggcctcatcggtgccgccaacctggctctgcgctgacgatgccgctccggcaacggggcgttagtctaatggtgagtcatggccggtgccatggctcactgccgcgctgatagtgcggtcgatgagtttccgctgcctgaccatggaatcgaatttcgggttctcggcgatttcctcatactcgtgttcggtggtcacgccggcgatttcggcgataatctcctcataggacgtttcgacggttcgatgcacgccggtgacgtgcccctgacgtatcacgacaatgcggtcggataccgcgaacacatccggcagatcgtggcagaccatcaccacggaccggccttcggagcgcagtcgcttgatatatgcgagcacttccgccgactgcatcaccgacagtgcggcggtcggttcgtccagcagaataagctgcgggtcattgagcagcgtgcgcgctatggccacggtctggcgctggccgacggataaggatgcgataggggagccgacccgaatcgccgagctcagggtcttcagcacggaacgggcacgcgagttcatcgaatcgtcatcgcgtatgccaatctgattgatctccttgccgaggaacaggttcgaggccacgtccaggttgtcgcagaactcctgcccctggaacaccgatgcgatgcccatgcggtccgcctccctgatcgagggaatggtcacctgttcgccgttgagataaatatggccgaatcccggctgcagaaatcccgcgatgaccttgatcagagtggactttcctgcgccgttatcgcccacgatggcgatgacctcctggcgctggatggacagattcaccgatttcaacgcctcgacgaagccgaacttcacacagatgtcctccagccgcagcagaggaggtgtgctcgaattcctcatggtgtgttccttcttatcactcttctcctggtaccggtcactggctgacgtcattgcgaaccgagaactcgatggcgcataatgcgccgcctagcgcgcaattgtcgtccgggtgggatgacacgagtacatcgatgggtgccacggcatcagggaacagcatgcgctgcaacgcttcattgaacggttggatgaatacgtcgccggtcatggccagcttgccgccgagcacaatgacctccggatccacgctgatgcacagatcagccgccacctgaccgatacgcacggccgtgtcggcgatgatgcgacggcaaccggggtcgccttcgttggcaaaggacaccagatcatccagcgtcatattgccgtgtgtgacgctgagcaactgcaccagcctgttttccgccacgacggtgtcaaggcagccgcggttgccgcacgaacagatggcacccagcgggtcgacctggatatggccgatttcaccggccaggccggtcacgccatgcatgatttcgccgttgatgacgatgcctgcgccaaccccgtcgttggctgagatatatacgaaattgcgtttgcctgccgccacgcccatacgggattcgccgtatgccgcgaaattcgcgtcattatcgacgtatacgggaacgttgaacgccgtgcgcaacggggccgtgatatcgacgccgtcccatccgggcagaatgccgggaatcgctatggtgtggtcgctggtggccaccggtgcggccacggccacgccgatgccgaccagctcgctggcttcggcgtcgatgctgctcagggtctcattgatgagcagcatggcgcgttccagcgttgtgtccgccttgtggcccaacggcagggggagcgtgtgctcagcgatgattgacttcgagaagtcaacgatagaaagcgtgagatgacgtcgcgcgatccaaagcccgacgccgaggccctgatgccgtgcaagggtcaccagagtggctctgcgaccgttgcgaacggtgtttttggtctccagctggtcttcgtcgacaagctgatggacgagcgtggacacggtcgcagtggacagtcctgtcacctctgccagttcgacctgtgtcatggcgccgaacttgtggatactggccagcaagttggcgcggtttgcctcgcgaagcgaggtctgcgaaccgaaaagccttgttgccataagaatccagtgtagtcgttaccggcatgaggcacagcgaggcgcagagcgtggatttttcggcgtgtcgccttgtgatgcgcgaaaaatcgccattgcgttcattggtcgaacataaacgacaggaaattcgctttcttgagtttgacaacttaactcaatacggtattctatgagatgaacctgaggttattctcaggttcgggcgaccaaggagggttcgccatcccctcgaagatgaaggagaacaaatgaagttcactaagaagatcgtcgccgtggtggcaggcgttgccatgtgcgcgggcctcgcggcctgcggtggcagccgtagcggccaggcaactggcggtgatgccaagatcgaaaagggcgccactatcggcatttcgatgccgaccaagtccgaagagcgttggaacaaggacggcaacaacctgaaggccaagctggagaaggccggatacaaggtcatcctgtccttcgccgacgataagccggcccagcagaacgctgacatcgagaacatggtcaacaacgacgccaagatcgtcgtggtcgcttccaaggacggcaccgcagtgggccccgccgttgagaaggcccgcgatgcaggcgccaaggtcatcgcctacgatcgactgatcatgaacaccgacgccgtcgactactacgccaccttccagctggagcaggtcggcgtgctcgaggccacgtatctcattgaccagctcaagcttaaggatggcgccaccggcccgttcaatatcgagctgttcaccggttccccggatgacaacaacgccaagtacttcttcaagggcgcttgggatctgctgcagccgtacttcgagaagggcgtgctcgtctccccgtcccagcacggtcagggtggcgtgaccaaggacttcaccgttgaggattggcagaagatctccgtgatgagctggaagaccgagcaggcgcagaaggacatggaatccatccttgactccacctacgcccacggcgagaagctcgacgcggtcctcactccgtacgacggcatcgcccagggtgtgatcaacgccatcgaatccaagcgtcccgacatgaagccgggcaccgactcctggccgtacatcaccggtcaggacgccatggagatcgcagttgccaacatcgccaaggataagcagggcgagaccgtgttcaaggacgtgaacaagctggctgacgccgtgtacgacatggtcgtcgagatcgccgagggcaaggaagtctccggcctgaacggcaagttcaacaacaacaacatcgacgtcccgtccaagctgcttgacccccagaacatcaccaaggacaacctccaggatctggtcacggccaactacatcacccaggatcgcttcgacgagctgactaagtagtcctcatcaggcaatccgtaaacaaacacaatgacatgcggcgcatagccgatatgcgccgcatgtccatgaacacagaactgtgacgaggagtgatgacatgtcatcaaatgacaccatcttgacgatggaaaacatcacgaagacgttcggtccggtcaaagccctcaccgatgtgaatctttccgtcgatcgcggcgagatccacgccatctgcggcgagaacggtgcaggcaaatcgaccctgatgaacgtgctttcgggtgtgtacccatacggtagctattccggcaaaatcacctttgatggcaaggaatgcaaataccatactattaatgattccgaggccgacggcatcgtaatcattcatcaggaactggcgttgagcccgttcctgtccattgcggagaacatcttcatcggcaacgagcaggccaagggtggcgtgatcgactgggacaagacccgcgccgaggcgaagaagctgctcgatcgtgtgggacttcccgaagacccggataccagggttatggacatcggcgtcggcaagcagcagctcgtcgaaatcgccaaggcattgtccaaggacgtgaagctgctcatcctcgatgagccgaccgctgcactgaacgatgaggattccgcccacctgcttgacctggttcgtcagctacgtgacgagcagggcgtgaccagcatcatcatcactcataaactcaacgaggtcgccgccatcgccgacaatgtcaccatcattcgagacggttcgaccgtcggtgtgatgtacgtgacgccggagacgccgctcgaccaggaagaactcatccgcaagatggtgggtcgtccgctgcgcaacctgtacccgaaccacccctccaataccccgggcgaggaatacctgcgcgtcgaggattggaccgtgcatcatccgctcgacgcggagcgcgtgatcgtagaccatgcgaacatcaacgtgcacgccggcgagatcgtcggtctggcgggtctgatgggtgcgggtcgtaccgaaatggccatgtccatcttcggccactcttacggttccaacatctccggcaaggtgttcgtcaagggcaaggaagtcaagatgcccaacgtgcagtccgcgattgacgcaggtctcgcctacgccaccgaggatcgtaagggcaacggtctgaacctgctgcagaacatccgagagaacgcatccctggcctccctgaccaagatcagcaagggcggggttgtggacgacaaccttgagcacaaggaagtcgaacagtaccgcaaggacttcaacatcaagtgccatgacatcgatgtgaatgtctccaccctctccggtggtaaccagcagaaagtgctgctcgccaagtgggttatctcgcagccggacatcctcatcctcgatgagccgacccgaggcatcgacgtcggcgccaagtatgagatctacgaaatcatcgataaacttgccgatgcaggcaaggccgtcatcgtgatttcctccgagctgcctgagctcatcggtatctgcgaccgcatttacacggtgtcctacggtgtcgtcaccgacaatgtcgagaagaatggatttacccaggaatacctgatgaagggtatgaccaaggaaagggaggtggcagcctgatgagcgccgcaactgcaacacctgcaaagaaagaagaaaagaccggcctgctggccacggtcgccaacaatgcccgtcaatacggtattgtcggcgcactgctgatcatcgtcgtggccttcgagatcctgaccggaggcgtgctgctgaagccgaactccttcgtgtccctgatccagcagaacgcctacgtgatcatcctggccattggtatggtgatggtcatcatcgccacccacatcgacctttcggttggttccttggtagccttcatcggtggtgtgtgtgcactgctgatggaacgcgccggagtcaaggggctgcggacgttttcttggagaccgaacggaaggattttcgtatgttcagtcttgaggaacgagagcgtgcggtggagttgtatttcaccacgccgatgacgacggcccaggtggtggagcatcgatgagtacatacgctggtacaaccacgagcgcatcaaacagtcgcttggttggatgagcccggtacaataccgtcaaagccaaggaatggctgcgtgattatctccaagaaaatgtccgcagccccaattcgtcttactttttttgcgcagtttttccctgcgcgtgtcgcgatgatgcgaatatagatgtgaaggttaacaacgtagtcgtttattgggttttgtgatttcactcacgttgtaattcaatgtcaaatatgtggcgattctccgtatttgctgagattgcttttaagaatagcttcttgtaaagtgtcttatcgtaattgcgagtgcgtattcttcaatgaagaaggcatctgcttcacctcgaagaagagattaaggaaaatatagttaatgaaaaagaagaagactatatcggctgcgctggcaacagcgttagccttaacctgcatgggcagcgggggaggtactgcgttcgcaatgcccctgtctgatgctgacttgcagactttggcaagtcagattcagcaaatcaacgatacttctgattctgcaactgcttccgagactccttccgcacaagccgatgcggttgaaggctggactattgattccaacatcgctcagggcggcgaaatcctggagatggcaaacggttggctgcacctcaagtccactgcctttaacggtaatgcggcagcgaaccccagctccagcaacaactggccggcagtagccgtatggggcacagattacgacttctccaaggccggctccttccacgccaccatcaaatccccgcaggaaggctccgccaaccgcttcggcttctacctgggctacaaagacccgggcagcggcctgttcatcggctacgattcgggcggctggttctggcagacctacaccggtggcggtagcggcagctggtacagcggtgctcgtatcgctgctccgagcgccaacgaagagcacgacattcaggtctcctggaccgacgccaaggtcgccacactgaccgtggatggccagaaggcattcgatgtcgattactccgcaatgccgaacctctccaacaagcttgccatcaaggccggctcctggaaggagctgaacgaggtcaccgacgtgtacatcaaggacttcccggaggttgtcgaagccgccaagcacgcggtttccggcaaggttgtggacgctgaaggcgctgccattgaaggcgcaacagtgcgtttggataagaccaaggtgaagaccggtgcagatggcaccttctccttcgccgacattgaagaaggcgaacacacgctttcgattgccaaggaaggctatgaggacgtctcccagcaggtggcggtctccggcgcggaccttgccatcgatcccatcaccctgaacaaaaccgttcaggtcgcctccgaaacgctgaagaccgagaagatggaagttcagattaagaagaacttcccctctgtgctgcagtacacgatgaccgacggcaaggtgatgtacggccaaaccaaggatgtgcgcaccgttgagatcaacggcaccaacatcgaactgggcgatgacgacgtgaccttcaagaaggtttccggtaccgaagccacctacacgctgaaggtcaaggatgaggccaagaagattgacgcggtgatcaccgttcagatcacggtcaaggtcaaccagctgcacctcaacgtcaccaagatcaagaacaacctgtccgaaggcattcctgagggcaacggtgtggaggagaacgccatccagacgctgtccttcccgaaccagagtctcgtttccgtgcgttccagccaggaaaatgcccaattcactggtgctcgtatgtcttccaacacgcagaagcctggcgataccaacttcgcagtgaccgaagatactaacgtcaccgatagcgactacacctacggcttcatctccggtgctggcctgagtgccggcctgtggagcaactccgagcacgatggcacctatgtggcggctcctgtgcgcggcggcagccagaacacgcgtgtctacgccaccacccagcagactggtgacgccacctccctgggcctggccagcgctccgtggtactaccaccgcacggtcaccgattccaagggcaagaagtacaccgtggccgaaaccgctctgccgcagatggccgtggccatcgccggcgacgagaacgaagacggtgccgtcaactggcaggatggcgcaatcgcctaccgcgacatcatgaacaacccgtacaagtccgaggaagttcccgaactggtggcatggcgtatcgccatgaacttcggctcccaggcgcagaacccgttcctcaccacgcttgacaacgtcaagaaggtggccttgaacaccgacggcctcggccagtccgtgctgctcaagggctacggcaatgaaggccacgactccggccacccggactacggcgatatcggccagcgtctcggcggcgccgacgacatgaacaccatgatggaagagggctccaagtatggcgctcgcttcggtgtgcacgtcaacgcctccgaaatgtatccggaagccaaggccttcagcgaggacatggtgcgccgcaactctgcaggcggcctgagctacggctggaactggcttgatcagggtgtcggcatcgacggcatctacgatctggcatccggttctcgtgtaagccgtttcgctgacctcagcaaggaagtcggcgacaacatggacttcatctacctcgatgtgtggggcaacctgacttcttccggttcggaagattcttgggaaacccgcaagatgagcaagatgatcaacgacaacggctggcgtatgaccaccgaatggggttccggcaacgagtacgactccaccttccagcactgggcagctgatctgacctacggcggctacacctccaagggcgagaactccgaagtgatgcgcttcctgcgcaaccaccagaaggacagctgggttggcgactacccgcaatacggcggcgctgccaacgccccgctgctcggcggctacaacatgaaggacttcgaaggctggcagggccgcaacgactatgccgcctacatcaagaacctgtacacccatgatgtgtccactaagttcatccagcacttcaaggtgacccgctgggtcaacaacccgctgctgaccgccgacaatggcaatgccgctgccgtgtccgacccgaacacgaacaacggcaacgagcagattaccctgaaggattccaacagcaacgttgtagtagtctcccgtggttccaacgacacctctagcgcagcctaccgccagcgcaccatcaccttcaacggcgtgatggtggcttccggtgctgtctccgcaggcgatggttcctccactggtgacgagtcctacctgctgccgtggctgtgggattcctccaccggcaagctggtcaaggattccgaacagaagctctaccactggaataccaagggtggcaccaccacttggaccctgccggacagctggaagaacctctccagtgtgaaggtgtaccagctcaccgatcagggtaagaccaacgagcagaccgttgccgtctccggcggcaaggtgacgctcaccgctgatgccgaaaccccgtacgtggtgtacaagggcgaggccaagcagattcaggtcaactggagcgaaggcatgcacgttgtggatgctggcttcaacggcggctccaacaccctcaccgacaactggaccgtcagcggctccggcaaggctgaagtcgaaggcgataacaacgccatgctgcgcctgaccggcaaggttgacgtctcccagcgcctggccgaccttaaggccggccagaagtacgcactgtacgtcggcgttgacaaccgcagcaccggcgacgcatccgtcaccgtaaccagcggcggtaaggtgctggccaccaactccaccggtaagtccatcgccaagaactacatcaaggcatacggtcacaacacgaacagcaatacggaaaatggctccagctacttccagaacatgtacgtgttcttcaccgcgcctgagaacggcgatgccacggtaaccctgtctcacaagagcaccgacggagcacacacctacttcgacgatgtgcgcatcgtggagaaccagtactccggcatcacctatgagaaggacggcacgctgaagtccctcaccaacggattcgaaaacaacgcccagggcatctggccgttcgtggtctccggttccgaaggcgttgaggacaaccgcatccacctctccgagctgcatgctccgttcacgcaggccggttgggatgtcaagaagatggacgatgtgctcgatggcacttggtctgtgaaggttaacggcctgacccagaagggcacgctggtctaccagacgatcccgcagaacgtgaagttcgaggcgggtgccaagtacaaggtgagcttcgactaccagtccggttccgatgacatctacgccatcgctgtgggccagggtgaatactctgccggcagcgtgaagctgaccaacctgaagaaggctctgggtgagaccggcaaggccgagttcgagctgaccggtggcgtcaacggcgattcctggttcggtatttactcgaccgcaaccgcacctgatctgcagggttccaccggcaatgcacaggacttcggcggatacaaggacttcgtgctcgacaacctgaagatcgagcgcatcgagtcccagacccgcaccaaggccgaagcgcaggacaaggtcaaggaaatccgcggcaagtacgattccaagcgtgctgagctctccgatgccgcatggcagcagtatcaggacaccttggtcaaggctcgcgtgctcatcaacaagaatggcgcaaccgctgaggacttcaccaaggcatacgacattctcgtggccctcgacgagtacatgaagaccgctcccggcaacgagagcagcgacaagtacgacgtggcagctgacggctccgatgagctgggtggctacaccgtggccacgggcagcgaagagcctaccgcaggcctgccgagcgaaggcccggccgatctggcacaggatggcaacgacagcacccactggcacaccagctggagcgagaacgcagtcggcaacggcaccgcatggtatcagttcaacctcaacgaaccgaccaccatcaacggcctgcgctacctgccgcgctccggaggtatgaacgccaacggcaagatcaagggctacaagatcacgctcactctggcggatggcaccaccaaggatgtcgtcaccgatgctgagttctccaccaccaccatgtggcagaaggccagcttcgacgccgtcgagaatgtgaccgccgtacgcttgaccgtcctgtcttccgcaggccagagcgactcccaggccaacaagttcgcatccgctgccgaactgcgtttgaccacggaccgcgaggttgaggaagagactgtcgctccggacaagaccgacctcaacgacaccatcgccaaggctaacggtcttaaggaatccgactacacggctgaaagctggactgctctggtcaaggcccgcgaagctgcacaggccgtggcggataacgataaggccaccgcttacgatgtggctctggcgctgacgaacctcgaatccgctatcgctggtctcgagaagaccggtgaggagcctggcccaggcccggttgaggtgaacaagaccgacctgcagactgcagtgaacaaggcaagcaagctcgagaaggccgattacacgaccaactcgtgggaagctttcgccgaggcactgaaggctgcacagcaggtgctcgacaacaagaacgccacccagcaggatgtggataccgcactgagcgctcttcaggacgccatctccaagctggaagctgccaccgagccgaagccgaatccggaaccgggcgtggtggacaaggctgctctgaacgcgaccatcaacaaggccgccgccatcaacctgggtctctacaccgacgactccgccaacgctctgcgcgccgcgctgaagaaggcccgtgaggtctccgacaacagcaacgccacgcagaagcaggtcgacgcagctcgtgaagccctggagaaggcaattgccgctctggtgaagcgtcccgctgccaagggtgatggcaacgttgtttccaacacgggctccgatgtcgccacgatcgctctggctggactgctgctggcaggtgctggcgccgccatcgcctaccgtcgcaatcgcgagcaactgtgaaagcgaggttatagcctaagcagtaataaataaggaataatccttatcctctcggccggcgccgggcagcaatgcctagcgccggccgctttcgtatgtatcagtgttctccagtcacccggcagacatcggaatacgcacgcgatgtcgctgctaggcgatgaatcgcaaatatgtgcggtcatcgaatgattcgtaattcgcagtgaatcctttggtggattggtactcgctgacgagttccggatcgtcgcgcttgagtcgctgcagttcagcctcactggccgcaagcatagggcgcaacagttcgccatgaattcaccctcggttcgttgggtgagcatgccccggttacatgctgacgttatatctgactgtaataccgatgaggctaggaaaaggaatgattatgcagtcagataacagccatcatgaagcacatcagaacgacctgaactacagcagtgagtaccagtacgatatgtatatgtatgccgagtacggcatcgagtggtgattgagagccccgagtgagaattggactcacgacctcttccttaccaaggaagtgctctaccactgagctatcggggcgataatgtgcgcacggcttagggccgttgaacggcttgcacaacaatacacgcaatcgcgtattacgcaaatcgacgggtgtgcgaggaagtattcgggtgctctaagttgtacacatgagcgcaatattggctattttgcgctcatgtggcattcggatgtgccacgtaatcgcattttcgtgtttttatgcgctgttgtggcacgaaaattgtgggaattcggtcgtctcggaatatgtgccatgccacgccactgcaaaaacagtgaatgtgcacgattgtgcacatatttggaccgctgcgtatatgcatgtgggtgcggataacaaaagggttttgacaaaagccaaaaccctgatggcggaggatacgagattcgaactcgtgaggctgttacaccaacacgctttccaagcgtgcgccatagaccactaggcgaatcctccatgcactgcagtgcttgctagaagtaagctccgtaggcaactcgaataagctaccacagctttcggataaatgcacattcagtgccggctgcggcgtgtcgctttgtggacaaggaccaccaatgagtgcctgcgctgatgtgcaggtcgttcgtacggcgtgtgcaacaggtgatctcaccgggggatgaaccagtgcaaatcaaagcgactcaaggcaagtcagcaaacccgaggcaaaccagaatgaacatgcgcatgccatcgcgtgaattattgccagcctcttgccgtgatgcaacatagtgattttaggccatgaaccttggtgaaacagttggtcatgcaatatgagggatggggagtggccagtcgcggggagttcataattcgggaagtctcccatctgtgagcgggacaatatcgaatattgagacaatctgcggtaataattgatcgaaaaacagtgcctaatacctcttaaatcctaaaaaatcaagactgttcctcaaaaaagtttttctttatattgagtagttggtttttgattacttagccgcgcagagagagggataggcatggttcgtcgcgcccaggctgctcttcggtccgttgaacacaccagcgtgaggcagctgcgagttctggctgcgattgtatttctgttcgccatggtcatcgccactgtggctcctgcagtcacggctccgatggccttcgccgacagcagcaccagctcgtccagttcatcaagctcgtccagcgttgactacgccacctgggccgaagtctccaaggcgatggacaagcagctgaacagcggtcttgagacgtacaaggatggcaacaccgctggcgccacctccgatttcatgggcgcgtacaacaagatttacgtggcctccaacttcaccgcggtcgtgcacgacaccattggcgcggacaagcagctcgcccaacagcaggcattccaaagcgttcagaatctttcctacacgcctagcaacgacgatcaactggctcagcagattgatgcgttgaccgccgatcttgacgccacggcccagcagctcgacgccaacgccgatctcgccaagccgaaggcgtacgccgaagcgctgcaggcgcagctggccaaagagcgcaaggagctcgacgccaagaaaaagaagaacccgggcaagggcaatcgttcatggaccgacgtggccaacgaaatgaccccgattctcgacaatgcatacaaagcttacgaaaagggtgatggtgccaagggcgccacgctcgtgaacaacgcgtactaccagtattacgagaagctcggcttcgaaaagaacgtgatgaacgccatcagcggcaaccgcgtctcgcaggtggaataccagttcaagatgtgccgcaagtccatgaacgccggcgcatccctgaaagacaccaagaagctgatcgacgacctcaaggccatgctgatcaaggacgccggcattcttgacggtggtgccgccgataaggaagacggtttcaccaagctggtcaccagctcctccggccaggcgttcctcgtgcttatccgtgagggtcttgaagctctgctggtggttgcagccatcgtcgcctacttggtcaagtccgataacaagcgcttcgtcaagtggatttacttgggtgtgctcgtcggtctgctcggcgccggcttggtggctgtgatcttcgtgttcgccttcggcggctccggcccgattcaggagatcatggaaggcacttgcgcactgatcgccatgggcatgctgctgtggacgagtaactggatgctgaacaagtccagcgtggaagcgtggaaccgttacattcgcaagaagaccgaggctgctgtggctgatgccgaagccgccgcaagtgccgacaacgtgacgttgaaaaccgtggtctcgctggctatgctgagcttcctcgccgtgttccgtgaaggcgctgaaaccgtgatcttctacgagtccatctacacgatgagtcgcgatactcgcggtatgtggatcggtggtctgaccgccgcggtggtgcttgtcggcatcttcctgctcttccgcttcacctccgtgaagattccgattggtccgttcttcctggtcacttcgattctgatgtctgtgctggtggtggtgttcgccggcggcggcgtccactcgctgatcgagggcgacttgctgcccgccttctacctgaacggtgtgccgacgaacgattggcttggcctctacccgtacgccgaatgcctagtggcgcaggccatcgcagccgttgcggttatcgcgctgttcgtggtcggcttcatcaagcagcgcaagctgaaggcgcaggctactgccgaggtcccggccgtgaaggcgtagcccgtctagctcgtccgtttcctcccataactgcagacaactgacagacttgcggcacggcctcggatcgatgccaattcctccagcccacgccgcacttatctcataactgaataattgcaattatctaagcgtgaatcctaattcaccagagatagagaaaaggaataacaatgatgaagaacaagaaactggccgctctgctcggcctgctgctcgccggttccatgaccgtgtccatggctgcctgcggttccaccaactccgcatccgacactaaggctgactcctcctcccagtcttccgactcctcttcctccgattcttcctccgattccggcgccggtttcgaagaggttccggttggcccgtccggtactgctgaagagcaggatcaggacgccggcccgctgaccgtgggcgctgtgtacttccagccgatcgatatggagccgtcttccatgggcctgaaggctgctgacgcttccttccacctcgaggccgacatccatgccaaccagaagggcaccgagctcggctacggcaagggcgacttcgtgccggatctgaccgtgaactacaccatcatcgataagtccaccggcaaggaagtcgagggcggcaccgccacctccggtaccttcatgcagatgaacgcttccgatggcccgcactacggcgccaacgtcaagctcgacaaggctggcacctaccagctgaagctctccatcgaatccccggcctccaagggttggatgctgcacgttgacccggagaccggcgtcaagggccacttctggaccgagccgatcgaggtcaccttcgacaactgggattacactcctcgccagtggtgattgactaagcagaaagccccctcgtcagagggggctttacgccgctttagggagataattcttaggacggtctaaaactcccctcagtccgcttcgcggacagctcccctcagagaggggagcctaaggtgaacagagaaaggacgcgaatgcttgaacaattcgtggcagtgatgccgggcactttggcccccgcattgctggtgatgagcctgagcgtgatgctcacggtcggcgaggggcgagataagccgataagctcgcattggcgtctcatcggcctgatcgtcggtctgatcgccgccatcgtattcgccggcctgcgcgcctcggccgtgatcaatcagcgcacgttcgtcaactacccggtgttgtggtgcgcgatcattgccgacatcctgaccatcgtcgtggtggtgttcgcacgccgcatcaccaccaattggcagcagcacaaggtgttcatgcacatcgctaacgccgtggccgccatcgacatcgcactcaccctgttctacgcgctgccggacgtgattctgcagctcaccatctgggtggaaccaggggagaccgcattcacttcggccatgctgctgcgcgctcttggtttcctgcttggcgtggccatgtccattattgtggccgccatcttccgcacgatgcgcaccactgccgtgcgctgggcgttcaccgtggccgtcgcggccatgatggtgattctgctgattcaacacttcactggtcttgcccagattctgcaggcgcgaggcttcccgatgaaccatacgatgttcgtggcgctggcttggtccatcaaccagaactccacgatgattatggcgcaggcgctggtgttcctgattcccgccgtggcctccatcgtggccggtttccgtatgaaaacccatgatgtgccgggagccaacgaggccacgttgcgccggcataaggtattccgccgccacgccatcgccgctgccgtgtggagccttatcgcagccatcggcgtcacagcaaccctgaccgtgggcgttgccgcgacccatcagaccatcaccctttcgccgccggaagcctactcgctcaaggacggcgtggccaccatccccttcagccaggtcgaggacggccacctgcaccgcttcgaatacaaggccaaggacggcaccgtcatgcgcttcatcatcatccgaaagaacggtggcgcgtacggcatcggcctggacgcctgcgagaactgcggcgacgctggctactacgagaaggacggcaagatcatctgcaagaagtgcgaggtggccatcaacctggcgaccatcggcttcaagggtggctgcaacccgataccattcccgtacaagaccggccacggcaagatcaccattcaaactacggatctggacgcgctgagcgcccacttccggtgagtcaggcaggagacaagaatcatgttctttctgcgcatgattactcgctcgttcacccgacagctgcgccggcgcctgcttatcgcgctgaccgtatgcctgtcggcgaccgtgtccgtatcgatgctgggcgtcgtgttcgacgtgggcgacaagctcaacgccgagctgtccacctacggttcgaacatcaccgtgcagcccaaggcggacgcggtcgtttccgacctgtacaacaccgagtcgggcggcgcgacgtccaccagcgacccgaccgcctttctgaaggagtcggacgcggccaagatcaagacgatcttctggtcgttcaacatcaccagcttcgcgccgcagctcaacatccacgccacggtggacggtaccaacgtgccggtcgtcggcacgtggttcaacaagaacctcaagatctccaccggcgagactaccgtcgtgggcgtggaaggcatgcgctcgtggtggcagctggacggcaagtggcccaaagacgattccgaccagggcgtgatcggcaagacgctggcctccgaactcggcgcgaccaccggcgacaccatcaccctcaacaaaaccaccgcctcaggcaagaagaacgagcagaaaatcaagctcactggcgtctacgattccggcgacgaggacaacggctcgctctacatcgcctcctccacggcccaggtgctcgccgacctgcccgattcggtcgacaaaatcgaggtcaaggccctgaccacgccggagaacgacctggcccgtaaggccgccgcgaacccggccgcgctgagccaggaggaatgggagacctggtattgcaccgcctacccgagctcgatcgcctatcagatcgaagaggtgattccgggcgcggtggccaagcaggtgcgtcaggtggccgcgttgcagggcaatgtgctgcaaaagacgcaggccgtgatgattctgatgacagtgctgagcctgatcgccgcagccgtggccgtggccaacctgatggtcgcctcgatcggcgaacggtcgggcgagctggcgttgctcaaggcgctcggtgccaccgatgccgcggtatcccgcctgatgctggccgaaacggcggcaatctcgctgctgggcgcgattgtgggcgcgctgctcggttccggcgtggcccagctgataggccgggtggtgttcggttccggcattacgatgcggccgatggtgttcgtgctggtgttcgtgctgctggctgtcaccgtgctgctggcgtccgcctcatcgattcgttcgattctgaatctcaagcccgcggaggtgctccatggtcgctgagtttatctacgtaggtgtggaaggagggaaccgatgaccaacaccggtatgttcttcagaatgctgttcagcgccgtgttccgtcggcgttcgcgcgcggtgatggctgtggtggcgtcgctggtcggcgcagccacactgttctgcctggcgatgatctgcctcgctgtgccgcagcagatgaacgaggagatgcgtgcgtacggcgcgaacctgattgtcacgcccgccgaatcgaccaatgctgacggcaaggccggcatcgacaaggcgatggtgcagcacaccactgaaatggtcaaggccaagggttccgcgaaatacgccacctaccgctacgagaacgtgcgcgtcaacgcctcgccgtacgtgatggccggcgtgaatgcggcgcaggtcaagaacctcaaccatcactgggtggtcgacggctcgtggccgaccgacggcaaggtgctggtcggacgcgacatcgccgacgccatcggcctgagaatcggctccgccatcaccatcggataccgtgcatccgataacgccagcaccaacggcacttcgtcgaactcctcgatcgaccagcaaaccaaagacggccgtgtctccagtgacatcatggacacctccggtaccgaattccgcgtggccggcattgtggacaccggcggcagcgaagactcgatcatctacgccaccaacgtcgacgtcaacaagctcaccggcatcacgcgcggcgtggacgtcatcgagtattcggccggcgccagcgacctcgcaggtctggtgtccagcatcaacgacatgacctccatgcacgtcaaggcacagcaggtcaccaagatcaccgcctccgacacccgcatcatcaccatgctgcagacgctgttctggatcgtctcgctggtggtgctggtgctgacgctcgtcggcgtcggcaccacaatcagctcgatcgtctcgcagcgacgcaacgagattggcctgcgcaaggccctcggtgccagctcgcgtgccatcggcaccgagttctacatcgaatcgtcgctctacggcctgattggcggcctcatcggcaccgcaatcggctacggactcgccggttggctgtgcatggcggtgttcgaacgctccatcggattcaactggtggctggcgctgatttccgtgctgttcagcgcgctgatcgccatcgtcgcctccatcccgcccgtccaccgcgccacccgcatcgaccccgccgtcgtgcttcgcgaagaataaagaaagagaaacgtcatgctacttgaactcgaccacatctcgaagatctacggcgacctgcatgccgtggacgacctcaatctgaccgtgccggaaggcgaatggctcgccatcgtcggctcatccggttcaggcaagaccacgctgatgaacatgattggctgcatggacacgccctccaagggctccgtgaagctggaaggccgcaagctggaggacctgaacgccacgcagctggccgacgtgcgcaagaacctcatcggactggtgttccagaagttctatctggttccgcacctgaccgccgtggaaaacgtgatggtggcccagtactaccattcggtggtcgatgagaagcaggccatggaggcgctggaaaaggtcggcctgaaggaccgcgcccaccacctgcccggccagctctccggcggcgagcagcagcgcgtgtgcgtggcccgcgcgctgatcaacgacccgaagctgattctggccgatgagcccaccggcaacctcgacgagaagaacgagaagatcgtgctcgacctgttccgcaagctgcacgagcagggcaccacgattatcgtggtcacccacgatgcgctggtcgccagctgcgcgcagcgcgagatcatgctcaaccatggcgtgctcgtcggtgagaagtggaatgacgaggatgcgcgcaaggcctacgaggcggccggcggcaagcccgcctccacgggtgcacaggtcgagggcgcgcagaacggcgagaccgccattggtttcgctgaccccaccaaggccgcgaaaaccggcggcgaggagtagggccgtcaggggtatcgagcagtatgtgaggaatacatggcaagctgatggtctctcccccagtcagcttcgctgacagccccccctcgtcagaggggggcttaaggagcgtgaatatgaccgaaaagaatatgttgaagaaatccgcgacattggcggcggccggactggtcgtggctggcgcgctgctggccgggtgcggcgaatccgaggccacgccgatggacgatgcgtacgccggcaactcgggcgagaccgagaagtcgcaggaagagcagtcgcaatcccagtcgaacggctccgatagctccgacggctccgattccagctcgtcgcacaacgacccgtccaccaccacgtccgacaagaaggacaccggcaactacaaggacggcaactactcgatcaacggccagtacggcccggtaggcgaggattccatcgacgtccatctgaccatcaaggacggcaacgtcgagaccgtcaatatcattgggcacccgttcaccacgatttccaagaaccatcaggacgacttcgccaaagccattaacggcgtggtggacggcaaacctctgaagggcctcaaagtggacaaggtcgccggcgccagttggacctccgacgccttcaacaaagccctcgaagtcgcccgccaggaggcttcgattcaggagtaagaccgctacttcagcaatgctggccacagcagatcggccatgcgcgaggcccaggcggtgtcgtcgtccattgctttgccctcgatggcctcatacgccaccaaagacccgataatcgtggacaacagcaacttctcgtcaacgtcctcgcgaaacacgtcctgcgcgactccctgcttgaggaacgcccccacatgctccagccacggggtcaccacctggtcgacgatgtgctggaagaactcggcctcgctggacaatacaatgcccacgcgcttgacgtcgatgtcgttgtcgcgcacccaatcgaccaatcgctgcaatagttgcgtgaaatgctcacgcgtggggctgggcactgggtcggaatccgggatggccagatacatcgcgctgatctcgcgcagcagctcgtcggcattatggtatcgacggtaaatcgtggttttggccacaccggagcgccgggccacctcctcgatggtcacgccgctgatgccgcggtccaccgcaatctgcagcgtggctcgcatgagcttgcgatccgtcgcctcgcgcgtgcgctcaccgcgcggtgtcgccgtcgtacctgtcatctccgtcatctcttctctccgaaatatgctcccgtacgctcccgttggcgggagctggctggcaaagccagactgagggtggtaagtccatgccgtttgtaggcaacccccggataatacctactagcccagcactttagtgctctcgactttggccacataccactggttgaaccgcaccagtggcttcctgagcaacagtccaagcaacagtagcggcggcacgaatgccagcagcattccggcggcccgccagtaatccatgtcgtagatgccggcgatggccgcacgcatcatcgtcaccgcatgggtgagcggcaagaacggactgactttggcgatgaagtcgggcaacatctgcaccgggtaggcagcgttcgcacccgaaatctgcacgatgagcataagcacgccgattgccttacccacattgccgaaactcaccaccatcgtataggtgaagaacgagaacaccagcgaggccagccatccagacaacataaacagcagcggatgcacggcctgcacgcgcaggaacagcagatcgccaccgagcgacaccgtggattgcagcagcgcaatcagcgcgaacaccccgtaatgcccaaggaagagccgatgcggccgcggatcgcccaatgctttgcgcgtccggcgagacacggtggttttcagcgtcaccaccatcagcagcgcgcccacccacagcggcagcagcgtgtagaacggtgccatcgacgaaccgaaattcgccaccgggaatacggccttgcgcctgagctgcaccggtgcggccaacgtactggccagcgtttcgggatcattgcccagcacctctttgaccatgcccatatcgccactgtttagtgcgtcgctcagtgtgctgttgaacgaagccagttcggcaccggcggaacgcagtttgccggacaccttgtccaaggtagtgcgagcgtcactgagcatatcgctggcgtcgtcggaagtccctttcaggtcgccgagcgtggagtccaactgggtggcgccggaactcagtatgccggaggcgtcagcgacggtggacgacagggagtcgatttgcggtttcaccgtggccgagaaatctgacttgatattggcaatactgttctgtgcttgatcagccagattcttgacctgcgcatgctgatcctgcgcgtcctgattgccttggcgaatatcggtcgccgccgtattcagcgcttgccgcagcctgttttgccgtgcgattgaacggtcaatcgccgtgatgatggatgagtcgttgcccagtatgccggccaacgtgttgcgaatttcagtgtatttctccgtctgcttgccaatggccgtggcttgacggtccaattcgtcggcggccgtggtggcaccagcattcgcgtcggaatacagcttgtctatggagtcggacaccgcgccgaaactggaggcgctcgcgtccagtgcgctgctcatcgcgtcagcggtggtgcccagggctccggccacgtcggtgacttcctgtttggcgctggcaagatccttgccgccttgtttggcggcagaggaaacctgagtgatcagtgagttcgaggtgtcgagcaaggcgccggccgtatcggtcaatgcgctgtatgtgccaagcagatccgccgtatcgtcaagctgtgtggcgaaattggcgatgttggcgttgaaggtattcagttgctctttggtctcgggcttggacagctgatcggccagcgaagacgcgatttccagcccggccgaagtgatggtcttagcgaacgtggtgttgatttccgccgcaacctcatccgtgccctcgttgagcagattcggtgccagcgcgttcttcttctcgttgcggtaataggtcagttcggcatgctgcacgtcgtcggagaagaaggtcatcatgtctttgctgaacgacttcggaattacgatggccgcgtagtatttgccggatcgtgcgccctcgacggcatcggctttggacgtgatcgtccaatcgagctgactgttggcgcgcagcgcgttcaccacctgatcgccgaccgtgactttcaccgggatcaggttggaacgatacccctcatccacattcgccaccgcgaatttcaggttcttcatattcgagaacgggtcccagcatgcggccacgttgaaccaggtgaacaggccgggaatcatcaccaagccgatcacgatgatgatggagaccacgttgctggtcaggcgtttgatgtcgccggtaaacagtttccacatggtgttcatcgtgcgtgcctgccttccttggtcggcggaatagtggggatgattgcggtaacggcggcgctcgggtccgcttcttcgtggcgttcggcggaggtgtcgcgacgcttggccttatgcccgtacagcatggcgcggatcgactcgtcggagaggctgccgagctcggtttggcggcggatggaatcgcgcatgaattccacgaccatcaggaagcccatgatgatgagcacccatgccagccatgtgcccatgacttcgattttctcgctggtggtcagcgcaaacacgataatgagcgcggccggcaccacgaatccggcaataagcgcacccagcagcagccggggataacggtaggcgaatttggcggcccgacgttcgatggcatgacggtattcgtcgtggtcggccagtgctgcaatggcctgagtgacacggtattcgctgccgggcatgtgcaccggctcgccgataatcatgtcgctttccttgatttcccgcgcgaacaggcggttgagattggccagtttcggccgggcgccgaggccaagcgcaaaggccagaaccacgaaaaccagcaatttgccgatataggcgaaccagaggccgtcgtagaagccgccgatggtttcacgcatcgcgtcaatcgaataggtgaacggcagcagcgggtagatggcgcggaagaacgcgggcatcatttcaatcgggtacaggccggaggcgcccggcacctgcagaatgaccagcgccacgcatacgcctttgcccacgtgcatgaacgtggtggagagggcgaaaatcaccgacatatacaccagtgaggtgatgacgcaggtgagcagaaacactggggcgctcgcgcattgaatgccgatgacaagatcgccgatggccgtgaccaggccttggacggcagccagcgtggccagtagcaggaagcgaccgagatagccttgggttggtgtgagatcgtcgatgccctcatcatcggtttcgagtttgggaatgaccacgagcacgaacgcgcccacccacaaagacagggtggtgaacagcggtgccatgccggaaccataggaggcgaccggatagacggcctgttcgctgataacagtgggggagagcatgaagtcggcgattgtggcggcatccagtttgccgtcggtgccgatcagggaactgagtgaactggagatgctcagggctttgatgtcggtgaccagcgtatcgagcttggtttgtacgccggccagcgccttatcggtgtcgcgcagcgcggtcaccgtggtggaggctgctttgtcgagttggtcgagggtatgcttcgactgatcgatgagtgagccttgcgacgtgatgccggtcgacagagtgctggcggtcgagctgagggcgttgagaccggtgttgagctgaggaatggcgccggaggtgatggtgccgcgagcggtattggcctcgcgcaccgtggtttgggtggcggtattgagatgctgcgccaatccggcggtgtctgtggaggcattgccgatagtggtgttcaggctatcgaggttgcccagtgcgccggcaagctcgctattgcggctttccagtgtggcaatggcggattgcagcggttctcgattggcgttcggcagccctttgagttggtcgatgatgtcggcgttcgcttggttgatgtcttccgccgtattgatcagtccgcctacctgctgattggcggcgctgatggttccggttaccgtgcccacgctttggttggcctgtgctgcggcttggctcagcaggcttgagccttggtcaagcgcttcggacgtggaggtgacgaagccgttcagactggtctgggtagtgccgatcagggtggagacgccggccagaccttctgcagtgtcgatgccaagtgtgcgcgcgtcgtccagcgcctgacgtgcggtgcgtgtctgctctggggtgtcggtgagtttggtggtgagcttggcgatggtgctgcgtgtgtgctgcacatcgtcggaggccttggcaagggccgtgagggccttggctttggtggtgtcttcggtactgatggctttgccgtcaaccgtattgatgacttcggtaagtacttcggatacggtggagacgaatgtggaattgaccgtgcggtccacagtggacgcgccgacgtcggtgactttgggggcgatggcgctggctttttcgttgacgtaatactccagagtgggccgactcttgccgccggtcaccacgccggcgagatcgtcggaaaagtctttgggaatgatgatggctgcgtatgccttgccggattccacttggtccatggcctcggcttcggtgacgaaggtccagccgagctggtcgttgcttctcatctgcttgacgatttgatcgccgaggttttgcttgccgatgagcgcgttgtcggtgccgtcgtcattgttggcgatggcgacggtgatgcctttggtattgccgtacgggtcccagaagccgacgatgttgtaccacgaatacagtggcgggatgaacaccatgccgaacaggatcacccatgcggccgacaccttgaacaggcgcaggaagtcgcgtctgaggaccttgaagatattgcccactgatacctccggagcttggtgttgcttggttgctacgttttccgtagcgatacgttaatcgtagcgctacgtttgtagtagcgtaatacggctgccggagattaatggggtgattgatgatgtttttggcggaataacgccgctgcccagcggcttatcgtgtgtcgctgggcagagcaaaaggcgttctggaacttattgacaagatttctggatggtttttggacgtttcctgaacgcgatggataggctcggtgctcggcaatgtagacagacatgtaccgaccgcccatcaagttcagcaaaaccgcaatcgggtgatagggtgaggggacgctatgtggggaggaaaccatggttgaattcaaggacgatggcacggccactacccccggcaagccgcgggagaaccgtgacgccgagtccgcagtcgtggccgatctggtggccgtcgaactggacgacgtcggcttgaacctgaacaccaagcgattaccgattctggcgcgcatctatggcgcggtcgtgctgctggacggactcgccacattgccgattatggtgatttccatcctctatgccgtgcgcgagattctggatggtcatgtgcacgtcgatgcgatgagcctgaccttcatcctgtccgcgattcatgcggtggtgctggtagtcagtgccgcatgcctgattgtgttcggcgtgatgctgctgcgcaatcatcgccggtatgccgcgcgctggacctacgtgctgatgccgttgacattggccgacggcatgctgtcgctggccctgaccggccttggcttcaacctgctgctgccgctgattcagatgattattctcgtcgtgatttcggtgaccgccgatccctccctgagcgaggaacgccgtctgcagcgcgcgctcaggcgtatggacgatcgcgatgattatgaatcggctgtggcggccggcatgctaggccgcgaccagtccggcaagggctatattgcgctggactttttcaatatcttctggctgtttaccatcgcttcggtgggtggcctgattgtggagacgatctaccatatggcgctgtataacggtgaacttcaggaccgcgctggtttgctgtggggcccgttctcgccgatttacggctgtggtgcggtattggtaaccgtgtgcctgaatcgcctgtggaaggcgaatccgttcttgattttctgcgcttcggcggtgatcggcggcgcgttcgaatattgcaccagctggttcatggaagcggcgtttggtattaccgcgtgggattacaccggccgttggctgtccatcgacggacgtacttcgggccaattcatgttcttctggggactgattggtgtggtgtgggtcaagtggctgttaccgcgactgctggctctgattaatcgcattccatggaaagtgcggtattcgctgactgcggtatgcacggtgctgatggtgattgacattgccttcacgctgatggccttggattgctggtatgggcgcatggccggccagccgcaggattcaccggtcgcgatgtggttcagcgaacgctacagcgacgcttacatggccaatcgcttccagaccatgcatatcgacccttccaaggccgggcgtatgtgaatggctggcaagtaattacgcttcgcgggcagaaggtgcgtagaacctaagacagccctcgcgtgtgggtggtaagcgggatacactttcaagcgttgaaggaatgatccctccgctgatgcgctggtttgtgacgcgcgtgatgacgatgggacaatcaaacgaaaggcaaggcacatggccgaagctacagcaaacattggtgtgattggactggccacgatgggctccaatctggcgcgtaatctggcgcaccatggcaacacggtggcgttgttcaaccgtcattactcgcgtaccgagaagctcatgaacgagcatggcaccgaaggcaacttcgtgccggccgaaacgctcgaggaattcgccgcgtccctgaagcgtccgcgtaccgccatcatcatggtcaaggccggtgctccgaccgacgcgaccatcgcgcagctggaagaggtgttcgaaccgggcgacatcatcgtcgacggtggcaactccttcttcaaggacaccatcaagcgtgagaaggaagtacgtgctaagggcttccacttcgtgggttgcggtgtgtccggtggtgaggaaggcgcgctcaacggcccgtctctgatgcccggcggcactgcggaatcctggaagaccttgggcccgattcttcagtccatcgccgccaaggtgaacggcgaaccgtgcgtgacccacatcggcaccgatggtgcaggccactttgtcaagatggtgcacaacggcatcgagtatgccgatatgcaggtgattggtgaggcgtatgacattctgcgccgtggactcggcatggatgccgaggagatcggcgacgtgttcgctgaatggaacaagggcgatcttgattcctacctgatcgagatcaccgctgagattctgcaccacaaggatgccgagaccggcaagccgttcgtggacgtggtcgtggatcatgccggcatgaagggtactggtacgtggaccgtgcagactggtctggaatgtggttctcctgtggctgccatcggtgaagccgtgttcgctcgtgcactgtcttcgcacggtgagctgcgtgaagacgctcagaaggaaggtctggctggaccgaacaagaccatcgatctggccggagaagacaaggccgcgttcgtcgaggacgtgcgcaaggctctgttcgcttccaaggtcgtggcctatgctcagggcctgaacgagattcaggacggtgccaaggaatacggctgggatatcaacctgtccgaagtggcccgcatttggcgtggcggctgcattattcgcgcccagttcctgctcgaccgcatcaccgaggccttcaggggcgataacccgccggcttccctgctgttcgatccgtacttcgagaagatcatcggcgaatcgcaggatgcatggcgtcgcgtgatcgttcgcgcggtggaggccggcatcccgaccccggtgttctccagctccctggcgtactacgatggtctgcgctccaagcgcctgcctaccgctctgacccagtcccagcgtgacttcttcggtgcccacacctacggtcgcgtagacaagcccggcgtgttccacacgctgtgggctgaagaaggcaagcctgaaatcgaggcgtagcctcgtgatttcaggtttaggacagccctgtgggctgtccggccttcttcaggctcggcgatagccgagctgagaaaacagcaagtccgagatcgaggcgtagcctcgcgatctcgggcttaggggagcccggtgggctccccggccctcttcggagcgaggcggctatgccgccgagccaacactgagcctcgccgcaggcgagtccctaattgcaggggccggcggcgaagagggcaagtccgagatcgaggcgtagccatagacgaattaagccccctcatcagaggggggcttaattcactcacaactcggtgacggtttcttcggtggagaaccagatgaactcgtccactccgttggcgtaggaggacgggtaatccgggttgttgggctgctcgaagacatgggccagcgattcggctttgccggcaccggcggcgaagaaccacgtatggcgtgaacgcgcgatgagcggcgcggtcaatgaaacacgcagcggcggcatcttgggggagtggttcacacccacggtgagcctatcagtaaccttgacctcatcatgaccagggaacagcgacgcatagtgaccgtccggtcccatgccgagaatcatcagatcgattaccggttccggccccaattcattcaccaactcgcgctcatagtcgctcgcgacatcgtccagcaacgcatcattcgcggcatcggcggcggcgcgaacggaagcatcatcgctgtcggcctgatccatcacatcggcgatgtcatcggctgaacgggtatcggccgccatctcatgaatattcgactcaggcagcttgccatctgccaccagctggtcaagcagcaggcgacgggcctccaaagcattgcgatcggtgtcgtaagccggcacaaaacgttcgtcgctccaccagaaatgcacgcgcgaccaatcaatcgcgtcagccagcggatcgttcagcaccaagcccagcggctgcgcggccgaaccgccagacagcgccacatccacacgcgtgcgatgcgtgccatcaggcaatcgttcggcgagcaaatcgagtagcgccaagacaaaacgttgcgcgccagcctgaatcatcagatctttattcggatacacaatgagttttcgagttgccatgtatggtccttgtatggggtatgtgtcgtactttgcaatgtggattgtgttgtcagttgacaacacaatccacattgtgcgacatcgcatatgtcactttattactccgcgggcatgagcttcggcatcgcatgaggtaggaaacgatgagcaacggcgttggcatggctcggccacaattgccgaactcattccaacgccgctgtggcaacgggttctaccgacttcagtgacgaatcagatcccagccttcgttgatgacctcggcgtagatctcatcgggatcgatgcgacgcagttcctcggtcaggcagtcctcgatggtgcgcatcggcacggacacttcctgcggagtctggccgggcagcgagatcagcgcttggtcctcatacgggcgttccagcgagatcacaccgtcctcacgggtcaggtacacgccggtcacggcctgcgcgtcgggcacgaactcagtttcgactggtacgccaagtttcagacgcagccatgcgcacagcatttccataggcaggaagtcggccttgccggtcaccttcgcggcggtgatgggcaggtgcggcggctgatcgagcatcgaggcgagcattgcgcgccagacggtcagtcgtgtccaggacaagtcgatatcttccggtgtccaattgcggcgcaaacgctcaatcgtggcctccggattattggagtgcaacgcgtcggtgatgcgactgcgggccatcgcacccatcagatccttggccgggttcgacggcggtgtggtcggccaccacgccactacaggcgcatccggcacaagcagcgggataaccagcgtatccgggtggttgataaggccaccgcgcggacgcaagatgatgatctcaccggcaccggcgtccgcgccgaatcgcacttgggcgttcaggttggaatcgttcggatcgttcgggccgtcggtcaaatcgacggccggattatcgcgactcgcgctcacctcggcggccacttcggccgcgttcggttcgccttcgccggactgatcggcaggattggtatccggtactacggcaatcacgcggcacgggtgctcacggctggccgagttcgcgatttccagcgcatgctctaggtccgcgtcctcggtggcgatgagcagcgtcagcacgcggccggtcgccgattcgccgcgctcctcgtgcagctgttcgattttgtgcgcaatctcgcgggtgcgggtgttcggcatatcgatgatcatggcatcctccagtggcggccgtcgcgcgccagcatttcgtcggcctgtgccggaccccacgtaccggcgcggtaggcctgcggctggccaagcgtggaccagaattgttcaatcggatcgaggatctcccagctgaggttcacctcttcggtggtcgggaacaacggcggatcaccgagcagcacgtccagaatcagtcgctcataggcttccggcgagttctcggtgaaggagcggccgtagctgaagtccatgttcacgtcacggacctccatggtggagccgcccggcaccttggctccgaagcgcatggtgacgccctcgtcgggctgcacgcgaatcacgatggcgttcttgccgagttcgcgcacggcggtctgctcgaacggcagatgcggggcgcgcttgaacaccacggcgatttcggttacacgcttgccgaggcgcttgccgcaacgcaggtagaacggcacgccagcccagcggcgggtgtcgatatcgaggcggatggcggcgtacgtttcagtggtgctcttggggtcgatgcctttttcctccaagtagccgaccacttcgtgcgagccctgccagcccttggcgtactggccgcgcgcggtgttggcggcgaggtccttgggcaggcgcacggcggaaagcaccttggtcttttcggcggtcaggtccttggcggtgaagctcaccggctcctccatggcggtcagagccatgagctgaagcaggtggttctggatgacgtcgcgtgcggcgccgatgccgtcgtaatagccggcgcggccgccgatgccgatgtcctcggccatcgtgatctgcacgtggtccacatagttggcgttccagatcggctcgtacatggcgttggcgaaacgcagggccagcaggttctgcacggtttccttgccgaggtagtggtcgatgcggaacacggagctcgggtcgaacacttcggataccacgctgtcgagttccttggcgctggccagatcatggccgaacggcttctcgatgatcacgcggcgccatgcgccctcggacgagcgcgacaggccggaggcggccagctgcttggcgacctgtgggaatgcgcgcggcggcaccgacatgtagaaggcatggttaccctgcgtgccgcggtcgcggtcaagctcctgcacggtggcgcttagacgctcgaaggcctccgggtcgtcgaacgtaccctgcacgaagcggatgccggcggccagattgcgccaagtcgactccttgaacggcgtacggcaatgcgcctggacggcggccttgacgaattcgatgaaccgttcctgtgtccagtcgcggcgggcgaaaccggtcagaccgaagctcggcggcagtaggccacggttcgccaggtcgtagacggccggcagtagtttcttttgtgccagatcgcccgtgacaccgaaaatgacgaggctgcatgggccggcgatacggggcagtctgaggtcgcgcgagtcgcgcaggggattgctccaattgggggattcactcataatgtacaagggtagtcgccggcggctatctatcgctagaggcgatatgcgatttgggctgcgatttgggccacattgcgtgtgctgtgccgtgcgttgggccaatcgcgtacgcaaacgtgtacgcaacgccgtagttgaaatatcccaaaacggtgtgtattttagaagagttgcccctttagctcaacggttagagcagcgtccttttaagtcgtgggttgtgggttcgaatcccacagggggcacaacaaatcctcggaatcgcaatggttccaaggatttttttgtttcgaccagcctggctcctagagtggtgtcccatgtcatgcaccacgattcttgtcggcaaaaatgccagttacgacggttccaccatcatcgcccgcgatgacgattcgggctcgggccgttacgatcccaagcgcttcgtcgctgtcgcccccgacgaccagccgcgccactaccgcagcgtgctgagccatgtcgaaatcgaactaccggacaatccttgccggtacaccatcgcaccgaacgtgctgaataatcgtggcattctggccgaagccggtgccaacgaacacaacgtggcgatgagcgccaccgaaaccatcgctgtcaacgagcgcgtgctcggtgcggacccgatggtcgagttgcggccggctgtcggcgaaccggacagcaccgattatcaggccgagcagcccggcggtatcggtgaggaagacatcatcacccttgtgctgccgtatgtcaccaccgcgcgcgagggcgtcgcgcggttgggcgaactgctcgaaacctacggcacctacgaatcgaacggcgtgattatttcggatgtggacgagatctggtacgtcgagaccatcggcggccaccattggatcgcccgccgagtgcccgacgactgctatgccacgatccccaaccagctcggcatcgacgacttcgacctcgccgatgcgttcggcgagcagcgcgaatacctatgcagcgccgacctgcgcgagttcatggccacgcatcacctcgaccgcacaatgggaacgccggtctcttccaacggccgtcacgcgcatagcgccggattcggaacaaccgttgcccttcccacccgtttcaacccgcgcaaggccttcggcaccgcgacgccgaaggaccatatctacaacacgccgcgtgcctggtacatgcaacgccgcctcaaccccagcgaggactgggattcgccggccgcccgctacacgcccgaatccgacgacatcccgtggtgccgcgtgccggaagacaaggtgagcctcgaagacgttgatttcctgctgtcctcgcacttcgaaggcacgccgtacgacccgtacggcacgaccggcacggcggaatcgcgccaccgttaccgtccgatcggcgtgaaccgcaccggccatatggtggcgattcaggtccgcccgtatgtgccggcggccaatcgcacggtgatgtgggtatcgttcggctccggtccgttcaccgccgccgcgccgttctacgcgaacgtcaacgacacgcctgcctacctgcgcgacaccacgcccgaagtctccaccggcaacctgtattggacgaaccgcctgatcgccgtcgtggccgacgcgcattggtatgagacgaaccggttcatcgagggctatgcagaaggcgtgcgcgcgttcgggcaccggctcatcgagcgcacggatgagcagttgcttgctcgaagcgatgccgaatcgacggatacgaatgcatggccgctcgatggcggccacggcgatgagaaggatgtgcaaggcgtggcggatgcgctcgaagcggccaacgacgagatggccgactacctgcgcgagcacacaaccaagctgctgaacgacgtgctatacacctccagcaacctgatgcacaacagcttcgcgatgtccgaccgttgggccgagtagtaaaacctcgactggggaggtaatagggatgccctgctgataacgcgtcagcagggcaaaaccacaatccgaatcagttaaagccgacgatgcgttcggcgatgagatagccgttgcgcacgatccagcggccggttttgccgggcagattgagcgcgcgggacatcagctgcgagcgcacatccttgccgatggccggagaataggcgtcaatcgcatcccacagctcggttttcttaacgtagttggccggatcgcgcgagagaatcaggaacaccgaggtaacgcacgattcgatcgccaggaagtgaatcatgtaccggtacagcccctccggcaccgtaccgcgttcgggcgtggcctcggtcatcagccgattgacgagccgcaactggtccacacgcttaatcatcacgtcggtctgcacgctctgaccctcgcgcccgatgaagtagtggtagaacggcacatcgaggtactggatgcgcttcacccacgggaacggctggtacgagtaatagaaatcgacgtagaacgtatgctccggcagcttcagcccggaatcgcgcaccacctgcgtgcggaaggtgagcgcatgcatgatgatgtactgcgccagaccgaacttgcccaggtcatcccagccgagtacacggccggcctccatcacacggcggaagttcactacggtcttgtgacgcttggccaccttgtcatacacgtaattggtcaccagcatgtcaatcggttcgtcggtgtcatgctgtgcacgcaacgtggccagaaccgtgtcgatggcctgcgggtcgacccaatcatccgcatccaccactttgacgtacatgccggtcgccgccgcgataccggtgttcaccgcgccgccgtggcccttgttctcctgatgaatcgcgcgtacggcgcccggattggtgcgttccagcttgcgcgcgtactccagcgtgccgtctttcgaaccgtcgtccacaatcagcacctcgaggtcgctgatgtcgcttgccgaaagcaacgagttcacgcaacggtcgaggtaggactccatattgtatgcggggatcacaaaggtgagcgtctttgccgtgctggccatgaaagtcttacgtcctcacatatttagtcgttatgttcagtttcctgttcaaaccgtagcacttcgtctcccgactcggcagagtgttgcgtaacctgtgcccctgaactcatgttctgcaaccctgaatcttccccggtggcgtgctcgggatccgattgggcagaactcgtctggtctgaatccgggctgccggaatcggactcgcgcttggctcggcgctcggcctccttccgcgccttggcgccctcaaagaacaactggggcttggagtcaagccggctcaggccatgccaggccaaatccacaatgtatgcggccagctgctccttgctcacctttggccggtcggcccagtactgcccggtgaatacggtcatgcccaccagcatctgcgcgtagtacggcacgcccttggcagacagcttctgccgtttgaatgtttcggaaagaatgtcttcaacgcgtacggcgatgtctcccatcagcgagctgaatgagccggacgggtcggtgctcggcgagtcgcgtaccagtacctggaacccctcggcattctcttcgatataggtgaggagcgcaagcgccgtgcgttccacaatctggcgcgggtgcacggtcggatcgtcaagcgcggcggtgagcacactggtcagcgcgcgcatctcacgatccacaatgacggcatacaggccctctttgccgccgaaatgctcatacacaatcggcttggagactttggcgtgcgcggcgatttcctccacgcttaccgcttcgaagcctttggcggcgaatagcgagcgtccgacttcaatcagctgctcgcggcgctgcagcgacgtcatacgtgaagaatgtgccatgcggttcagcttaagtcgtcgggtggaattgtcggcctgagactgccgaattcgtaggggattccatctgcgggctagacttgacaggtatggatatgaatactgtgctcgccgttcttggcgtgattgtggcggcggttatcgtaatcgccctgagcatctggttgggcaagtcccgcaagcgcgatttggatcgtgcgatgggcaaggttgcccccgacaacaagaagacccgcgacgccaaggccgccgccgacgctcggctggccgccgaagccgaggaagctaaggctgcgactgccgccgagccggccaagtcagccgaatcggccaaagccgagcctgcgccagccgcgcaggccgaacccgaaccggcagctgcgcccaagcccgagtcccaacctgcctccaagcccactcccgccaaacctgaaacccccgaatcggtcggctctcgactgacccgactcaaggcaaaacttgccaagtccggcaacccgttcggcaaggccctgttcgacatcctcgccaaagacaatctctccgaggccgattgggaagacgtcgaagacacactgctgcttgccgacgtcggtgcggatgcttccgcccaactggtcgatgacctgagaaccgacgcccgcatcactggtaaagccgacccagccgaagtacgcgccacgctcaaggagaagctgctcgatctggtcggtcgagatacggaccgccgcctcaatgccgaaaagccgggtgccgccaagcccagcgtcatcatcatggtcggcgtcaacggcaccggcaagaccaccactgccggcaaactggctcgactgttcgtggccgaaaacaagcaggtcatgatgggcgcggccgacaccttccgcgcggccgccgccgaccagctcgaaacctggggcgcacgcgtcaatgtgcccgtcgtccgctccgacaaggacggtgccgacccggcatccgtcgcctttgaggcatccgccaaggccaaggaagcgaacgcggacgtgctcatcatcgatactgccggccgactgcagaacaagtcgaacctgatggacgagctcggcaagattcgccgtgttaccgaaaagaacctgccggtggatgaagtgctgcttgtgctcgacgccaccaccggccaaaacggcatggcccaggccaaggtgttcgccgaagccatcggcattaccggtgtggtgctctccaagcttgacggttccgccaagggcggcatcgtgatcagcgtgcagaaggagctcggcgtgccggtcaagctcgtcggtcttggcgaaggtccggacgatttggcacctttcgatcccgaaggtttcgtggacggcattctcgcgtagacggtcgagctctcctcagtctcgctttgctcgacagttcccctcagcgaggggagccctgcgtccgtccacgttgtgggcgcgggaaacgcccgcaacgcaccaaacctagccccgaatcatattcgaaacatgattcggggctttcccatatccgttggaatcatgccggaaccagcccatccgataccaacctaactgtcaggtgcgcttaacaatcgcgtaacttgccgtaacgaaaccaaaacgagaccggcttttactgacgaactgttagcccccacaagggggacggcattgtagagacaaagtcgacgccggccgcgcaaagcccccggtgccctgaacgaaagagagggaggtagacatgggagcgattgattccggtaacaccgcatggatcctgacatccgcgtccttggttttcctcatgacgcctggtgtggcgttcttctacggcggtatggttcgtgccaaggccgtcctgaacatgctgatgcttgaggcggccgccctgtcggtcaccatgattatctggaccctgtggggttggtcgattgcttacgccggttccgacatcggaggcatcttcggcgacccggccagcggcttcctgctgaaggactccatggtcgcccaggacggcgtgttcaccgccaccggtctgaacggcaacaactacccggtttccgtggacgttgccttccaggtcgctttcgcgatgattaccgtcggcctgatctgcggcgccattgccgagcgtgtgaagtacagcacctggatgattttcgtggcgctgtgggtcaccttcgactacgctcctatggcccacatggtctggaacggtggtctgctgtctgctgacggcgccatctccaaggccatcggcgctgccgcccacgatttcgcaggtggtactgtcgtccacatcaacgccgcagtcgccgccctgatcatcgtgctcatcatcggcaagcgtaagggcttcggcacgcagccgttccgcccgcacaacgtgccgttcgtgatgctcggcgccttcctgctgtggttcggctggttcggcttcaacgctggttccgccttcgccgccaacggtactgctggttacgcttgggtttccacctccgccgccaccgcagccgcaatgctctcttggggcttcaccgagaagattcgctccggtcactacaccgccatgggtgccgcctcgggtatggtcgccggcctggttgccatcaccccggccgccgatgtggtctccccgctgtgggccatcgtgatgggtgccatcgctggtgtcctgacctgcctggcctgcggtctcaagttcaagttcggctacgatgactccctcgacgtcgtcggcgtgcatggcgttggtggtttcaccggcaccatcctcatcggcttcttcggtgaaggcaccggtctgctggctggtggcgactggaagcagctcgtcgttcagctggtcatcgctctcgtcgccatcctctactccgcagtgatcaccgcgatcatcgccttcgctctggagaagaccatcggttggcgcgtcaccgaagctcaggaagtcggcggcatcgatcttgccgaccagggcgaacgtgcttacgattttgctggtactgccagctccgttctcaaggaggtgaagtgaaatgaagctgatcaccgctatcattcagccccataagctcgacgatgtcaaggaggccctcgcggccgccggcgtgcacggtctgaccgtgtccgaggccaacggctacggccgccagcgcggccacaccgaggtctaccgtggcgctgaatacactgtggacctgattccgaagattcgcgttgaagtgctgtccgatgacgcggatgccgaaacgctggttggtgtgatcatcaagtccgccggcaccggcaccatcggtgacggcaaggtgtgggtcgctccgctggactccgtggcccgcgtgcgtaccggtgagaccggttccgccgcgatctgataacacagacgtccatgcttagaaggggatggactgcataggaaaggtccccgcacgccgcgaattgacgccgtgcggggactttttttagcaatgaaagatgaagcaatgacttcagcagtagatggcttgaaacaacgattcatggatatgagccagccggatgacgacggcgtttaccggaatggtgcgaccaagcgcaaagcccgcacagaactggccatgcaatgcctcactgagctgtggaatgcggcctgcaaggatgtctctttccccgtgcccgactccggcatcggcttcgccgcggtaggctcgctggcacgtggccaactgggccccagctccgacctcgacctggtcatcatctacgagcctcgcacgttgaacgaccagcagctcaacgagttggccaacaaactctggtacccgctatgggacagcggtctggacctcgaccactccatccgcacgcgcgcccaatgcgaggaagtcaccgaccatgaccttcccgccgccatgggctggctggacgtgaagcccatcgccggcgacaccgctctgatcaccaccaccgccacgtccatcctcgaacgctggcgcaaggccgcccgcaagcgcctgcccgaactgctcgactccgccaaagcccgactcgacgaattcggccggctccaatacgtcaatcagcccgatatcaaggaggcccgtgggggtttgcgcgattcggtgctcgtctccgcgctcgccgcctcatggctggccgaccgcccgcacggcatttacgacgaagctgtggaacgtctgctcgacgtacgcgactgcatccatctggtggccggcaaggataccaacctgatgctgacgccctatcaggccaaagtggctgccatgcttggccttgccgatccgacttggcccgaaaacgagcgtgccgcctactcgatcgacgatttgcagacactgcttgcccgtatcggtcggcgcatctccttctcgcttgattccaccgcttcccgcgccgaacattcgctgacccacgaaaagccgcgattcgcgttcttccagatgttctctcagcgctctggtggcaagcgcgaagccccgcaattcgacgtggtggctcccggcgtggccaagcacgaaggcgaattggtgttggcgcccggtgccgagcctgccaaggatgccaagctggcgttgcgtatggccgtggcggccggcgaattcggtcttcccatcaacccgtctaccttggttaatctgaagcgctgcccgattcacgacaaccagtgggatgacgaatcgcgcgagctgtttatccgtctgcttgcgtgcggatcgaatcttatggaagtgtgggagagcatcgatttcgtggacattccgggtcgatggatgccggaatggctcggcgtccgcaaccgtccgtccgcctcggccgcccaccggtacaccatcgatcggcatatggtggaggtcacgtcgcgtctgggtcgtgagacaccgtccggtggacggtacgatgacgatcatttcaaggcattgctgttggccggtatcacccacgacatcggcaagcgcgcgttcgtggccgatcacgccgccgagggtgcccgccatgtgccggtgattctcaagcgtatgggctacgcgccggacatcgtcgactgggctaccgtgctggtgcgtgagcatttgacgctatccgaatttgccacgggtaaggacccctatgatccggccgtggcggaggagttggccgaccgcttgcaccacgacaagatgctgctggatatgctgttcgacctgacccgggccgacggctcctcgctcggtgccaccgccggtgagaccatcaccaagcaatacggctggtccaagtggcgcgaacaaatcgtccgcggcatgtattccgccgcccgcgccgctatgtaaacggaatcgcccagcgcttcgcgcggccgatacctacctcatccatgcgtccgagcgcacgcgtagtccgttggacagaccgcgcccacccatgagcaccacgttgaacgcggcccagagtacggcggtacgcatcaggtcgctcgtcagcgccggcgtcaccatattggccagtatgagtatgagcgtcacatacaccacggcggtcagcgtgcatgtgacggccagatagcggtagtcgcgcgcgccgataagaatgccgtcgattgccatcatccagccttgcagtgggaagaagatgcccatcgtcaccatgcccacggcgatcagcgtctgaatatgtggcgtaggggagaagaagtgcccggcgaacaggccgactaccgcaaaagccgcgccgattaccgcgccggtgaccagtcccgcacgcccggtcgcccgcgtcagccgccgcgcctgctgcacgctgccagcgcccagcgctgtggccaccagcgtctggccggcgatgcccacggaatccagcatgttcatcgcaaaattccaagaggagttcacggcctgaaacccggccaacacggcagtacccatgcgcgcggcacaggcgaccgtagtcaccatggccgcacgaatcgccaatgtgcgaatgaacaatggcagtccgtcgcccccggctgccgcaataccggccaaacgaggccgcagactcgcaccatccgcccgggaccacagaatggcggggattaccaggaacagccccatgaaccactgagctaccagcgtcgccactccggagccggcaatgccccaattcagcacaataacgaacaacacatcaagcaccgtgttcaccaccgcgccgcccaccgcagcgatcagcgtgatacgaaccttctgcaatcctcggaaaatgccgttcgccgcatataccatcagcatgcctggcgcacccagcacgattgcgcgcgtataggtcacggcttgttccaatacttcgccctgaccgcccagtgcccggcataatggctcggcagccgcgaacaatcccaatcccagtacggtgccgatgctcaaggccagccacaggccgtcaatgcctgcctgcagtcccgcgcgacgacgacccgctcccagcagatgtgccacctgcgcagtggtcgagtaggccaggaatatgcatagtccgactgccgtgaggatgatggtggagccgattgacaggccggccaacgccgcatccccgatatggccgacgatggctgtgtcgataaggatgaaggtcggttcggcgatgagctggccgaaggtcggcagggccagcgccatgatccggcggttggtggagcgggcgtcggtcgggccgatgctgacgtttgtgtttgcgccggcatgcggggtgccgaagccatcgcggcgtgtagtatcgccggaactggtggctttggcgtcggaagagtctatgggcacgctcacacgcatatcacgcctgactgcgttgcgcaagcacctgttgtgggcgcggaatgttatccccagactatccaccaagttatccccagtatgtggataacttagtggattatccccagaattatccccaaaatgtggataacttatttttctatccacattttgctttctgcgtgtcgtggcgctgactcataggtgaataaggaatgaaccgatgcgggcaaccgtttcgtttccatacgatatcgttcacctgccacgccacatcctatacttggaggctatgccagaaggaagtgaacactcgtatcagaatgggttcggcggtggcctggatcgtggcgatcgtggcgaccgcgcgggccggggcggcacgcagacgtcggcggcggccggcgacccgattttcgaccgcgtgcccccgcatgatgacgacgcggaaatggccgtgctcggcggcatgctgatgagtaaggatgccatcggcgaggtctcgcagaccattgacgtcaccgatttctaccagcccaagcatcagacgatctataacgcgatcatcgatctgttttccgccagtcagccggtggacgtggtgctcgtggccaaccagctgttggcggatggcaacctcgacaaggtcggcggcgcggactatctgcacagccttgtcgcatccgtaccgaccgccgctaatgccatgtactacgcggagatcgtccatcagcgggccattttgcgcaatgtgatcgccgccggcaccaaaatcgcccagctcggttattccgccgagggatcgcaggctgaggatgtggttaacctcgcccagtccgagatctacgagatgtcgatgggcaaggtgcgtcaggactatgccgccatcggcccggtggtccacgacgcgctcgaccagctggacaaactgcagcaaggcctcgtcaacaagggcgtgccgaccggcttccgcgacatcgacgacgtgacccagggcctgcagcccggacagatggtcgtcgtcgcaggacgtccggccatgggtaagtccacgctcggcatcgacttcgcccgcgccgccgcgttgcaccacaacatgacttccgtggtcttcagcttggagatgagcaaggtggagctcgctcagcgtattatctccgccgaaaccaatattccgatggccgccctgcgccgcgccgacgacatcacccccgaacgctggaacaccctgaaccagttctggaccaagatgcagaacgcgccactgttcattgacgacagcccgaacatgagcctcatggagatccgtgcgaaatgccgtcgtctgaagcagaccaacgatctgaaactcgtagtcatcgactacctgcagctgatgacctcgggcaaggccgtggaatcccgccagcaagaggtgtccgaattctcccgtgccctgaagctcttggccaaggaactcgaagtgccggtcgtggccctttcccagctgaaccgtggcccggaaatgcgtaacgacaagaagccgcagctctccgacctgcgtgaatccggctcaatcgaacaggacgccgacgtggtgttcctggtccaccgccctgacttctacgacaaggaagaccgccctggcgaggccgatatcatcatggccaagcaccgtaacggcccgaccgaaaccttccacctcgccttcctcggtgccacgtccaaattcaaagacatgccgcaggactacaacgccaatcagggggtgtgatgatggcaagcaacgtttcacgcgatgtttcgcaagaccaatcgtccgtggtgcagacctgcaaaccgtggtatgcgttcgccaccgtggccgcaggccgcttcgtgcggtttgcatcccgcgtcaccaaacatggcggttcggctttgcccggcaaagtcgtagaaaagattgaccccggcttcctgacccgtacgctcgggcagttgccgcttggcgtggtattggtgtccggcacgaacggcaagaccaccaccacccgcatggtcgcctcgatgctctccgatctggggctgaaggtgttcaccaatccgaccggctcgaacttcgtgcgcggcgtggtctccgcactgcttaccgaagtcacgctcggcggcaaattggacgcggacatcgccgtgctcgagctcgatgaggcgtacgccgtccacttcgtcaagcaggtcaagccccgttatgcattgctgctgaacgtgatgcgcgatcagcttgaccgattcggtgaaatcgacaccacggccaaactgctcagccatgtggctgcggcgactaccggcactgtggtactgaaccgcgaggacccgcgtatcgccgcgctcgccgcgaaggccccggctggcaccaccgtgcgatacttcggcctcgccgacgatttgcgccgctatttcccgtccgatgacgacatggccacgaccgtgtcggtggaaggtgtggccgggccgctcccctcagccagaactcccctcagtccgcgaagcgaactgagaggagcttccgcaggcacggcagaacttcccgccgacgtgacacttaccgcagtgggcgaccacaaggccaccttccagatggacggtcagggctacgccaccgacgtcaagcttgaaggcgtctacaacctgtacaacgcggccgccgcgctcgccgtggtacgtgcggtgatgcaagacaatgccgccgcatccaaggccaccgccgcagccaacgcctgcgccgtgtccgccgacgagctcatcgccgccgtttcccgcgtcacgccggctttcggccgtggcgaggtcatcgacgtcaacggttccccggtcgaactgctgctggtcaagaacccgatgggcttccgcctctcgctcgccagcttcgacccggccaacgcggacaccatgatcgccatcaacgacgaatatgccgacggccgcgacatgagctggctgtgggacgtggacttcacttccctgcgcgcgtccggtgtcgccatggtctccggcgtgcgtgcctgggacatggcattgcgcctggggtatgaccaagtgccagtcgccgatacgaacaccgacctcgaacaggccgtcaccgcattcgtcaacgccaatcccggcacacgcaagcacatctactgcacctacaccgccatgctcaaaacccgcgccgtactgggccgcatcaccgaagtacgggacgcgggcgtgggcaagtaactatcctctagcgcccgcgcgccacctcccgcctgcgggaggacatggtgaggaataagacgcttcccgtcagcgggaagacatcgacaaggagaacgtgacatggccagaacaattgatgtggtgtccctgtatcccaaagacatgaacatctacggcgattccggcaacgtgctgactatccgccgccgtctggaactgtacggttatgaaccggtcgtccaccagtacaatcaaggcgacgactggcccgaccaggtggaccttattctgggaggcggcggccaagacaccggccagaagaaaatcatcgacgacttctaccatcgcgccgacctgttgcgttcgcttgccgcagacggtacgccgatgctgatgatctgcggcctgtaccagctgttcggcgagtactttgaaaccgtggacggcacccgtctggacggcatcggcgttatcggtgcttataccgtgggccagaacgtgcgtatgatcggcaatcttgttgagcattccgaccagttcggcgatgtgattggctacgagaaccactccggccagaccttcctgcgcgaaggcgttcagccactcggcaccgtcaatcaggacggccgaggcaacaatggcgaagaccataccgagggcgcgcgcgtgcacaacgtgatcggcacctacatgcacggctcgttgctgcctaaaaaccccgccatcagcgatttccttatcgaaactgccgtgactcgtcgttacggtacgttcgatacgtccgatcagacccccgaacaagccaaggagctcgcccggctcgatcaagtagccaccaacgcgcgcaaggctgccgccgaacgtcctcggtgaattctcggtgagtcctcggtaagtaccaatcagcgaaaaatcagtcgaaatcagtctgagggtctagtacattgccctgttgtttgcgctaggcttggtggtacgagacatggcaccaggccatgtcggacctcgaaggaggggtatcatggctgattttgatcttctgggtgatggcctgcgcaaggtcctgctggcgggcatcggagcccttgccaccggatacgagaagagcagcgagctcgtcgacgaactcgtcaagaagggtgagattacggtcgagcagggcaaggcgctgaacaccgagctcaagcgcaaggtgagcgagacggtggatgacgccaagaaggccgccgccgaagccggcgacaaagctgctgccgcagccgacaccagtgccgccgacaagcccgctgacgagggcaaggccgagtgaccaagcccacacgcgctacgccggaatcagggtcgaccccgctttccagcagggtcgaccctattctgacgcctgcgaaagccgaacgtgaggcggcggcgaaccggtccgtcgacacgtcggacacgctcaagcagaccgttaccaaggcgactccgagcgtatccgacgaaacgctggcactgttcggacgcaggaacgatttcgccacgcgctaccatctgacgcgtcgtggcaagatcaaacgactggggcagatcaccagaatcgtcgagcaattcgacgtgctgcacggcctgactccggtcaaaatgcgcctcatgttcgaggcgctcggccccacgttcgtcaaagtgggccagattctgtcgatgcgctccgagattctgccgcaaagcttctgcgacgaactcgccaaactgcgcgccgacgccgacccgatgccgtattccacggtgttggatgtgcttgccgccgaatacgggcgtcccgccgacgaggtgttcgcgcatatcgaccccaagccgttgggctctgcttcactggcgcaagtgcatcgcgccacgctgaaaaccggcgaagatgtggctattaaagtgcagcgcccgggtgtgcgcgaaaccatggcccaggacgtctccatcatgcgctccatagccaaggccgccactaaggtgattcgcacctcacagatcgtggacctgaagggcgtggtcgaggagctgtgggacaccttcgaatcggagactgactttctgatcgaggcccgcaatctcgccgaattcaagcgtttcgccgcccgattcaaatacatggactgcccgacggcgtacaccgaactgtgcaccgagcatgtggtggtcatggagtacatcgacggcatctccgtctcccatccgggccggctcgtcgatgctggttatgacttgaaggagatcggcaccaagctcgtcgacaattacgccacgcagattctcgacgacggcttcttccacgctgacccacatcccggcaatatcatcatccggggcggccagatcgtacttatcgacctcggtatgaccggtcggctcgaccagcgcacccgtgcagtcctcaaagaaatgattttcgccgtcgccaaacaggattcgcccgctctggccgaggggctgctgcgatttgccggcaccgaggccgatccggaggactacccagcactgctggctgatctggacgtgatcgtcaaggaattcggcaccgtggatctggccgaactggacattgccgccttcctgaccgcactgacgcagatggccggccgccacaacatcgaggtgcccagtacggtgaccaccgtcggccgcgcgttggttacgctcgaaggcttgctggacgagttcattcctgatgtgaatatgatcgaaatcatttccgaccatatcgccacgtcgaaatcgctgaagaacgccaccaaagacgagatcaagtcgctgggcgttgagggacatcaggctttgcatgccacgctcggcaccatgaccgaactcaagaccgtggcccgtatgctgacccgtggtcagttgcgcgtcaacatggaactggtcggctctgaagagccgttccagctgctttcggatatggtgaatcgtctgacgatggccctgattgtggtcggtttgttcgttggctcgtcgattgtctactacgccggcatgaagccgattatcttcggcattccggtcatcggcttcatgggctacgtcgtggccttcgccctcggcgtatggatcgtcatcgacatctacttaaaggggcgcaaaaccaagaagcggtagggcatcgattggtatcagtccagcgggagggtggattcgcgctggataaggtggcagggtacgtagtcgacaccgtgatgcgggttgccgtcgatggcatcgaccaagtatcgtgccgcacgccgtccgatggtttcggtttcgttgtcgatcgacgtcagtgcgggcctcgagctggaggtcagtaccgaccagttatcgtggccgatgacggcgacgtcatccgggatgcgcagtccctgctgcttgagcacgtcaatgcagccgcgggccaactgatcgttctggcagaccactgcatcgaacttgaccccttggtcgagcagcaggcgggtggcggcgcggccccagccttcgtcccatttgccgtaacgaattgggccggcgggttcaatacctaattcggagagtgcctctagcgcgcccttggtgcggtcggtggcagcggtataggtttcgtcgccgccgataatggcgatgtgccggcggccacacgagatgagatggttgatggccatgcggccggcgtccacgttgtcgcaagtgaccgagcagtctttggggtcggtggaggggccgtagacgtagaccagtggcacgccccagtcatggccaagcgtgggcctggggttggtctcgcactgcacgatgagcagtccgtcgaccttgagggacagcagtttctcgacatgctgacgttccaaggcggcgtcgccacgagcgttggccaacaatactgaggtcgattgggctcgcaactcgttctccgcgccgataagaatcggtgtggagaaacgaccctgcagatcggaggtgaccaggccgatggtgccagtagtgccgcgggctagggattgggcaagcttgttgggagagtagttgagttgcttggcggcatccagtacacgctgcttggtttcttcgctgatgcggggtttgttgtgcagtgccttggatgcagtggccgtcgagactccggccaatgccgccacatcctcaagtcgcgctgcccgtccggttgctggctgggtcatcatgcctcgattccttggttcttcagcagtatatagcgcattgttttgcgatgaaatacctcatacggtgtggtgcgccattacatctgggaataattgtagcttcaatgcgaaaactttcgcaaacatctttttttcggcgtggcgtagtcagggaaattgttcaagtgcaaggtaagtgaaagaaagcgttacttccatgttcgcttttgtttgatttgctcgacacgccggaataatcattgatattaagccaattcaagcacgttattcatagtcgaatcacagtctcgaacccgtttgatgtgagaaaaaacgcgaaaatgcgaaagcgcttttgcaaaaacttccatgttcgtttatattgagaaaaggctttcgcagtgttacctgctccgagcaaaggagcgagcagggcgaaaccaaggaggcggaccgtccgccaccgcctctcatagttgagcggatatatagagaaagaagcgaacatggtgtctttcaataaactgacccgtactcttgctggcatcgctgccgccgcgttgatcgttccgctggccgcctgtggtggctccggcaatggtggcactgccaccgccgaaggtatcccggccaagggcaccgacgatggtaccgagatcaccctgtggacccgttcccctctggagcgtcaggccaagaacgtggtcgaggcttacaacaagagccacaagaaccaggtcaagctcgagatcatcccgaacgacgatatggaaggcaaggtcggcggcgcttcgcagaccgactccctgcctgacatcctcgccggcgacgtggtccgtattccgtactgggcttccgagggcatcttcaccgacatcaccaagcaaatcgatggcctggataacaaggccgacctgcagcagggccacatcgaagccggtactgttgacggcgccgagtacaccctgccgttcatcaccgatgtttccgtgatggtctggaacaagaccctgtacagggaagctggcctggatccggagcagggcccgaagtccatcgctgagttcaccgagcaggccaagaaggtcgccgccctcaacaaggatggcgtcgcaggttcctaccttgccggtcagtccggtggtgctctggtcttcgacctcttcccgtccgtgtgggctgacggcgaatccgtcatgaacaaggatggctccgaggccaccctggacaacgactccatgaagggcgtcttggacgcttacaaggagctggccaacaccaccaacggcctgggtgcaggctccaaggaagagaccggcgccacctggaccgctccgttcgcgaacggcaagatcggcgttatgccttacccgaacacctccaccactgctctgttcgatgctgagaaggacggcggcttcgaggtcggcgttgctccgatcccgggcaccaaggaaggcaagacctccacgttcctcggcggcgatgccatgggtatctccaaggactccaagcacgttgctcaggcctggaacttcctctactggctgatgcagtctgacgctcagaaggaagtcttcgctgaccaaggcgacaccgcctccaacatccagaccctgaagaccgcttacaaagacgctgacccacgcatccagaccatcaactccgtgattatcgacggcaacggccagaccccgaagtccccggccttcaacgaagccttcaacgccgctggctccccgtggcagctgctcgtgcagaacgccgtgtggggttccggtgacctcaaggccgacaacaaggccgtcaccgacgtcctgtctgcccagtgattcggtggtgatgctcctcaccatcactcatcaaatcacagcaataactgaataacaactgaacagattgagccggtccctcccttgtgagggcaggagccggctcaaccacataatcgaacttctatcttcttcttcattccttttcttccttcatcactacataccttatgaatgcggtgtgttggcggggcttcggagtcctccttcctcgaagccctgacatcggattgcattcggattccgtgattaccatttcacagtaatttcccaaaggagagagaaacatgtcgagtgtttccaagagcgccggggctgtgcccgtgcataagtccaaggcgaaggcggcgcagaccaggcgaggtctgctgtacgcacttccggactggctgatgattatcgtcctgttcttcgtgccgattgttctactggtcgtcatggcctgctctcgttggagcctgctgggtggcaaccgcggcgtgaacttcccggacaacttcgtcaaggtgttcgagaacaaattgttctggccctcgatttggttcacgctcgagtacaccgtgatcgtcacgatcttcctgttggtccttggcctgggcatggccatgattgtgcaggagagctcgaagtggaacaacgtgctgcgtacctgcttcctgctgccgtccgcgacgggcctggcgtccgcgtccctgctgttctacgccctgtattccccgcaggtgggccctgtcaccaagattctgagctcgttgggtctgatgcaggagggtggttcggtgctggccaccggccagtcggccctgtgggccacgattatcgtgattgtttggcgtttctcgggctactacatgctgctgatgatgatcggtctgcaggccatccccggtgatctgtacgaggcggcccgcatggacggcgccggttcctggcgtatcttccgctccatcaccctgccgctgatgaagccgaccatcgtgatgtgcctggtctactgcgtgaccggctcgatcctcgcgttcgatcagttcttcattctgaccaagggtggtccgaacaactccaccatgaccgtggtgcagctcatctacaacttcgccttcgattccaagaaggatctgggtatggccgcggcgctctcgctgatcgtgctggtggccttggtcatcatcaactccatccagatgcgcggcatgcgcgacaacaccaagtgagaaaggggaggtaacacattatgactaccccattgtggaagcgtatcatcgcccggatccttgaggccctgctggccatcatcttcatcagcccgctggtctgggtcatcatctgctcgttcagcccgcaggccggttcggcccagtccaagggctggggcgtggccaactacctgaccctgttcggttatcaggaaggtctgcccaagtacctgttcaactcggtaatcgtgactctggtcgcggtcgtgttctccgtggtcgtctgtacgctggccggctactcgttctcccgcttcgactacccgggccgcaacctcggcttcatggtcaccctgtcgatcctgatggtaccgtacgcctcgctgctgatcccgctgatggtctggtacaagcagatcggcctgaacgacagcctgctgggcgtgggcctggtcatcaccctgttccagctgcctatgagcacgttcatcatgcgcaacgcgttcgacgcgatccccaaggacatggaggaggccgccatggtcgacggctgcaacagcctccaggccttgttcaagatcctggtgccggtggtcaagccttcgatggttacggttggcctgctcgccttcctcgaggcatggaacaacttcatgattccgctgtacttgagctcttcgtccaagtccacgctgccgctggcgatggtgaacatgcgtcagcagaccatgggcgtcatcgattacggtgccaccgaggccggcgtcgtgatcctgctgattccctgcgccatcctgttcctcgcactccagaagtactacgtcaagggctttatggccggagctgtcaagggctgacggctcgtgccgccggcccttggctgggagcccggtgggctcccagcaagctccgtgctgagacgcgacagcgtcgaagccaatactgagcccggctgaaaccggtccttaattgcagggccggaggcggtgtggtcaagggccttaaaaaaaggacaatcatgaacgttacaatcacttccccgttctggaagcggcgtcgcgaccagatcgtcgaatccgtcatcccctaccagtggggcgtgatgaacgacgagatcgacaccacggtgcccgacgacccagccggcaaccagctggctgacaacaagagccatgcggttgccaacctgaaggttgccgccggcgaattggacgacgagttccatggcatggtcttccaagactccgacgtctacaagtggcttgaggaagccgcctacgcattggcataccacccggatcccgagctcaaggcgctgtgcgaccgcacggtcgatctcatcgcccgcgcccagcagtcggacggctatttggacaccccgtaccagatcaagtccggcgtatgggccgaccgcccgcgcttcagcctgattcagcagagccacgagatgtacgtgatgggtcactacatcgaggccgccgtcgcctaccatcaggtgaccggcaacgagcaggcccttgaagtcgccaaaaagatggccgactgcctggatgccaacttcggccccgaagaaggcaagatccacggcgccgatggtcatcctgagatcgagctcgccctcgccaagctgtatgaagagaccggtgagaagcgttatctgacgctttcccagtatctcatcgacgtgcgcggtcaggatccgcagttctacgccaagcagctcaaggcgatgaacggcgacaacatcttccatgatctcggcttctacaagcccacctacttccaggccgccgaacctgtgcgcgaccagcagaccgcggatggccacgccgtgcgcgtcggctacctgtgcactggtgtggcccatgtgggacgactgctcggcgatcggggactgatcgacaccgccaagcgtttctggaagaacatcgtcacccgtcgtatgtatgtcaccggcgcgattggttccacccacgtgggcgagtcgttcacctacgactatgatctgccgaacgacacgatgtacggtgagacctgtgcttccgtggctatgagcatgttcgcccagcagatgctcgacctcgagcccaagggcgaatacgccgacgtgctggagaaggaactgttcaacggttccattgccggcatctcgctcgacggcaagcagtactactacgtcaatgcactggagaccacgcctgacggactggataacccggaccgccaccacgtgctctcccaccgcgtcgactggttcggctgcgcctgctgcccggccaacatcgcccgactcatcgcctccgtggaccgctacatctacaccgagcgcgacggcggcaagaccgtgctgagccaccagttcatcgccaacacagccgaattcgcttccggcctgacggtcgagcagcgttcgaacttcccgtgggatggccatgtggaatacacggtgagcctgcccgccagcgccactgacagctcggtccgatttggactgcgcatccccggctggtccttgggctcctacacgctgaccgtgaacggcaagcccgcagtgggttcgctggaagacggcttcatataccttgtggtcaacgccggcgatacgttggagattgcgctcgagctcgacatgtccgtcaagttcgtgcgcgccaactcccgcgtgcgctccgacgccggccaggtggccgttatgcgcggtccgctggtctactgcgccgaacagaccgataaccccggtgatctgtggaactatcgtctggccgatggcgtcaccggtgcggatgccgctgtggctttccaggccgacttgctgggtggcgtcgataccgttgatttgccggcagtgcgcgagcacgccgacgaggatgacgcgccgctgtacgtggatgccgacgaaccgcgtgcgggcgaacccgcgacgctgcgcttggtgccgtactactcgtgggccaaccgcgagataggcgagatgcgtgtcttccagcgtcgataaatatcggcgatatgccggcctgcgcgcaactggccggcaaaaaaatacttatgccgccatcgtctgcaataagtcgatgacggcataggccggatgtcagtatcgattggagccgaaaacacatccggggaatgaggtctcctgtgcggggtaatacccgtgcaggagattattttttaattatatgctcccgctgtgagagctgtcggcggagtcgactgagggcggtcataagcggtaccgtgtaagccaccctcagtctcgctttgcgagccagctcccgccagcgggagcctgttggttcctgattcagcgaggctgaatcgttgcgccgtaggtactgcgacacggcgaaacacagcaatgccctaatgcgaaaataaatgcgaaagctgagaaattaccgggtttttgttgtataagatggttgatatcactgagggaaagttgtgaaaccgtattcgctcggttatgatgtggaatcagcttcggtgaattgctccaaccgggatatccatggcggatatcacaccagatttactgaagacactcattccggtgaacccaataaccaataaaggaaactgatggagaacgggctctgcggcccagcatccacagaagaagtcctggtcgcatagacgcgacgtagcctgagcgaagacgcgaaagaccggggcggagaggtccaagcaggaatgcatcaatcaacacgaaagcggtggcttgcgtcaatcggcgcggttgcagcggtcgccacactggccaccggcggtgcagtcaccgcgcaggcagccgatacgcccgtcatcaagaatgcggatgtggcatatccgtcgttcaaggggtctgatgatccgatgaagacggcggcgaacaacaccacatataaccctgccgccagctatctgcaggagacattcgataacgacgtgaagaacctggccggcaccgacaccgaccatgacttctggatcgataagattctcacccgtactggtgcacagccaactggtaaaggcacgaacgacaagggtgcttactcgtatgaaggctccgacggcaacaactacctgttcacccgtggtcgcgccgcctacatgtacacgcacacgcctaatcggctcggttttgtgggtaacaccgcctactgggatgagaccaacagggatggctttaccgttaccgtaaacgctgacggtgcaaaccagacccttaacgaagacgcctcccagcgcaagcagacaccgagctacttcacctccctgttccagaccggtggcaagagcctcaagatcaaggaagttaagtacatcacctacaacaacgtgatggttgcgaacctcaccgtggaaagcacgcaggaccgcgatgtcacactgaccacggcctcgccgttcgccgccgagggtgctgatggtgccaccgaacttactggccgcgtgaacgtcaagaacaacctgacgaccatctatccgcgcttctccgccaacaaccaggacggttccaactggatcgtcagcggtggcaaactcaccagcacgttgagcctcaaggccaacgaaccgcagaccgtcaagattcagctcggcctgatcgccaacgaactgcctgactccaccaaggaatatgaggcccgttacaccggcgaccttaaggatgctgccgcctcctacaaggattccgtgaccacctacaacaagtggtgggtcgataacgctccctatgtggacactccggaagacaacatcgataagaccgtggtctaccgctggtggctgagtcgtttcaacatgctcgacgccaacatgcctggcaacaccttccagtacccgacctccatcgagggtgtgctcggctacaacaaccagatcgtgctcacctccggcatgttcatgatggacaccaagtggttccgcaaccccgagtactcctacggcacctggctttccgccggcgataccgccaagaagagcaatgcgggctattactactaccacgacaatccgggcgacccggccaactggaaccatagctacacgcagtacatcacgcgcgccggctgggactcctacaaggtgcacggcggtccgtccaccgtggccgagaagctggccgaccagggtgccgaggacgtgcaaggtctactcgcttccaagagcgagccggacaacaacgacaaccagaacaacaatgacaacagcttgattgactggtcctggtggtcgatgaccggtaacgatgccgacgccgtttccttctctgagccgggtcgctccggccagcgcatggatcgcgccgatggttccgccaatatgtgggccaacgctaacgcggctgctcaggcatacaaggctgctggcgataccgccaacgccgagaagatgcgggccatcgccgacaagatccagaaagaagtcaccactgaactgtgggacaagtccgacaacctgctcaagcacaggtggctgaacgacggtgctttcgccaagtacaaggagatcaataactactacccgtactccgaaggcctgatgcctaccggcaacgaagattacaacaaggctctgcgcctgttcgaggattccaacgagttcccgatcttcccgttcttcaccgccaaccaggcggacaaggccgcgttgaacttccccggttccaacaacttctccatcattaatgcgcagccgctgctgcaggtctactcggccggtattcgcaactacgatgcagccaagaatggctacatcaccaatgagcagttcaagaagctgctgtactgggtggcgttcgcgcactaccagggcggcgataacaaccaccctgatcagaacgagttctggaacgaggacaacaacaacgtcggcgatgtgaacggtgacggcgtgatcaacaacctcgacaagaaccttgacgccgcacagaacggcggcaagatcacctaccgctcctggatccaccacacccagctcggcaccacgaactggacgatggtcgaggacgtagccggtatggtgccgcgcgaggacaacaagattgagctaaacccgatcgaaatccccggttggaactacttcacggtaaacaacctgcgctaccacgatcaggatgtctccatcgtatgggacaaggacggcagccactacggtggtcctgctggctacagcctgtacgtgggcggcaagctcgccttcacctccgacaagctggcgcacctcatctatgacccggctgcgggaacggtcgaggtcaaggacgattccggtgcccaggttaccgtcggcgccgaagccgtcaagaacgtgaaggccgccaatcaggttaccttcaatgccgatcagcgcgtgaccgacctgttcgccaagtccggcaccaacgtcgactccgcctccaagtccaccacgaacgtggccaaggacgcggacgtgaccggtaccacctacgccgagaaggacaccaactacccggccaagaacgcggtggacggcaagaccgtgatggaatcgttctggggtaccaagggctccgggaacaagaccgacacgctcaatatcaagttcaaggacggcaagcagaagatcgacgacatccgcttgtacttctaccagagctcgtccagccagaccatctccggctatgccgagcccgccaactacaagttggagtaccagaaggatgacggcacatgggccccgattgcggatcaggtgcgcaccccgaactacgcgggcgcgaactacaaccgtatccagttcactccggtggagaccacgaccatccgcgtcaccttcacgccgcaggccggcatggccgtcggtgtcaaggagatcgaagcctacaacaccggtatcaaggctgacggcacttctgagaaccagactccgcaggtggatgcttacgtgtcttccagcacctcatccggtgccaagctcgtcggtacggtgaaggatgacggtctgcccgcagaaggcgacgtcaccaccacatggtcccaggtctccggtccggaaggcggtgctgcgaagttcgtggacgcctccgctgccagcaccaccgtcaccttcaacaaggagggtgactacgtcctgaagctcaccgcttccgatggcgagaaggaaggctccaaggaaatcaccgttcacggcatcccctctgacggtaccgtgaacgtagccccgcagtcgagcgcctctgccagctacaccaacggctaccagccgaaggacaacgccaagaaggtcatcgacggtcaggtggtatacgccaacacgccgaacgagacctggaacaactggggcgacaacaccggtgtggagccgtggctgcaactgaagtgggccggcaaggtgccgctgaagaaggccaaggtcttcttctggaccgatggcggtggcgtgccgatggtctcatcttggaagcttcagtacgctgacgctgacggtaactggcaggatgtgaaactggctgacggccagtcctacacggtcaaccggaacgaaggcaacgaagtgaagttcgccgacaccgtcgaaaccaacaagctgcgcgtggtcttcccgaagggcgccatcgtgggtgcttccgagttcgaggcgtacgccatcgagccggtgagcgtggacgaagtcaaccgactggtgcagaccggttccaaggccgatgatctgaagctgccctccaccgtgagcgccgtatacaccgacggttctcgccgtgacctcgccgtcacgtggggtaaggtgaccgacgctcagctggccgccgatgccgtattcgatgtcaagggcaccgtcgccggtgcgctgaacggtacggttgcacacatcgcggctcgttccgataccgcatcgcagaccgtgggtaatgcgcagccggttgagcagaccgtctaccagaacgccaagtccatcgacctgcccgccacggttccggtgaagttcccgaacggatacaacgacgaccgcaaggtcacgtggaaggatgccgacatcaaggccatcgacctgaccaaggttggtgactacgaggtggctggtaccgtcgacgacggttcgtcttccgcagctgccaagctcactgtccacgtggttgccgacccgaacggttcctccactcctgagcctgagcctgagccgttggtcggttggattgaaggcaaggcgaccaagaccaccatttcgcctgattccgaggcaacctggtcaccggccgaaggcaagctcaacgacggcgtagtcgtcgatgatacttggccgaccacggatgatcagaacgtcaacgacaaggtctggggttcttggggcaaggcaaaggacggcatgtacgcccagtacgacttcggtcagtccgtgaccgttgaccagagccgcgcccagttctgggccaacttcgctgagactgacgattcgaagggtggtctggaagtcccggacgcttggaagattcagtacctcgccgaggatggttcttggaaggacgtcgagcccaccgaggattacaccgtcgtgcgtaattcgccggcttctcgtgcggataccgatgccaagggttggagcgctgtgaccttcaagccggtcaccaccaagtcgctgcgactcgtgctcactccgcacaccggcagcagcaccttcggggccgccgtggccgagtggggcgtgcatggtattgacggcaccgagcctgaacctaccccggtcgacaagaccgcgctcaagtcggctcttgacacagccaacggcctcgatgcaaaccgctacaccgccgcttcatgggctgagttccagcaaagcattgacgctgcccaggctgtgtacgacgatgtcaatgccaccgaagaacaggtcgccgagcaggtgaccaagctcgaggacggccagaaggtgctcgttgcgctcgccaccgacgtggagaagtccacgttgcaggcggccatcgacacggccaaggccgaggccgcttccggcaagtacacggataagagtgtcgaggccttgaacaaggccatcgaggctgcggaaggtgtgctcaagggcgatgagtccggtgaggtcactcaggccgccgtccaggaagcgtccgcttcgctgaacaaggccgtcaaggccttggaagagaagcccgccgtcgaaacggtgaagaaggagtctctcaaggcttccatcgagcaggccaagaaggctgacaagtcgaagtacaccgaggaggcatggcaggctctgcagagccagattgccgccgctcagaaggtgtacgacgacaaggatgccaagcaggccgatgtcgatgccgcacaggatgcccttgacaaggcattttgggccaccaaggttgagcagaagcccggctcccagcagcctggtgtgaccgacactgataaggatgataaggacaacaagggtgatcgtgtgcctccgactggtgccgcggtttccgtagttgctgcggctgccgtgctgctcaccgccgcaggcgtgaccatcctgaagcgtcgccagtccggcgaccacggttcggctcgccactcggcctgacccgcaacggagtcattctgccgagtgagccccctcacagagggggctctagccttttccttctacccatcattactcttttcactcactcaatgaggagcactatgagtttccatgtatccgcgcaatcggttcgcgcggtggccggtggactcgtcgccgcagcgacattgctgtcaggccttgcccttgcgccgaccgcaatggccgccgattcagccaccgctgacaacgcgcccagcgttgccggtcacgcgtataacgaactgccgtataacaatcctgatgtcaccgtcacccaaatcgacaatagcgcactgcccagctacatgcgcaaccccatcgggcagaacgagggtattgacaccccgaacgatctttcgcagaactactactctgcagatgcatccgcgctgagctatgacggcaaactcttcgtcttcaccggtcacgatgaggcttcgcccgactacggctccttcaacatgaaggactggggcgtatacgtcaccgatgaagacggcctgaatcaaggcaaatggacacattacaagaccatcgccaaggcagacctgttcagctgggccaccggcgatggcgcgtacgccggccaagtcgtagccgacgataacggcaccccgagcgacacttccgatgattggttctactactacgtgccggtgaaggacaaggcttctgaggcggctggacaggacccgttcgccatcggcgtggccaagtcgaagagtccgctcggcccgtggaaggatgccatcggcaagccgctgctcaccacatcgcaaacccagattgaaaccatcgatccggcattctttgtggacgaggatggcaccggatatttgcactttggtacgttcggcactcagctcgccatcaagatgaagaaggacgccacaaccggccgcacctcatacaccgaggtggaaaccaaggctgatggcaccacgccgaacctccacaccatgaaggacgcggacagcaacgcgaacggcccgaagggattcttcgaggcggcgtgggtgttccgtaagggcgatacctattacaacgtgtacgacggcggtaagcccggttcgggcacggccacctgcgtggaatcgaactatcaagcttgcatccagtactccacttccgacagcccgctcggcccatggaagtaccaaggcgtaatcgtgccttctggctcggccaccacgatgcacccctcggtgctccagttcggcgacaaatggtatgtgacctatcacaccggcgacaaggaaggcggcaccgatttccgccgtgccgtgtgcattgatgaagtcgattggaccgccgacggccagatggtttccaccgcccatccaaccaaggccgagaaaacgcagccctccaccaacgtggctccgtacgcaaaggtgagcgccacgttcactgaaacgcctgcttggaagggttcggtgaacgacggccgtgtgttgcaaaccgctgtggtcccgccgaatcactggaccaactaccgttctatcccgcaatcgcagtccggcgattctctggtctaccaatgggatggcactgtgcgcgtcaactcgtctaaggtttggttcgacgtggattccaacgctctgcgcgcgcccgcctcgtggaagattcagtacttggacgcggacggcacatggaaggatgtcaccaacccgagtgcctatacaacgaccacaggcaaggccaaccccaacgccgtcaccttcgatgcggtgaccactactgccttaaagctcgacatgaccggtcaagctgtggatggcggctatgcctccgtggccgttgctgaatgggaagtcggctccgactccagcgaatcgccggcaatcactgcgccgaagagcgtgaccaccgccaccggtactgcgcctactctgccggccacagtggatgtgaagtacgggaacccaaccgttgcctccccagtaatttggcgtccagttgatgcttcctcgtatgccaaggtcggttcgtttacggcctacggcgtggtcgccggcgtgcccggtgaggcaagcgagcagggcaatgtgtcggtaaatgtcaccgtgcaggacggctaccagcctgccgctgataccacgaagccgactgtaaccgttgccgttactgctaacgcaggcaatagcgagtggctcaccaccgctccgttcgccaccgtgcaggccacggacgacaccgcacctatcgccaagctggagatttccgctgatcaaggcaagagctggaccaccatcgccgcgaatgcaaacgcggccattgccacgctttcccagcagggcgatgtcgaagtgtgggctcgcgccaccgatcaggccggcaacgtttccgacgtggccaaggccggcggcaaggtggactccgccgcgccaaccgtgaccgccgccgccgataaggaggagcgcacgctgaccttgaccgctgatgacggcaccggttccggtgtcgcatcaattgaataccgcattggcacagacggtcaatgggccacgtacagcaagccgattgctgcaccgagcgcgtcgcgcgccaccgtgtactaccgcgccaccgataaggccggcaacgtgtccgcttcggcgaaaaccgacattccatccgacacttccgtgccgctgaccggctacattgagggcgatgccaccgccaccgatgtggacggcaaggcatccggctgggtcaagggtgccgccgcgttgaacgacggcaagatcattcccgatatcaccattgccaacgaggatgtctggggcacttggcccaacaccggtgagatgcgcctcgactacgagtgggaccgtgaagtgactatcgactctagccgcgtgcaattcacctcggatgatggcggattgggtattccggcatcgtgggaattgcagtactgggacgccttggcgaacaacggtgccggcaacttcgtggatatttccgacgccacctacactgtgaccgccaattcaccgtctgctggctgggccaccggcgatgccaaggggtggtctgatggcacgtggaacactccggtcaagactaccaagttgcgtatggttatcacgtccggctcggcttctccggctgttgccgaatggcaggttcatgccattgacgacagtacgcctgagccgcctgagcccacaccgatcgacaagaccgagctcaagcaggcgctcgctgactcgcctaaggctgacgatgcctccaagtacaccgagacttcatgggcggagtacgcggcggtattggattcggcgcagcaggtgtataaggctgaggatgccaccgaagctgcggtggtggatgccgcaacccagctgaagcaggcagcgaagaagctggtgcttgtagctacggtgcaagatcgtgccgcgctgagcgctcagctcgatgccgctgctgccgtggatcgcacaaagtggactgatgaatcgctggccgtgcttgattcggcagtcgctacggcgaatgcgctgacgagtgatggtcaggccgcccagtctgacgtacaggctgcgactgaggcaatcagcgatgccatcgcgggtctggttgagaagagcaccacgaagcctggccagggtggcgataagcccggttccggcacggacaagcccaaccaaggcaacgattccaaccagaacaagggtgatgcagactccggcaagcacaagaagatacctgacaccggtgcagccgtgcttggtgttggcatcctcgccgtggtacttgctgttgcgggtgtaatcatcctcaagcgccgcaagtccggtacctgctagtcccactcgctcggcctagcatcaccaagcccccgcgcatgaacagcgggggcttcacttttgttcaataacaagcattatgtgcgcgtatgagactacgatggtggggaatctacgaacaggggcagcaatgacggcatacatggaccataaggatctcgccaacgaagttatcgatcaggcgcgcgcacaagagattactgatggtgtgcatcgcgtgcttgaccggattgcctcagcggagtccgcagccgggcgtgctgccggttcggtccaattgctggctgccaccaagacgcgcgatgtcggcgagattctggcggctatcgatgctggtattcgcgtgattggtgagaatcgtccacaggagattactgtcaaggctgacggtctggcaaaacgactgggggagcgtggttattcgctaggcgtgattgatgccgctgaggctgacacggccaatgccgcagctgcaacgcatattcctttccatctcatcggccaattgcaagccaataaaatcggcaaggtgctgccggtagtggacaccatcgaatccgtggattccatcgaactggcggaaaagatcgcccgccgtgccaccatgcgcggcatcacggtcggcgtgttgctggaggtgaacgaatccggcgaggaatcgaagtccggctgcgcacccagccacgccatcgacttggcccagcgcatcggtgcgatgggcggactgcgcttgcagggattgatgactattggcgctcatgtggatgatgagcgcacgattcgtgcgggcttcgcgcatctgcgccgcactcgtgaccagattcttgcctccggtgccgaaggcacggccgactgcaccgaactgtccatgggcatgacccacgacatgacctacgccattgaagagggctccaccatcgtgcgcgtcggcaccgccatcttcggcgaacgcgccttcatctgattggagctatacgaaaaaaacgccacttgatagccaagcggcgtttttttcgtaaggattttcggcgtatcaatcacgcatagatattgcgcggacgcatgtcctcgggcaggccgtcgagcagaatcgccacagaaccttcctcgaacacggagcgaatacccgcggccagcagcggtgcgcaagacagtacggtcatattcggcaggcgcttctcttcgggaatcggcacggtgtccataaacacgatttcatgcgcgccgcagtgagacaggcgctccacggccgggccggagagcaggccatgggtggcgaccagcgtcaccgacttggcgccggattcgttcagggtgcgcacggcttcgcagatagtaccggcggtatcgaccatgtcgtcgatgaccacgcagtcgcggccgtcgacatcgccgataatgccatgtgcctcggcatggttcggacgagtaatatcacgctgtttgtggatgaatgccagcggcagattgcctagcttggcggcccactgttcggacactttgatacggccggcatccggggacacgatggtggtgttgcccagatcaagggtggaacgcacgtaatcgagcagcaccggcatggcggttagatgatcgaccggaccatcgaagaaaccctgctcctgagcggcgtgcagatcgaccgtcataatgcggtctgcaccggcggcgtggaacagatcgaaaatcagacgggcggtgatgggctcacgaccgcggtgcttcttatcctggcgcgagtagccgaggaagggcgccaccacggtaatcgacttggcggaggcgcgcttcaaagcatcgatcatgatgagctgttccatgatccacttgttgatatcgcccgaatgacactgcagcacgaacacgtccgcaccgcgcaccggttcggtgaaacgcacgtacatctcgccattggcaaagtcataggacgtggtttcgaggatttcggttcccaagcattcggccaccttctcagctagctcggggtaggcgcggcccgtgaccaatacgagtcgtttatccggagtgccttcaagaatcgccgacatgcgttcgcatcctttgtttgagtcgctgtgtgatttacgccttaaccagtgtacaagcaccccgccgcagcgaacgccacggcggggtgcttatttcgtaagagtgttgagattgccgaaatcactcggagaactcgacactgaccttattgtctttgatggtgaagttgccgttgacctccttgccttcaagcgtgtacgttagctgggcgctcacggtgccatcggcattattggagttctgcgagatgcgcgcgttggtgatgcgcgtgttctcgcccgaggatgccttgctggtcagcagtgcgcgctggttcgtatccacgtgaggatcggcgatggtgttggccttgtcgtagttgccggaggagatggcggccacatagctgttcgcaacgctcttcgcgctgaacacggcggaagacagcacgccatacacgataccgaacagcacgaggaagccggccacggcaccaacgatgatgaagattttcttctgctgctcattcatggtggtggaggtcgcgccaggtgcggctaccggtgccgctccgggagtgatgggagccgcgggctgcgtgggcttgtccaaaacggtggacatcgcgaaaccggcaagaatatgggcataccctgtcccgcctcatatatagactgtccaagttgcccgaagaggcggtgccggtttggtgctgcgtcatgggctaacacgcatacacactcctgccacggaacgtccgtggccgaatagtccgaaggaggtgggtgatgtctgcgcacaagtacgaactgatgttcatcgccgatcctgagctggatgagcgcggtctgaagaagctgaccgagcagtatctggaactcgtcaccaaggaaggcggctctttcgatgagcccgattactggggccgtcgcaagctcgcctatgagattgccggtaagaccgaaggcaactacgtcgtggtgaagtacaccgccgagcccgctaccagcgatgagcttgaccgtgttctgaacctcaacgaatccgtgatccgcacgaagattcttcgtaagggctgaatcaagcgtttagtcagctgaacagctggtattcaaggtaagtaagaaggaccgttatggcaggcgaaaccgtcatcaccatcgtgggcaacctcactgcggaccccgagctgcgcactattggcagcggtgcgaccgtggcgagcttcacgattgcttccaccccgcgaacctggaatcgtcagaccaaccagttcgaggatggtcaggcgctgttcatgaggtgctccgcttggcgtgatctggccgaccactgcgcccagtccctgaagaagggcatgcgcgtgattgccaccggtcgcctccagcagcgttcctatcaggcacaggatggttcccagcgaaccgtcgtggagatgcagctcgatgaaatcgggccctccctgcgctacgccaccgcacaggtgactcgccagtcgtccggtcagggcggcttccagggtcgttccggtggtttccagagtggtcagcagcccaatcagggctatggcaaccagggtggccaaggtggttatgccggtggccagggcggttacaacggtggctatcagggtggtggcgctggatactcccagcagtctgccgctcccgccaacccgtccgctcctgcggtcgacccgtggagtaatgccggtgcatctgatgccggtagcttctccacgttcggcgcttcctccgatttcggcggcgacgattccgacccggagttctgatcagtacttgcctccccgctgccagcagcaatcaatatcaagatttataaggagaacatcatgtcacgtaagaggccgcaaccgccggtcaagccgttcaagaagaagccgaacccgctgaaggccgccaaggtcaccgagatcgattacaaggacgttgcgctgctgcgtaagttcatttccgatcgcggcaagatccgttcccgtcgtatcaccggcgtgaccgtgcaggagcagcgtgagctgtccaaggcgatcaagaacgcccgcgagatggccctgctgccgtacgccacctcgggtcgctgagttagggaggctttgaacaatggctgaaaccaaggttattctcaccaagaccgtgtccaacctgggccattccggtgacgttgtcgacgtgaagtccggctacgcccgcaactacctgttcccgcagggcctcgctttcgcgtggaccaagggcgctgaggctcagatcgtcgctatgaagcgcgctcgtctggccaaggccgtcgctacccgcgaggacgctgtcgccgctaaggccgccatcgagggcactaccgtcgagatcgccgccaaggtgtccgagtccggcaagctgttcggtggtatctccaacgaggccatcgccgtcgctctgtccgacaaggccgcggtgaacccgaaggccatcgaggtcgagaccatcaagaccaccggcgatttccccgccaaggtggccctccacccggagatcaccgcttccttcttcgtgaaggtcgtggccgagtgagtcattccggcctagtgctggaatcacacagaccaagagtctgagcttaagcatcatcccccgtgcggttcgcgccgcatgggggatttttgtattagcaaaaacgccggaaataggcgcgacacgccgagagttgcattcgcttcaaatctgagtatatttatcacctgttgcaaggaatacttcaacatctaaccaagcccctgtagctcagttggttagagcagctgactcttaatcagcgtgtccagggttcgaatccctgcgggggcacagacaaccggaatcgaaagattccggttttttgtttttttcagcatcagtccgtagctggtgcggaaaggccgtcttcgcgcgtgacggccggacgtgtaaggagcaacgtcatgcctcagatattcacgttcaccgtatccgaccccgaaggcatgcacgcccgcccggctggccggttggttgccaaagcgcaggaatatgaatcgagcatcaccgttgcctacggtggaagatccgtggatgccaagcgtatcttcggtgttatgggacttgatgttcaacaaggtgacgaggttacggttcgggtgcagggcaacgatgaagctgtcgctgctgcagagttcgagcgattcctcaaggagcacctgtaatgagaacgatacagggcgtcggcgtatccgctggcattgctatcggcacggtccgcgtgctcgccgccgtagattatgccgtagaacgccgcttaatcgacgacccgcaggccgagatggatcgattccgcgcggcccgtgacacggccgtcgctcagctcaagcaactgcgtgacaacgtcgccgctgagttcggcgaaaacaaggccgaactgttcgacgcccatcggcttatgctccaggacccggactatgcggaatgcgtcgaaggtttgattgcgcaagacaaggtgaacgccgaattcgcggtgaagagcgccgccgaacagttcgccgccatgttcgctgcgatggatagctcgaccatgcaggctcgagccgctgatgtcaaggatgtttctcgccgcgtgatgaacgtgctgcaaggcaaatgcgatagcacggcgcaggatggcagtgtacaaggcgatgctgtgcagaacggtattgtgcagaacgggatcgcgcagaacggcgaaagccacatcatcttcgccgaagatcttgctcccagcgataccgcgcagctcgaccgcgctaaggttttgggcctcgtgaccgccaagggctcagcgaactcgcacaccgcgattctggcgcgcacgatgggcctgcccgccatcacaggtatcggcgacgcctttgacccggccgatgatggtcacgttgccgtaatcgacggcgccagcggtgcggtattcgtcgacccggacgaggccacgttgaccgaataccggcgcaggaaggccgaggctgaggagcacctaagcctcctgcggaagctcaagggcaagcccaccgaaaccaagtccggtcagcgggtccacctgtacgccaacatcagccgtccctctgacgcagccgccgtgctggccaacgatgctgagggcatcggcttgttccgcagtgagttcctgtatctggaacgcgaggactggccgaccgaggaatttcagttcgatgcatacggacaagtcgcacaggagatgggcgaccgtccggtcatcatccgtacgctcgacatcggcgcggacaaacaggtcgactactttaatctgggccacgaggataatcccgcgcttggttaccgggcaatccgcatctgcctgacccgcccggagattttcaaagtccagttacgcgcattattgcgcgcctcagcatacggcaacatcgccattatgctgcccatgatcacctctgtgcaggaggtacgcgacgccaagcggattcttgaagaagccaaaagcgagctgcgcggcgagcgcatcgacttcaacgagagtatccagatcggcgttatgattgagacgcctgcgtcggtcattatggccgacgagctggccgccgaagtcgatttcttctccatcggcaccaacgacctgacccagtacacgctggcctgtgaccgtcagaacccgagtctcgaacgctttgccgacccgcattcaccagctgtgctgcgcatgatccagatgactatcgaggctgcccatcgtcatggcatctggtgcggcatctgcggcgagcttggcgcagacttgagcctgaccgatacgttcctgcgcctaggaatcgacgaactgtccgtctcgcccaccagcgtcctgcccctgcgcaacgtcattcgcaaccactgagattcaaggtcgcttcggctgattccgatggctttttgggcattgcattcggctggacattcgacatcgcatcttgccggcatttcgtcgtggggcaaagtgtacaatcaccacgtttgctttcgcgcccagcgtaaatcgcgtcgccggctccgcgaacggatttccagtcacacagaatgccgtgaacagtcagccatgcctgttgcgcggcgaagagaaaagaagaagcagtggattatcctctctttaccaagctggccgccgagttcttcggcaccgccattctgatgatcttcggcaacggctccgtggccaacgttgagctcaagaacaccaagggccaccacgccggctggctgaacatcgccatgggctacggcttcggcgtcatgttcccggtgctcatgttcggtagcgtctccggcgcgcacatcaacccggccatgaccatcgcccaggccgtcaacggcctgttcccgtggagcgacgtgctgccgtacatcgtcgcccagctgctcggcgccctgctcggccagctcatcgtctacatcacttactacccgcactacaaggagaccgaggacgccgaggcgattctgggcaccttctgcaccactgacgcggacaaccagaaggccaactacttcctcaacgagatgttcggcaccctggtgctcgtcttcggcgccctgtgctgcctgtccctggcttggggcaagcaggattacgccgccgcctccatcgtcgtcggcttcattgtgtggggcctcgtgacctccatgggtggcccgaccggccctggcctgaacccggcccgcgacctcatgccgcgtctgctgcacgccatcctgccgatcccgcacaagggctcctcccgctggggcgaggcctggattccggttgtggccccgattgtcggcgccattatcggcgcttggctgttcgtgttcttcttcgccagctgattcgttgattgattcatatatgcaaatggcctccgctcgttttgggcggaggccattgtcgttgaatcaggtaaacgcagagactactgctccaggaacacctgcggggccttcatgaagttcgtggcacagtgttcgccgcagaagtaataggacttgccctcatactcgcgcgtgatcgcgtcggcattcaccgccacggtcatgccgcacaccgggtcggtggcggtttcgccgtccgcgggggcggtgtggtgcatgtgcattcccatatccatagtgttctccttgttggttggattattggattggtcagatacgtgattggtttgattcagcgtggtgcgatcgtcgatgatgacggtcggctcgtgaggcgcgttggatgtggcggagccggtgatgtcggcggcgttggcggatacggccgatgcggctgattcgacatccgccgtgctgctgcccgagccagcggtgctatcggcagcacccacgttgatgttcgctccatgcagccggttcgcgttcagcaccaggcacactgagctcaacgccatcgccagacccgcgatcatcgggctcaacagccagccggtgaacgggtagagtacgccggcggccaccggaatgccgatgacgttgtagccgaacgcccaccccagattctcgcggatgttgcgcatcgtggcattggacaggttgatggtcttgatgacgccgcgcaagtcgccgctcatcaaggtcacgtccgccgactgcatcgccacgtccgtgccggtgccgatggcgatgccgagatccgcctgggccagcgcgggggcgtcgttgatgccgtcgcccaccatcgcaatcagagtgcgggattgcgcggccgtgcgggaggtgccgtacgcggacttggcggcggcctcgtcgcgttcgcgctgcagtttggcgatccagtaggccttgccgtccggcttgacctcgcagatcaccgtatcgatgccgacttcgcgggcgatgcgcccggctacctcggccttgtcgcccgacagcatcaccgtgcggatgccgcgtgcgcgcaacgccgcgatggcctcgcgcgagccttccttgactgtgtcctgctcgtagctcggcttgtcccagtcggcggccgcgtccaccacgccgcgcgtgatggtgccggtcttgtcgaacaccacggtgccgatgcggcgtgcttgctccaaagccttggcactggtgaccagcacgccgttggtggcgcccagacccagcgagaccgtcaccgacagcggcgtggccagtcccagcgcgcacgggcaggcgacgatcagcacgctgaccgcggtgaccagcgcgtgcgccagttgcggcgccggtcccagtgacacccagatggcgaacgtccagatggcgatgatcatcaccgccggcacgaaataccgggcgatcttatcggccagctgctgcaccggcgctttggtcgcctgggcgcgggccaccatcgccgcgatctgcgagagtaccgtgtccgcgccgacttgggtggcgcgcatcacgcagtcgcccttgagcagcacggtggccccggtcaccgggtcgcctgcggttttggagaccggcttggattcgccggtgatcatcgattcgtcgatacgcgcctcgccggccacgatgatgccgtccgtgggcacacgctcgccgttcttgacgatcagcaggtcgccggtgacgatggcgtcgatgtcggtgtccgtgaaatgcgccggattacgccattcgatgccgtccacattgtctgcggaagtggcgttgagcttgtgcgcggtgcgcgggcgcagtttgataagcgactgcaccgccttgccggtgccttcgcgggccttggtctccagcaggcggccgaccagcaccagggtgatgaccacgccgaccgattcgaaatacggctcgcgcgagccctccgggaacacccacggggcgatgcaggtcaccagcgaatacaggtaggcggccgaagtgcccagcgagaccagcgagttcatgtcgggggagcggtgcgccagcgcggggaagccgaccgtgtggatcggacgcccgcagtagaacatcaccggcgtgatgagaatggcctgcagccacgggttcaccatccaatgcggcaccagcgcgggattggccatatgcagcatggtgacggcgaataccggcaacgtcagtaccgcgcccacaatcaccagcttcgtcagcgccttgatctcattggcgcgttcagtcgcctctcgccgctcggcctccgccgcatccacaaccggagctccaacccgcaagtctgagggagagaccccctcggcttcggccgagccgtcagcacgcgggcgcagcccgtccttatccgcaccgtccttactctcctttccctcaaccctcaacaacccatgcaccatattcatgccgcatgcaaacggatattcgcccgccggcaacgccggtagttccacgtcggtggtggcgttgcccggcagcatggcgtcaagccccagatccgcgaacgccacatgcgaagtgcattcgccggtctcctgtcgatcgaaagtcagcgtaatcggcgtacccgtgcgcatgctgatcacggcgggggagtacccgcccttgacggtgattgttgcggattggcgttcgccagaggcgtccatggccccggccgtggctttctgcattccgaagaagaaccgcagtaccagccatgtcaatgcggccgccgctatcagcgccgtggcggccgagaagatgctgagctccataaccgttccttccccttgtttgttgtactgaacaacagtgtataccctatacccctagagggtatataatggggtgtgttcagctgacggataagtatcagggggtttgcgatgcatggttatgacgaagacaaggccaaggtcatcgcacgattgcgccgtatcgaaggacaggtgcgtgccatcacgcagatggtggaggatgacaaatactgcatcgatatcctgacgcagatttcggcgtcgaattcggcgctgaaatccgtggcgttattgctgctggacgatcatctcaaccattgcgtgcggcaggcgtcgattcagggcggcgaggtggccgatgaaaaacttgcggaggcttccgcggccattgcgcgtctcgtcaaatcgtgacgagttttaccgtcattcaccatcgatgacatactgggtaccatgtttgagcaaataggaaccgtgattatcgtcatcgtcgtgctagtggttggtgcagggcttggcctcttcgccggcttcgtgctaggccgtcataagggtcaggagatggctcgaggcgtcaaaagcgaggagctggaggaggccaagacctcgctggagaatgcgcgattcgagaacgctgagctcagtgctcgcaatgctgccgcgcaagctcagattgaaggcgtgaaccagcaattggctttcgccaagtcacaacttgcccaggcgcagcaggctgagcagattcgcattcagcaggaacgtgagcgtgcagctgcggaggcagaacggaagcgtcaggcggatgctcaggccgccgaggtcaagcgtgctgaacaggaagcacgtttgaaagaacagagcaaggtgctcgaggcgcttgcgccagtggccaagaatcttgataccttgcagaacaaggtcacgcagatcgaagagggccgcaagagggaaatgggcgcattgggagcccaactcaaggggctcaacgatcagcaggcccgtttggacaaggaaaccagttccctgtccgccgcgttgcgcaacaacaaggtgcgtggcgcgtggggcgaggcccagctcaagaacattgtcgagtccgccggattgctggaacatgtcgatttcgacacccaggtggtggtcacggatgccgatgggcgtacgttgcgcccggatatgatcgtgcatctgccgggaggcaagaccattccgattgatgccaaagtgccttatgccgattaccagcgtgcctgcgaaatcccggacaccgccagccccgaggatattgcccgccgcgatgatttgctgcggtcccatgccaaggcgttgcgcgagcatgtacgtgctctcggcgaaaaggcctattggaatgcctttgatgtagcacctgattttgtggtggccttcatccccaatgaggcactactgcaggccgcactcgaagccgatcccacactgatggatgatgcgttctctcgcaaagtggcgctcacctcgccggtcacgctgtgggccgtgctgaaatccgtggcctatgcctggcagcagcagtcgctcaccgatgacgccaagcagctgttcgatctgtcccgagaactgtacgaacggttctccacgctgggtgattatgccatcaaattgggcacccagattactaagacggtcagtgcctacaacaagttcgcgtccagtttggaacgccgtgtgttgcccaccgctcgcaagctgcaaaaaatcgaaccgaccaagatcatcgaggaagtaccgatcatcgaatcagataaaggcaatgtgagcgaactgtccgcccctgaagtggtgccggccgatgaaggtgatactcatctgactgcctcaggcgatagtctggagtcatgactgaatctggattccgccccactggtaccccggaccttgccgtcgcgaagagccataatgactttgccatgctggagccgcgtgaacagctagccaccttgctgaaggagcatgtggtgggccgtccgttctccgaacttgccgcggtgactttcgaccaccgtgccgccactgtcatgggccatgtactgattgacgctttggaagatgcgggctattcgattgatgacttcgatgctgttggtgccttgaccgcagcatctgtacccatggtgtctgccatgatccaggccgccgcctctcgtggcgaggacctagatggattcgtgatggacttcgtctacccgtccatcaagggcccctccatcgaaggccgccgtgtggtgctgttggatgcttggctgtccgaaaagtcgtacgtgcagacaagctcgctggtcaccctgcgcaacggcaatgagctgagcctcgactttggcatagtggagcagctgggtgccaaggtcgtggccatcgcctcgctggtcggtggcggtgccaaagacatcaatgtggtcaacccctccaccggcgacgagcaaacgctccccttcatccaggtcttcgacgaatccgaactgcggtaaatccacctttgacgtccctcacataaagtcagccgggctgagcagcgaagctgactaagaggaaccggtgaatagcgttatcgaggagaaagattgcacgcacccaaccagatttctttggctgccaaagcttcaggtgaaccggaattccgtgaaatcggccttgggccgtggtctgagacccatcccggtgagcctcgtcccgatgatccgacttcttcgaattatgacggtcgtttcgactcggtgctgttgaacgacggagaccgccgcaacgtattggaccgttaccgctactggaccgttgctgccattaaggccgatcttgacgctcgagggcgtcacgacttcgaagttgcggtggaaaactggacccacgattttaacatcggttccatggtccgcaccgctaatgccttccaggccaagcgcgtacacattgtcggtccacataagtggaatcgcaagggcgcgttgatgaccgaactgtaccagcacgtcgaacaccacccctccatcgccgaactggtggaaagctggcatcatcgcatcgccggtgaaatcgcctatgaacgagccaaggccggtgccgccgccatccatgcgcatgatgtggctgtggatggagacaacaagcaccttcatgagctgctggccgaaatcgatgcttgtgatgcacgcatcaaggagcttcaagccgcccgcgtcatcgccctcgacattattcccggcgcagtgccgatggaagcctatgccttccccaagcggtgcctgctgctcttcggtgcagaaggccccggattgagcgagaaggccctcgcattggccgacgatgtggtctacatctctcaattcggttccgtgcgctccattaatgcaggcgctgcggcggccgtggccatgcacgcatggattgcccaacacgccgtatcaggcgtgtagccatgcgccgacaatcctgccgcatggatcggcggtctcatcgtcaccagaaaagcggatatcaaataatgacccgagtgcctgccctgctgaaatggtctcaaagggtaggaaaatgcggtttcccgacaactgcgtgtcacatacggctcatatagttatggccatgccaacattttcacgcgaagaaatcgtgcatttgggcgatctggcccgaatcgcgctcaccgatgaggaaatcacccgtctgcagggcgaactgaacgtcatcgcagactccatcaacaaggtccaggaagtcgcctccgacgatgtgccgccgaccgccaacccggttccgctggaagcctacctgcgcccggacgtcgccgaaaccccgctcacgcaggaagaggcgctcgccggtggcccgaagaccgaggccggcatgttcgtggcaccgcgaatcctgggaagcgaggagtaatcgatgagcaacgaaaccgcaactctcgtcaaactgtctgctgccgagcaggccgctgccgtcaagaagggcgacgtcacctctcgcgagctcgtcgaagcccacctcaaggtgatcgaggctgccgagccgtccatcaaggccttcctgaaggtttccggcgatgtggctctcgagcaggccgacgccttcgacgccaagtccgccgaagacaaggccgccctgcctgagctggctggtgtgccgatcgccatcaaggacatgatcgtcaccaagggcatcgaaaccaccgccgcctccaagatcctcgaaggctgggtgccgccgtacgacgccaccgtcatcgaaaagctcaaggccgccggcatgccgattctcggcaagaccaacctcgacgaattcgcccagggctcctccaccgagcactccgcctaccagaccacccacaacccgtgggataccgagcgcgtgcccggcggttccggtggtggctccgcctccgcagtcgccgcattcgaggcaccgatcgccctcggcaccgacactggtggctcgattcgccagcccggcgccctgaccggcaccgtgggcgtcaaacccacctacggcggcgtctcccgtttcggagccatcgccatggcctcctcgctcgaccagatcggcccggtctcccgcaccgtgctcgactccgcactgctgcaggagatcatcggtggccacgacaagcgtgactccacctccatccccgaaggcccgcgcccgatggtcgccgccgcccgcgaaggcgccaagcgcgatctgaagggtatgaaggtcggcctcatcaaggaactcggcggcgacggcttccagcccggcgtcgaggcccgcttcaacgaggccgtcgacaagctcaaggagatgggtgccgaggtcgttgaggtctcggtcccgcacatcggctactcgctaggcgcttactacatcatcatgccgtccgaggtcagctccaacctggcccgttacgatggcatgcgctacggcctgcgcgtgatgccgccgaccggcgtgccgcagaccgccgccaacatgatggcctacacccgtgaagccggcttcggcgacgaggtcaagcgccgtatcatcctcggcacctacgccctgtccgccggctactacgacgcctggtacggctcggcccagaaggtccgcacgctgattatcgaagacttcaagaaggccttcgaacaggtcgacgtgctcgtggcccccaccagcccgtccaccgccttcaagttcggcgagaagatggacgacccgctggccatgtacatgaacgacatcgccaccattccggccaacctcgccggcgtgcctgccatgtccatcccggccggcctgtccgacgacggcctgcccgtcggcttccagttcatcgccccgcagcagcgcgacgaagtcatgtacaagccggccgcggccctcgaagccgcgctggaagacagctggaacggcccgatctggaacgacctcaagaccccgtggcttgacggtctgggcaagtgagcatcggaaggaaagaaacaacatcatggctgaaaaactgatgaagtacgccgatgccaccaagaagtacgatgtggtcttcggtctggaaacccacgtggagctgtccacgaacaccaagctgttctgcccggcccacatcgagttcggtggcgagccgaacaccgagctgaccccggtgagccttggcctgccgggctctctgccggtgatcaacaagaccgccgtcgattacgccatcaagctgggtctggccctgcactgcgaaatcgccgagtggagccagttcgcccgtaagaactacttctacccggacatgccgcgcgactaccagatctcgcagtacgacaagcccaccaacggcaacggctacctggacgtcgagctggaagacggcaccgtgttccgcgtgccgatcgagcgcgcgcacatcgaggacgacgccggcaagaacacccacgtgggtggcgccgacggccgtatcgaaggtgccgaccactcgctggtcgactacaaccgtgccggtgtgccgctgattgagatcgtcaccaagccgatcgagggggcgggcgaccgcgctcccgaaatcgccggtgcctatgtgcgcgccatccgcgacatcgtgcgcgcgttgaacatctcccacgctcgtatggagcagggcaacatgcgcgctgacgtgaacgtctcgttgcgcccgagcccggacgctccgtacggcacccgttccgagaccaagaatgtgaactcgttccgcggcatcgagaagaccatccagtacgagattcgccgtcaggccgctcgtctggacgacggcaaggagattctgcaggagacccgccactgggatgaggctacgcagaccaccgctggcggccgtctgaagtccgatgccgacgactaccgctacttcccggaccccgacctcgtcatgctccacatcaccaaggagcacatcgaggagatgaaggcccagatgccggaaatgccgcgcgagcgccgcaaccgcctcaagtccgagtggggcctgagtgatctgcagatgcgcgacatcctcaacgccgacgccctcgacctgattgaggaaaccgtcaaggccggtgccaaggctgccggtgcccgcaagtggtggctgggcgagctttcccgcgaagccaacgccaagggtatgtccctcgaagagctgccgatcaccccggccgatgtggccgaggtcgagaagctcatcgcctccggcaagctcaacgacaagctcgccaagcagaccgtcgaaggcgtgcttaagggcgaaggcactccggatgaagtcgtcaagaagcacgactacaagatcgtcgaagacaacggtgccatcgaggcggccgtcgacgcggcgttcgaagccaacccggacgttgtcgagaagctcaagagcggcaacatgaagccgatgggtgtaatcatcggtgccgtgatgaaggccacgcgcggtcaggccgacgccaaggccgtcaccaaggtcgtcatgggcaagatcaagggctgattagattcactggctcccgctggtgggagctgtcgaacggagtgagactgagggtggtcgccatgtacggatgaccaccctcagtccgcttcgcggacagctcccgccagcgggagcacttatttgtagggaaattctccagttcaaatccgttagacagctcccgccagcgggagcctttattgattctgtaagaaagtcgactcagagcatttccagcgttcacccagtcgagtaagatatgttcggcactggaccgtgagccgaaacaagccgaaccgggggacgtataccgatgaccgcaaccaacgagacgctgagcatggctaccgaagcgcaactgaagcgcgatctgccacagagcatcgtcattccgccaatccgtggcgaaatggtgcacctgcgccccgccaccgtcgaggacctgcctcgtttggatgaacttgatgccttctatggcgcatccaagatcacaggtaaggatgcggtcaccgaacgcgccatcgtacacacgtgggtccgccgctcccaggcttgggaagccggtcaggcacccgccgaatccggtgtgggtgatccggaatcccgccgcaccatcgcatgggccgtattgactgacgccgaccatgacgatgacggtcagctcgatgcggccagcaccgataatgtcatcggcatgattttccttatcgacatcgacggctggtccaagtccgcccgcatccagatcatcttgggccgtgaataccgtggccgcggctactcccgtgacgccatgccgcgtgtgatgacctacggtttcgcgcccgaaccggccggcttgggcatgcaccgcatctgggtgagcgtgccggaaaagaacagccgctcgatttcggtctaccagtcgctcggcttcgtgccgtccggcacctcgcgcgacgcgttgtgggatgccgaaaacaacaaataccaggaccttatcgtcatggacacgttggctgacgagtacgatccgattcgttcgcttgacgcttttggcatgcacttgattgaggacaacccgggtgtcaaggaagcgctgtccgcgcgcgagcattccatcgccatccagcagaacaagccggaacccgagccggcacagcgtggtgaggcagccggcgccacgacgagtgacgtgcagtcccaggcccagacgccggcggccgcacagccagtcgaaccacaggccgagcaccacgacgatacgcagaagaacgcgcgccacagtctcgaagaggaaagcaactggccgtacggtcaggcagaacgcaagccctcaaaggaagcatggtggcgtacgctgggccgcggccgcaaacgcgatacggaaagtgagtgagtaaacaagcatgagtgccgaggatctcgacaattacgaaaccgacgccgaactcgcgctgtatagggaataccgtgacgtcatcaagctgttcacctatgtggtggagactgagcgtcgcttctacttggcgaataaggtcgatttcaacgtgcgttccgctggtcaggacgtgtatttcgatgtgcagctgactgacgcatgggtatgggatgtctaccgttccagccgtttcgtcaagtccgtgcgcatcgtgaccttcaaggacgtgaacgtcgaagaagtccagaaaaccgatatcgacattcccgacgatattcactgacaggcaatcgtctgatacagcctgtattgacaatgcgcggcattccgtcatcttacggcggggcgtcgcgcattgttcatacaacgcatagcaaaagttcagactcgtaaccttgccatcgtgtgtcttgtttgcttgcggctgatagaaaatgctgcatgaacacacaccatatgcagcagggccttaagggctccatcgcgggcgtggttgctgccgccacattgctggccggtggcatcctgaccgttccgcacgccatggctttggagaccgatggccagtattacagcagcaagcagccatatgtggcacctagcgaagcgaccactgccagctatagccaggcgccggaaggctacgaaacggtatacaccgagtcgatggctcgccacggttcacgcggcctgtccagctacaaatacgacgcattgcttatgaagatggccgaagccgccgaagcggataacggttttaagtctgatgccatcaagtccgaattcatgaagaatctcaaagccatcaccgccgcaaatgtggagaatggctacggtatgctcaccggtcagggtgctgaccaacatcagggcattggcgcacgtgcctacgagcgcaacaagacgctgttcgacaacgcagccaaggacggtggcaagattgcctatcagtcctctggcgaagcccgcgctactgaatcaggcgagaattttgctcgcggtttcaacgcggcctcgaacaataaactggcgaacagcactgtgacgcccgccgatccggccggcaccggcgaggcggcggctttcgacaagacgccgaacacgctgtacttccacaagtccgaaaacccggacggcactgagaaaaccggtgaggccaagcagcgtgccgacgattaccagaacttcgtggaaaacgatgcgattatcgcaggcgctgagcaaaccatcgccgaaaacgaggacgtgaaaacagcctctcacgatttgctttcacaaatcttcaccgatgacttcctcgccaaactggccgacggcacgtacgcctggtacaacactgtcgatggcaccaagggcggcgaggccaactgcgcgccgggagccgaccccagcaaggatgccgacgcctgcggcgcagccaagaagaagatcgcctccgaatacgatgccgcgatggatctgtacaacctgtacatcatcgccgctgatatggagaacgagaacaccggcagccataccttcgacttcaaccagtacttccaaggtgagcaggcagacgacgccaagttgttcgcctgggcgcttgacgccgaggacttctacgagaagggcccgagctacgccggccaagacgagacctacacaatcgcacagccgctgcttgacgatttcttctcgtcgattgatgagcgcgtaaacggcggatccaccgttgctactttccgctttgcccatgccgaaacgatgatgccgttcgccgcgctgcttggccttcccggttccatccagcaggcggccgccagcaccaccgacgtgtacacctacgccaacaatgaatggcgcggtgaatcggtgactccgatggccgctaatgtgcagtgggatgttgccgtcaaatccggcaacgacccgaagaccggccgtgcctacacgccgctcgttcgtatgctctacaacgagcaggaaatcgccttccgctccgaatgcacgccgattgccgatggttccacgtggtacaagctcactgagcttaaaagttgcttggcctccgaccaccaaaccctaggcgacgatgcgcatctgactgatgattccacaacgcagccgggcacaggacctaacactggtgaaggaacgagtaccactccgaataacaatggtgcgggaactcatcagcccagcaacactcaggctaatggtacggaaaacgagttgagtcgtactggtgttgccgttactggtgttgcggggattatgatgctgcttgcacttgcaggcatctcgctgaatctatggaaagttcgtcgctgacgaattagcctaagaccaaaccgattcgccgcgctgtgtgtgacgcaacgttgccgaatacccctacctcacgattcgatgcgtcgcctttctgctgatggaaagacggcgcatcggtcgtatatcgggagaattctgtaagcattcgctcatctttcggtgtgcgattccggggcttctagtagactgtctctgattttgcgtttataaggagcataatgaccgacaagcaatccgtagtgattatcggcggcggtccggctggacttaccgccgcgtgggaactcatcaaggacggcggtgccgacaagtacgacgtgaccgtgctggaggggacccgcgaattcggcggtatctcgcgcaccgtgaagcacaacggcaaccgcatggatatcggcggccaccgtttcttctccaaagacgaacgcatcatggattggtggaagaccgttctgccgttgcagggcgcaccctcctatgatgacaagaagctcggccgcgaccacgacatggagccgggcggccccgatccggagacggaggacaaggtgatgctcaagcgccaccgagtgtcccgtatcttctggaaccgccacttcttcgattacccgatttcgctgagccccaacacgttgaaggccatgggcttcaagctcaccatggtggccggcttcagctacctgaagtccatgttccacaagctgccggaagacaatctggagaacttctacatcaaccgtttcggccgcaagctgtattcgatgttcttcgagggctacacggagaagctgtggggccgccacccctcccagatctccgccgactggggcgcccagcgcgtcaagggcctgtccatcatgggcgtgctcaagaacgccttccagaagctgctgcccaagaagcgctccaacgcggaggtcgagacctcgctgatcgaggagttctggtatccgaagtacggtcccggccagctgtgggagaccgtcgagtccaattgcgaggccgccggcgtcaaggtgctgaccgacgccagggtggtcgaggtccgccagaccgatggtgccgtgtcttccgtggtgtacgaggattccgagggcaaccgcaccgagctttccggcgaccagttcatctcctcgatgccggtcaaggacctggtcaacgccatcgacgcggccggcgccgatcccgaggccgttgattccaagcccgccccggccgatatgaccgaggtggccaacggcctgccgtaccgcgatttcgtgaccgtgggcctgctggtcaagcacctgaagctcaagaacaccaccagcatccccaccctcggcaatccgccgatcgtgccggactgctggatctacgtgcaggacccgggctacaaggtcggccgtctgcagatcttcaacaactggagcccgtacctggtcaaggacgtggacgacaccgtgtggatcggtctcgagtacttctgcgaggagggcgactcgttctggaacatgagcgaggaggatgtcaccaagttcgcgatttccgagctcacccgcatgcgtgtgatcaacggtccggacgaggtcatcgactcccatcgtgagcgcgtcaggaaggcgtaccccgcctacttcgacacctatgagcacatggacgagctcatcgagtacctcgacggcttcggcaacctgtactgcgtgggccgtaacggccagcaccgctacaacaacatggaccactccatggccaccgccatggaggccgtcggcaacatcaagaccggcaagacgtccaagaagaacgtgtggtccgtcaacaccgaaaagtcctaccacgaagaaaagtgaataaaccttgttgagctccctcgtcacagagggagcttttttggttttcggcgggccgttttgcgttggtcgagttggcgttgtacagtgaacgaagttcgcagagactcagagacgcagcgaacattcatgagcggtgcaaccgcaataatcactcttaacgcctggataggcatgggtctgttcggtatggaaagggcaaccagtggcaaatagccagaatcttgaggatatgaagctgcctgagctcaaagagctcgctaaacagatgggcctgcgcggcacgtcgaccatgcgcaagcccgagctgctcgccaccctgcaggcggcgcgcaatggtggagagccgccggccggtgtgaccgtgcgcgcccccaaggccgccaaaaccgccaaggtcgtcaaggctccgcagtccgatgccgctgaggccaacaccacagacaatgctgacgtggccacccagtcgccggctccggctccggctgccacggaaccgcagctcgatttgccgcttcccgtggccgacgatgccaagaaggacgagaccgaaccgcgacgcacccgtcgtaaggccgccgatgatgccgcatccgaaccgcgtgcggcccgccgtcgtcgcgatgacgaccagcccgatttcgctcgccgcaagccgcgcaagaaggccgatgaggccggcgatctgctggccacgctcgatttgggagatgcagcgcctaccgagcgtcgccgcgagcgtcacgaggacgtggaagttccgctgattcgccgagtccgtgatgatgaggacgagcagcctcgccgccgtcgtcgcactgcggaaaacagcgaagaaaccgtgcgtgacctcgacgatatcctggccacgctgcccacgcagaagcacgaggaaacgtccgaagacggcgagcagaacgacgatcacgagttcgtgcgtcgtaaccgccgcgaccgtagcgatcgcaacgatcgcgatacccgtaatgatcgcagcgatcgccgtaaccgtcgcatgcgtggccgtgatcgcgacaacgccgatgatgatcgtcgctatgatgatcgcgataatcgtagcgatcgcaatgaccgtgatagccgccgcgaagagccgcaggaggatctggtgccggtggccggcatcgtcgacgtgctcgactcctacgcttttgtgcgcacttccggctacctgcccggcccgaacgacgtgtacgtttccatgggccaggtcaagaagtacggcctgcgcaagggcgatgccgtgcatggttcgattcgcgccccgcgtgaaggcgaccgccgcaaccagcgccagaagttcgtgccgctgcaggccatcgattccatcaacggccaaagcgttgaagaagcgctcaaccgtccgcagttctccaagctcacgccgctgtacccgcaggagcgtttgaagcaggagaccgccccgaacaagctcaccggccgtatcatggacatcgtttccccaatcggcaagggccagcgtggcctgattgtctccccgccgaaggccggtaagaccatcaccctgcagaacatcgccaactccatcgccgccaacaaccccgaggtccaccttatggtggtgctcgtggacgagcgacccgaagaggtcaccgatatggagcgcacggtccagggcgaggtcatttcctccaccttcgaccgtccggcctccgatcacactacggttgccgaactggccgtcgaacgcgccaagcgtcttgtggagctcggccaggacgtggtcgtactgctcgattccatgacccgactggctcgcgcttacaacatcgcagcccctgcctccggccgcatcctgtccggtggtgtggacgcgcaggccctctacccgccgaagaagttcttcggtgcggcccgcaacatcgaaaacggcggctccctgaccatcatctcatctgcgctggtggaaaccggctccaagatggacgaggtgattttcgaggagttcaagggcaccggcaacatggaactgcgcctgtcccgcgagctggcggacaagcgactgttcccggccatcgacatcaacgcttccggcacccgccgcgaggagctcatcaccaacccgcaggaactgccgattatctaccgtctgcgtcgactgctgggcggcatggagcccgagcaggcctaccagacgctggtgccgcgcctcaagaagaccgccaccaaccgcgacttcctcgccgccatcgtgcagcaggccaacaccggcaacgcggtcaacggcaactgatcagaccgctgaacaatagtgtaagggctgcaccctgattgatacggggtgcagcccttgtcgtatctgatgcaaatacgtcaactatcacattgcagttgtagtattgccgtcaacgttcacatgcacgctgacgatatatgagatgaaagaggcatcactgggttcgattgttttgggagtgggcagtggtgcggccatgttcggcgatgcggatgccagccatatcctcaccggcgactatgacatctgagatatctgactttgcgcatcgtgcaaagccgtaatcgggagtatcctcgaatctatgagcgaaacgagcagcgactggcaaaggaccaccatcgactccgcccaggcggcggcccacccggaaaccgcacaagcggtggcgcgcatcaaagcgctgcgccaaaccatcgataacatcgattcggcggtcatcgcattactggccgagcggttcaaggccacctcgcaggtcggcgtgctcaaagccaacgccggattcgcgcccgaagacaccaagcgtgaggactatcagatcgaacgcctccaccgcatcgccatcgatgccgggcttgatccggaaattgccgaaatgtaccgtgaattcgtggttaccgaagccaagaagcgccaccagcgcatagccgatgccggtggtgacccgggcgtactcgacgtattcgcctgattcgcccgcagcgaatgggcacctttcggatattcgtctatagggcaagttgcctgcagcgactacattaatacgggaatggaatgcccgtagtggtcgactgtatgaatgggatacgtagatgagatgtggtgccgcactggtcagttgcgcattgtgcgtggcttcgattctcggcggtgcttggatgtctcgtccgactccggttgattacggtccggtgctcgctacggcaagtgatatgtacgccgtcaccgatgccgaaggggagccggtccgttggtatgtggtagggaagggcggcgccggcaatggcgccagtgccgattccggcaatagcggttccactgataccgattccgccaatagtaattccggcacgtccaaggtttctcgtatccccgcttccgccgccaccctgccatggaaagtcagcgtcacctactcgcttgacggtccgaacgtcgaggcaaacgaggttgccggcgcgtctggactgatcggcgtgtatatcgatattaagccgcaaaccaaggaagccaaccgtacgatcccggttgtcgcctttaccgtgcctacgcaggtagccgatgatgtttccgctgacaactccattacggtgaccacgcaaggttccaataccgtagtcgccgcagctggaaaagccgcaaccggcttggaattcagctgctatatgaacgccaaagacttctccatgagttccgtggcgctcgccgtattgccttccaattccagcagtccggcagttggtgctaatcccgatgccgcgaatgctgcgaatgctgccgcacagcctgctgccgatacggatgtcgcccaactcgtcgcctctgccgccatactggtcgattcactgaccgacgccggttccggggagcatcaacagctcatcgagcagcttcaaaccctgcgcgataatgagcgtgcgctggacaagtccgtagtggccgaacgcgaaaccgcccataagcggacgtttgaagactatatggccgcgtatgtgggctcatataccacgcacctgtctggatcgattggtacctccacccagttgccggcgttgatgggcacggccggcgaactgtccggggatacgcctttggcacaagccgtactcgacttggccaacgcggtgaacaacgtcagtgccgcacatcagcatgccggtgcggtcgatgcgttggatgaggtgattcgccgcatccagcagcaaggcaccaccggactggtggatgatctgaccgccgaggcttcggaggaagccactcgaggctccaagcaatacgccgatggccagagccagctctccgccgcaatgattccgtattcgatgaaatacacggacgtctacacggccaatttgagcgccctgaccggcggcacgtcttcgggcgccaccgcttacgagagccaagccatcgccgaaaccaacggtagcgatgaactcgccgacgctcaatccaaggtcgatgccgcgatgagcacgcttgccaccgcctccgagcatacgggcaaagccacggccttgcgccagattgtattgcgattctccgatcagttcgaaggagtcgcgtcctcggcttccggcagcgatggcgatggctcgtccggtgatgtctcttccggtccggtgaccgaggctcaggcactgactggcctggtcgattcgcaatcgcaatcgttctacggcaagacccgggccgtccaagccaagcgtaaggccgatgccgcccgtaagcaggccaaagccgcgcaacagcagcagtcgcagcattccaaggcctcactggtcgatgacaccatgtccatgtctgctggcgatgtgatgaactatgcgggtggtcttacttcggccatcggtggtggaggtaagttcgattcgtccaagagcgatggttcgggaacgaacgactcagccaagtcgagcgatactggcgattccggcaacaatcttgacaccgctccagtactgttcggctttggcactggcggcacgctgttcaagcacgatatgaacgcgctgattaatgagaccgtgaaaatcagtgatgctggcacgctcttggcgcaggccgtcgcgcagctcgacagccccaatacgcaacaaaaaaccgccgaaacccgatatctcatcgtgattccgacggtgtgatggtgtatgcgggatatttgcgtgccgtcccacagtcgtgtcatccgaacgtcaaaaaacaaaagaggggaacctcaataggttcccctcttttgttgttgtgcgtaacgttcagtgctttggcttcttagctggccgagccgttaagcgggaagcccggtgggcttcccgtaggctcggaacgagcggcattgccgtgagacctactgttgttgtgcgtaacgttcagtgctttggcttcttagctggcggctcaccgagctcgctggcttcgacggcgacctcggtttcgggcgtgccttcggcggcggattcctcggcgtgcttggccaccaagtcgaacttgccgaccacgcgaccggcctgcgcgatatcgcccaaggcggcgtgaatcgcttccacaccttccgaagcagcggacagtgccacagacaggattggggtcttcatggagaccttggcctcggacttgatcttacgcagctgctccacggccttgccggcccaagtcagcagctcgggggaagcaccggtggcggcctcgacatacgggtccacgaccggccaggcggcgcgatgcacggaaccggaaccggcgtgcatccagctccacacttcctcggtggcgtacggcaggtacggggccagcagacgtgcgaaggcgtccaggcccagacccagagcggtgcgggcggacttcacagccttctcggacggcacattgccgtgctcgtccggagtgccataggcgcggttcttgaccagctcgatgtagtcgtcgcagaactgccagaagtaggactcgatgacttccagcgccttggaatgctcgtaggattccagcgcctcggtggcctgacgcaccaccaaagccagcttggccatagcggcgcgatccagcggttcggtcacatcggccgggttccacgcggcctcggcggcagcgcccacgtgatggttctcgtcctcacggccgatggccagcgcgaacttggtggcgttcagcagcttgatggccagtcgacggccaatcttcatctggccgatgtcgtacgtggcatcgaggcctaggcgagcggcggcggcccagtaacgcacggcgtccgcgccgaacttctcgatcggctcgttcggcaccacgacgttgcccttggacttcgacatcttcttgtggtcggggtccagaatccagccggacagcgtggcatgggcccacggcaggcacttgttctccaagtgcgcgcggtccacagtcgagaacagccaggtgcggatgatgtcctgaccctgcgggcgcaggtccatcgggaaggtggaagcgaacagggccttggaggcctcgtccggctcggcccagtgggtcacgatctgcggggtcagcgaagaggtggcccaggtgtccatgatgtccttttcggcggtgaaaccaccgggcacatcacgctgggactcgtcgtagccctccggcacgtcgatggtcgggtcgatcggcagacgatcctcggacggagtgatcgggtgatcgtaatccggctcgccggaagcgttcaccgggtaccacagcgggaacgggacgccgaagaagcgctgacgggagatcagccagtcgccgttcaggccgtgcacccagttctcataacgcacgcgcatgaagtcggggtggaactcgagttccttgccgcgctcgataagctcggcgttcagcttggcgtcggtaccgccgttcttcaaataccactggcgggaggtgacgatctcgagcggcttgtcgcccttctcgtagaagttcgtcatacgcttggtcggggtcggctcgccgtccagatcgccggactcgcgcagcttgtcgacgatgatcttgcgggcggagaacgtggtcttgccagcggtttcggcaaagacctcgcggccggccgggtcctcgatccagtccggggtatccatcacgatacggccgttgcgctggatgatcgggcgggtgggcagcttcaggtcgcgccaccactcgacgtcggttacatcaccgaacgtacagcacatggcgataccggcacccttgtccatttcggcggccgggtgcgccagaatcggcaccttgaccttgaacagaggggagtagacgtactggccgaagtactgcttgtagcgttcgtcgttcgggttggcgatcagcgaggtgcaggccgccagcagttcggggcgggtggtctcgatgtagatcggggtgccgtcctcaaagcggaaggccaccttgtggtagaagccggggtattcgcgcgattcgagctcggcctgggccacggcggtctggaaggtcacatcccacaggccgggggcgtcctgctggtaggcctcgccacgggcgaggttgcgcaggaaggccttctgggccacacgctgcgggtgctgaccgatggtgtggtaggtctgcgaccagtcgatggacagacccagcttgcgccacagggcctcaaacagcttctcatcctgagcagtcagacgctcgcacagctcgatgaagttcttgcgggaaatcggcacctgatccttggcgtcaatcttcttgccatcagtgccttcaaacggcggcttgaagtccgggtcgtaaggcagagacacgtccacgcgcacgccatagtagttctgcacgcggcgctcggtaggcaggccgttgtcatcccaacccatcgggtagaacacgtcgtagccgcgcatgcgcttgtagcgcgcaatcacatcggtgtgcgtgtaagagaacacgtgacccacgtgcagcgaaccggagacggtgggcggcggggtgtcgatggagtagacggccttgcggtcgcgggtgttgcggaatttgtaggtgccgtcttcatcccagacggtgcgccacttgtcctcaagtccgtccacgccgaccttgtcgggcagcggggtgaggttggcgttgatgatggatttgccttcagtcataaggccaaagtttatgcacgttgcatgacaagccgaactgtacagtaaacagcccagtaggctgttcgcaggcgaggtacgaacgatcgaacgatagtgagccaaggactatcgggcgtagcccgtccgtgactgaaggttgcctacttcaccgtcaacccggccagcggcatgcggcgattgatcatcgaggtcgggtagccggagaccttggtggacgccacagtgaagcatttgcgggtatacagccaatcactggccgcatcctcgctgatcagccgggcgtacgccttcattcgtgcctcataatcggcgtcattagtggcggcgcgagcatccgcataggcctgttgcgcttcggtatggtcgtaatggaacatggaatcggggtcggcgaatatgccggcatcatccgtgccgtccatgctcatcacggtcagttcccatttgccgtccttgattcgtttggcataatcctcatcggagagcacttcaaggttcaccgtggggcgcggctgccgctcgatctgctgcttgatggtttcggccaacgaccggtattcttcgggaaccaccagattcaccgtagtcaggtattgcgcaccaaagtaggagaacatctgcccagcttggttttcgtcatgcgggtacagtccggtcaaatcttcgtatccgggttccagcaggctgatggggccgcccaatgctccggctgcgtcgggttgggcggaggcgatgccggctgcgtcgatttgatagcggaaggctttacgcgcctgttcgtcggagagcagcgaatcggtgccgttgttgtaggccagcagcaccttatccgtagtggccccctccttgacggtcaggccatccttgccgttcaaaccggtggccgtcgaagccgaaaccggtgccgccatatcgagactgccgtcggtcagggccttgctgagcgcatcggcgtcggagtattgcataaattcaacgacattgctggccgctttggtgccatggtaggtatcgctgcgcgccagcttcagggaatggccaggctggaaatcggccacggtgaatggtccggaacctatggccttgcgttgataatcggcactggacgactcggaatcgtagacaatgccgagtctgccggacagcgctcgcagcagcgtcggattgggcttggcaagcgtaatgaccaccgtggtggcgttcggattggcgaccgacgccagatcgcccaattcgtcgacgtccgccaccttgttggtcacgttctgttgcaacgaccacacggcgtccgaggcgtccaacgtatggccgttcgagaaggtgacgcccgattgcagtgtcagggtgacggtcagtccgtcatcggaagtcttccagcttgtcgccagtcccggctgaagcttgttgtcttgatcgacggtcactaatgtctcatacacattgtcgacgagcaggcgttcggctgccgcagaggaatcggaccgaatatccaaggattgcggcatatcgtcgatgccaatggtcacatcggcatcgagggatgatcccggctggaaccggttttgcatgaacgtccatcccacaaccacgagtgcgccgagtgccacggcgactccgagaaaaatcccccacttggaccatgtattgtcccgcttgctgtgctgcatggttttcagtctagcggtggattcagcctagaatccgcaattcaccatgatgaggtatgagttagcgcttggacgtgctcttgccggcgggcggcgcatagctagggcaggtgtcggacagcgggcagttggcgcagtcaggggtacgtgcgtggcaggtggcccggccgaacagaatcagtcggtggctgagattcgtccactcttcgggcggaaaacaggaggtgatttccttctcgattttcacgggatcggggtgtgcggaccgccaatccgaccgccaacgcagtcgtccggttacgcgcatcacatgcgtatcgaccgggaatccggggatatcgaacgcgttgccgagcacgacgttcgcggttttgcggccgacccccggcaagctggtcagttcatccatcgtgcgcggcaccacgccgccgaatcgttcgtccagtgccgtggccagtccgatgagatgctgggttttcgaacgatagaaccccagcggatgaatgatgtcttcgacttgggccgggtttgcggccgccaagtcacgggcggtggggtaggtggcgaacagttccggggtgaccgtgttgacacgcttgtcggtggtctgggcgctgagcacggtggcgatcagcaattcgagcggattcgagaaatgcagtgcgcaagcgggtgccggaatcacctggcgcagaatgtcgtattcgtcatgcatgcgcgtgagacgcgcggatttggtttctctcatcgtatggacctaagcggcgtaatatcgatgattgatagtttgcagcgccgctggtctgtcaggcgacggtgttgagatcgggagtatcgtcatcggtgtcgatggcggcagaggatgctttggcggcctgctgtgcggcggcagtttccttatccgtctccggcgggtcgaatcggtagcccacgttgcgcacggtgccgatgaggtgttcgtattcgccgccgagcttggcgcgcagacgacggatatgcacgtcgaccgtacgagtgccaccgtagtagtcgtagccccatacttcctgcagcaactgggcgcgcgtgaacacgcggccggggtgctggaccaagtacttgaggagttcgaactccttgtatgccagatcgatggggcgtccatgcagggaggcggtatagccgttggtgtccacaatgaggtcgccggagcgaatctggccatcttccaccgtggtggtggattcggcgggagaaccggctgctgcggctgcgggagcgttgccgcgctcggagaccaatcgcaatcggccctcgacttcggccggggaagcggtggcgaccaccacatccgcaatgccccactgggagttgaccacggtgaagccgccttcggtcagcaccagcacgattggcgtggacaggccggaagcgtggatgaggcggcacaaggttttggcggtcgccagatcatcgcgtgcatccagaaacagaatggtgttctccggcatcttcaccaagctggctgcatccatcggcagtacgcggacgcgatgagaaagcagggcgagtgatggcaaaacggtggcggggtcgctggcgaaagtcatcaacgtaagatccgtcacgctaatcccccttatcctgcaatgtgttacgcaattgctcggtgtggctgtacgagtcgtcagcggcgttatgccgctttcgcacggttttcattattctacgcgcttgtagtggacacataggttacaagtttgcggaatatggaacggtggacgtccatcaaccgatgatacggccgagcaccagtgcggttgcggcgatggtcacgcccatcagcattaccggcatcaggccggtaccgatccacggatagcggatatccgggtccggatcggcgtcacgcacccacaacgtggaagccacggccaaagccagtcccaaaacgatgaggatgatcagggcaacggttcccgcaacggtgcccttggcgagcatcgcgcccaaatcaggtaggaagcaccagccggccacggcgagagctgccacaccggaagtcacggcgtgagagagtgcgcggataagatgttcgcgcttctcacgagccatctggcgtccgaaggagaagaccaccagcaccaccagcagcaggcccatggccagtgcccatgaataccaaggaagtaccgagccatccgcagcggtctgatccggcggaacctcgctggtcgggaaaggtacgatgacgaaaatcagagaaatcgcgccaaacaccaaagtgacgatacgatccagtatgctgccgcggaacggccagaatacgacaaatgcggccaacgtcagagcggcgataatcaaagggatgatggggacggtgccaggggagggaatgaccgtggctgcgatgaacagtacataggacgtcagttgggccaacaacatgctcagagctttgttcttccaaccctcctgggtgatctcggtcatgatacgcctctcagataatcgaatttctatcccaatcctacgtcgggcattggaacggtgaaatcaaacaaaatagccccttctggtgaaggggcttatggcactaaatcagaacgcgataacgcccaaatgctccaatagcactttgatgccgagtagaatcagcaccacgccgccggcgatctgcgccggcttctgccagcgggaaccgaacgcgcggccaatgtgcaggcccgcagcggagaacagtccggtgaccacaccgatgctgaggatggcgaatgccatatgggctttggtgaacatgaaggccaggctcacgcccacggcgaacgcatcgatgctgcaggccacggccaggggaagcatatgcttccaatcgaactgggcggtctccttggagttttcctcatcttcttcgaaggcttcgtgaaccatgttgccgccgatgaacaccaacagggcgaagatgatccaatggtcgaattgggttacgtatttgctgaatgtagatgccgcgaaatagccgagaatagggaacagcatctggaatccgccgaaccagagggtgcttttcacggcgtcttgtactcgtacgcgggatacggtcaggcctttgccaatggatacggcgaatgcatccatagctacggaaacagaaataagcaggatttgaatgattatcgaaatcatggtgtgacagaaggttcatcgccggattaccgtgcgatgggcctcgaccagcgttcctacacgccgcctacgcctagttgaaaagacaaaacattactgtatcacaaaatacaagctccctctgttggggagctggcgcagtgaaactgcgactgagggagagtagagcggctttgccacaaatacaacaaaaggcccccgaaggggcctcctgtcaacgattcagaatcgaatcacttctcggaatcggcgagacgctgacgcgcggcaatgatttccttttcggcggcgtcagcaccagtccagtagtcgcccggcaggacttccttgcccggctccagagccttgtactgctcgaagaagtgcttgatttcggccttgtggtactcgttgacgtcgtcgatgtccttgatgtcatcgaaacgaacgtcggcgggcacgcacagcaccttgtcgtcgccgccggcctcgtcgaccatgtggtacaggcccacggcgcggcactcgaccacgcagcccgggaacacggagttcggaatcatcacgagagcgtccagcggatcgccgtcctcgcccagggtgccgtcgatgtagccgtagtcatccgggtaacccattgcggtgaacagggtacggtccaggaagacgcgaccggtctcgtgatcgacttcgtacttgttcttggagccgcgcggaatttccacaacgacgttgaaggtttctgccatgtcatttctccttgaaaatcgacagttacgttatcgtctcaccacaataccctgtttacgcctgcaaaacaggtgcggaactcaagaaaccgtgctgagattatgccgacactatgcccaaacagacgaaatcctccccttgaggggaggatttctagcggtttacgcgcacgataaacccatgcacgtcaacggcatcactgttgcattaccgttgcagtaccgcatcactgcacggacaggatgtgggccacatccgcccaaggagccagagacacgtagttgtcccaaccccactggaattcgcggccggtcagctcgtcgcgcacgttgagcgggcggtcggtgggcagacccagctcgctgagttccaggtgaatcatcgactggtgtgcgttgtgtccatcgaggttcacgaccacaatcagcgtgtccgcttggccggtaccggtcagttcggccggcgtgtggcgtgcgaaagccagaatattcgggtcggacgtaggcagcacggtgaggttgtggtagctcaacgcggccgggtgggcgcgacgaatcttgttgagtgcggtgagcatctcggccacgccgtactgcttggccttgctccaatcgcgaaccttgacctcgtacttctcgttgtcgatctgctcttcgaagccggggcgctgcttgttctcgatgagttcgtaaccgttgtagataccccaggacggcgagcccatggctgccagcaccgcacgcacgcagtggccggctacgccgttgtctcgcacgtaagcggtgagaatatccggcgtggtgggccagaaggtgttgtgctggtagtagccgtcgtcgccattggtgaccggcagatactcttccagttcgtccttggtgttgcgccacgggaagtagcagtgggactgggtgaagcccacgtagctcagggcgcgcatcatgcccgggcgggtgaatgcctcggccaggaacaggatctccgggtgcttcttggtcacggcggcaatcacgtcctgccagaaacgcaccggcttggtgtgcgggttatcgatgcggaagatggtgacgcccgcctcgatccacagattcatgatgcgttcgacttctttttcgatgccgggcatgtcggcgttgaagtcgatcgggtagatgtcctgatacttcttcggcgggttctcggcgaaggcgatggagccgtccggcttgtggcggaaccagttcgggtgggccttgacccacgggtgatcgggcgagcactgcagggcgaaatcaagcgcgatttccagacccagttcatgtgcacgctggcacagggccttgaaatcgtccatggtgccgagcagtggatccacggtgtcgtggccacctagctcggagccgatgccgaacggggagcccgggtcatcggggccggcgaccagcgtgttgttgcggcccttgcggttggtcacgccaatcgggaagaccggcggcaggtagacgatgtcgaagccctcggcagcggcgcgttcgaggccggccatcgaagtcttcagcgtaccctgaatgatcttgccggtgttcggatcgatggtggcgccttcggaacgcgggaagaactggtaccaagccgcgaagctggactttgggcgttccaccttgaagcgctggggctggctgggggagatgccgtcgcgcagcgggtgagtctcgtgcagggcggcgatggtcgggttgtcgccggcggcgagacgatcctcggcgctcagcgtctgatcggccatggtctcagcggccttctccaaggtcttgcgatcgcgtgcggtcaggccggtgtccggggtttcggcccaacgggccagcaactcggcaccggaattgagtgcgttgtccacgtcgtccatcacacgcaccttgatgcgggcgtcgtgcagccaggagacgtacgcgtcttcccaaccttcgatggtcacggtccattcgccgagctgacgcttgacggccgcgtagctatcctcccaaggcttcagatcgctgtgctcgccgcacttgaccatcacggtccaacgatcgaggccgggatttacgcaggtcatggcccggcgcatggtttccttgccgcgcgggttgcgcacgatggcggtggcacccaccttggtacggccttcgatgaacacctgggcggtcatctcaaacggttcgccgagttccacacgggcggggaagatgccgcgctcctcggcgggagtgatgtccatgacattgatgcggccgaactggccgggctcgtttgcttcgatggacggtgcgggggcttcgacagccaggcctttcagcgctgctgcggcgcgtgccgtttcggcgctgactctcttgcgcttggttgcggggctctttcgggcagaagtcgcctttgacttcgttttcgtggtgctgttatcggtattactagtgcgcgtggtcgcgcgatgttgtactgctgccataaggccctattctaagggcttttgaacatatgttgcgcattgtggataactatcaggtaaacgttcggtcaaccgcatgaggtggataactcggcggaagagttatccacaactcgccggcaaacggcaagctcggaccacataggtcgaaaaaccggctgtagcgaatgaaaatctgccatgatcgtggcctacccgcacacagtgcagtatgcggggaaacgtaccaggaaaggacgaatgatgataacgacatggcggcaacggggcatggccatcgtagcgatgctgaccggtctgataataatggtgggagtggtgttcggctcggcgaatacggcgtatgccgcgacgttgacgcccgccgacgaaagatatcacgtggcgtttccatacaacgatatggaatattacgtcggtgtcgcggggctggacgcttcgggcaacaagtactactgcatcgaagcggggaaactgagcgactatgtgataggccccaccacggtgcttgcctccgatgagaacgcccggcgtatggcatggatccttgaccggtaccgcgacacggatgccgccacccatgcggcgatcggcatcatcgtgcaggatcacttcgggcgcgatcgggacgagtgggcgagacagatggcggtcattcaaggccggtaccccgagatcgtggcgaaggcggcccggatatgggatcaatcggccggcaagacgcctgcgggcacgacggtggaacgcaccgatgccgaggctttgcgcagcggttccatctcggtgaaagtggtgaaccgcgccggtgacgcgatcgcgggagtgccgttcaccgtcaccttgcagggggcggcgcggttcgtccaaggcggcaacacgttctcgggggtgtcgacgagcgccgggtcctcgatcgcgtgggaggcgaccggcgccggcgaggtgacggcgaacaccacatacgagtatgggcggatgcacgtcatggacagcactcaggacatgctggcctttgactcgatggcttccactggcggcgcgtcgacgacatttcgggtgcgtaaggattttgttccggcggtatccaccaaggtctccgagaaggtgcttgatgtggcttctccggtgttcgatgacgtgaccagtggcgtggcggatgcggacagttattgggtgcccgatttggaattgcaggcccgcggatactatttcgatggtcttgatacgggcgatgtgggcaatgtcattacgccgaatgcacaagagagcgccgatgcttttcttgcgcgattggcgactttgggttatgagccggtggcctatggcaaggcctctttcaccggggtggggcagcaggcacgtgtgcaggccatgaccaagccggatgacggtgccgcttaccggaccaagcagaatagcggttttggcacatgggtatgggtgtttcggcggtccgagcagagcaaacaggcgcaggaataccttataggcgactggataagtccgtttatggaggctacggaaagcaatacaagtcgcaggaagctagaagtcatgtcgacggtcactgagcattcggcggatatcggtgccgagctcagcgacaccattaccgtatcgggattccctgcggatcatggccagtatgccggcaacgaagagtatgagttcgcggcggatcggccgtatgcgacggtgagcgtatggtggtccggcgatcccgacaacccctccaacgatgaggcgtacaagccatccgggggagaggttcccacggaagacgacaaccaccggttgctggccacctgggagattcccgcgatgaacggcacgttcaaaatcggcgccggggcgttggacgcgcatggcgctcctatgtatctgaccgccgaacggcctgggtggtacgtgttcgtctggcggttcgagggggatgaccgtgtttccccggcgtccagccggtatgacgatgcctgggagcgtgtgcgggtgttgcccccatgcgagtcggagaaaccgtgcgaaccggagaaacccgagacgccgccggcgccggcggaggcaaccacgcccaaccctcgcccgtcactgcccgtcacgggtggcgatgtgtcgcttgcctcggttctggccgtgtcagctctggcgataggcgccatactgtccatcgtcgttcggtggcgtcgtcgctatgaccgattcaagcactggacgatgcgctggccgatacgttgacccgctgcggcatgatgccgatgatgtcggctggatggtgaaccacactccgcttctgagcagaagaacgggagctgggcacgaagtcgatcgtaacatacgacttgtgcccggcttccgcttcgttgagaaacttcacgcctgtcgcctcccgtggattagacaactgaagatccgcgatgaaaatgacgagacgtttatgatcgccgacttccctgggcaccgtagctgcctgatcgcctttcatccatatcgccacggtaaacggaaaggccgctgatttcggtaccgaaatcagcggccatataaccacgttcgtagcggggcatggatttgaaccatggacctctgggttatgagcccagcgagctaccgagctgctccaccccgcgtcggcttgtctctcagacagctctatctacaataggtgcagattccagaaagtcaacatcggcgtgtcgcgtcatcttcccgcggttttaaaacgtgaattggctcacgcagcgaggggtttggggcggagtcggagtcggggtaataacgcgccataaatggccgttataggaatgccctgaaccgttatcccgaatattgacataataggaacatgcctatcaagatccccagtggcctgccggccagagatatcctcgattcggagcgcatcttcgctctggagaagcccgaggcggagcgtcagcgcgtccgcccgctcaaactggtgatcctgaacttgatgcctaagaaaatcgagactgaaacacagctgctgcgtctgatttccaagtcgccgctgcaggtcgaaatcgacttcatgaagacctccacgcatgaggccacgcacgtttccgccgatcatctcgtcaagttctacgaaaacctcgatgcgttcaaagacaactattacgacggttttgtggtcaccggcgcgcctgtagagcatatgccgttcgaagatgtggactactgggacgagttcaagacgattctcgactgggcctccacccatgtgttctccaccatatacctgtgctggggtgcgatgggcgcactgtactaccgctacggcatccacaaggtggattaccccgagaagattttcggcgtattcccgcagtacctgcaggatgaatactgcttcctgaccaatggcttcgacgagattgatctgcagccgcactcccgcctcgccggcgtgaacgaaaacgaggtacgtgccaaccatgaccttcagatcttgacttgggggccgcagtccggcccgggcctgatcgccacgcgtgacttctccgaagtgttcgcgctcggccattgggagtacggcaagtacacgctcgccgaagaatacgagcgcgatatggccaagggcatgaccaacgtgcccttcccgaagaactacttcccgcatgacgatccgaagctggaaccgttgttcgcctggcgcgcccacgccaatctgctgtggcgcaactggctcaactgggtgtaccagaccacgccgtatgacctgaccgaggtgccgcagctcagggctgagaagaagctcggtactgatcgttcgattcggcatgagccgggcgggccgcgccaggatgatttcaagccgtttgtgcatgacgggtatggggtgattcagggctgagcctacgatctcccctcagtcgcctacgacgacagctcccctcgacggggagctcctttgcttctccttcacggctcggcccatcagagggagctactgttggaggttgcgttcgtagcgtggacggttgttcgtccacgatgtggacggcttgatgaacgtaatgccacacatccgcgtaatgcgaccaatagtgcacaacgttcgcgaaacgcccgggaaaaccttgcagcagtagggatttcaggagactcgccggtataatattgacattgtctagacgcaggcaaataatcactcttcagtcattcggagccgaatgcccagcgcagactccgtgtccatgcccggcagactccacaccgaggagacaaaaaaagacgaaagtaacgagcacgtcacatttgcctgcccggtgggtttaaactgacacctgacattgaagaagcaggaggcgtgatatggtcggttcgctcagcgcaggattgctgttggctgacgaggcaggcgctcatctgccctcggttgatgacttccttcccccggagattctgttccagggaactccgtttgccatcaaccgcattattttgattcgtatcgtggcaaccatcgtgctgttggtggtgctcggcgtgaccgcaaagcgcgccaagctcatccccggccgttggcagggcgtagtcgagtacggtctcgacttcgtgcgcgacaaggtcgtgtatgacgtgatgggtgaggcccgtggcaagcgctacgtgccgatgatcaccaccctgttcttcacgatcttcattttcaacctgtgcggcatcattccaggtatgaacatggcggccaacgccacggtggtcatgccgctcgtgttcgctgtctggacactgatccagtactggatcgccgccatccgctcgcagggcctcggccactatctgcgccacgagctgttcacccccggtgtgccgtggccggtctatttcctgctggctccgatcaacctgcttgagctgttgatcatccgcccggcctccctgaccatccgtctgttcgccaacatggtttccggccaccttatggtcgccacctgcctggcgttcgcacagttctggatggttgacgcggtcaacaagctgcagggcatcccggtgggtgcgctgtggttcgccggtggtttcgccatgacctgcttcgaggcgttcgtcgccttcctgcaagcctacgtcttcgcgattctttccaccgtgtacatcaacctgagcttcccggaagagtgacgggcgactaacccgccgcttccggtccccggtctgggaaaatcgcagaccgaccaaaccccaagatttataacgtcgccaagtacgttagaaaggaaacacaatggatatcatcaccctcgcagaggtcgccggcaacctgtccgtcatcggttacggtatcggtactcttggccctggcattggtctgggcatcctcttcggcaaggccatggaatccaccgctcgtcagcctgagatgtccggcaagatccagaccatcatgttcatcggcctggctctggtcgaggtgctggcactgatcggcttcgtcgccgccctgatcatctgatctgcgcagatcaacagacgaaaaccgattatgtccatcactgaaaggagggcttgatgacacaagcagcaagcgggattgacctgttcattcctgaggtttatgacatcgtatggtcgctgatcattcttgtcatcgttgcggtgttcttctacaagttcttcatgccgaagttcaatgcgatcttcgacgagcgcgccgccaagattcagggcaacatcgccaaggcggagcaggctaggaaggacgccgacgaggccaaggccaagtatgaggcccagctgagcaccgcccgtgtggacgccgccaagattcgcgacgacgcccgtgcggaagcgtcccacatcatcgccgacgctcgttcccgcgccgagtccgatgcggcccagatcaccgcatccgcacagcgctcgatcgaatcccagcaccagcaggccatcgtctcgctcaagggcgaggtcggcgcacttgccaccgccctggccggcaagatcctcggtgccaagctggaagacaacgacgtgcagtcctcgatgatcgattcgatgatcgacgacctgggcgccaagaagtgaccgtgaccatccgtaaccagaaagggaggtgaccatgcgaggagaggcatcacgtattgcagaccgcgagtcgcgtgattcgctggccccgaaactgcgcgacacccgtgaggacgcgtggcggatcggcaacgaactgttcacgatcaccaaggtgctcgatgacagcattcagctggagcgcgcactgaccgacccgtcccgcccggttgccgacaaggtggccgtcctgaaggaactgctcggtgacaacgcgcatccgatgaccatggagatcatgactgacttggtctcccgccgttggagccgtgcgcgcgacatcgccaacgcagtggaagacttcggcgtggacgccatgatgtactacgcggacgccactgacgccacgctgcaggtatccatcgagctgtccgagctgcattccgcactgctgaacctgccggtcgtacgcgccaagctgtacgactaccaggccaccagcgaggcccgtgtgaagctgttccgcgaggtgttctctggcaagaccctgaacaaggtcaccatgaggctcgccgaacacgccacttgcaacctgcgccgccgccgctacttggagaccatccagtggctgatcaacaagttctcccgccacatgggcgagtcgatggtcaccgtgaccaccgccaccccgctgaagaaggagcagatcaagcgactggtcgaggtctactccgccaaggtgggccgtcaggtgcacatcaactcggtggtcgacccgaccgtgctgggtggcatgcgcatccaggtgggcgacgaagtcacggacaacaccgtggtcgcacagctgcagaacttgcatcgcaaggtgcagacggaggcgactccggcctgaccggccgagccaatccgtccaacaccacacacaagcaaagacttgactgaacaataaccaatagaaggagtgatcatggcagaactgaccatcgatcccgcctcgattcgcaaggccctcgacgacttcgtgtcgtcgtacaagccgagcgacacccccacccaggaagtgggctatgtcgccacggccggtgacggcattgcacacgtgacgggattgcctggttgcatggccaatgagctgctgacgttcgaagacggcacgctcggcctggcgttcaaccttgacgcccgtgagatcggcgtggtgatcctcggcgatttcgctggaattgaggaaggccaggaagtgcgacgcaccggcgaagtgctttccgtgcccgtcggcgacggctatctcggccgcgtcgtggacccgctgggcaagccgctcgacggcctcggcgagatccagggcattgagggtcgtcgtatcctcgaagcccaggcccccgacgtgatgcaccgccacccggtcgacgagccgctgtccaccggcctcaaggccatcgacgcgatgaccccgatcggccgcggccagcgccagctcatcatcggcgaccgccagaccggtaagaccgccatcgcgatcgataccatcatcaaccagaaggccaactgggaatccggcgacccgaagaagcaggtccgctgcatctacgtggccatcggccagaagggctccaccatcgcctcggtgaagcagagcctggaagacgccggcgccatggagtacaccaccatcgtggcctccccggcagccgattccgctggcttcaagtacatcgccccgtacaccggctcggccatcggccagcactggatgtacaacggcaagcatgtgctcatcgtcttcgatgacttgtccaagcaggcagaggcctatcgttcgatttccctgctgctgcgccgcccgccggggcgtgaagcctacccgggtgatgtgttctacctgcactcccgcctgctcgaacgttgcgccaaggtctccgatgacctgggcggcggttcgatgacgggtctgccgatcgtcgagaccaaggcgaacgatgtgtccgcctacatcccgaccaacgtgatctccatcactgacggccagatcttcctgcagtccgatctgttcaacgccaaccagcgccccgccgtggacgtcggtatctccgtctctcgagtcggtggcgccgcacagaccaaggctctgaagaaggtctccggtacgctgaagatctccctggcacagtaccgttcgctggaatccttcgccatgttcgcctccgatctggatgcggcttccaaggcccagctgacccgtggtgcccacctgaccgagctgttgaagcagccgcagttccacccgtactcgccggaacaggaagtcgtgtccgtatggaccggcacccacggcaagctcgacgacctcgacctgaaggacgtccttccgttcgagcagggactgctggactacatcgaccacaacaccgatatcctcaagaccattcgcgagaccgaggaattcaccgccgacaccgaggctgccctcgataaggccgtggacgagttccgttcgacgttcgtctcttccgccggcaagccgctggtcgagaagaagccggacgttgacaaggccgcgccggtcgatcaggaaaagatcgtggcgggagaaaagtaagccatgggctcgcaactcgcattgaaatcacgcatccgctccaccgagtcgttggcgaagatcttcaacgctcaggagatgatcgcgtcttcgcatatcgccaaggcccgtgatgtggccctgaacgcgaagccgtacaccgatgcgattttcgatgccgtgcaagcgttggtggcccacacccatatcacgcatccgatcgcggtgaaggacgagaagaacccgcgcgtggctgttctcgccctcacctcggatcgtggtatggccggcccgtacacctcttcgattatccgtgaaacggagtcgctgctgtcccgcctcgatgcggcaggtaagcagccggagctgttcgtgtacgggcgtcgcggttcgacgtactacaagtaccgtaatcgtgacatcgcggcgacgtgggaaggcgacaccgaccagcccggcgtggaaattgctgaaacgatctccaacaccttgatggacgcctacatgaagccggctgagaagggtggagtttccgaactctacatcgtctacaccgagttcatcaacatggtggtgcagaaggtgcgcgtgctgcgcatgctgccggtcgaaatcgtgaaaaacgagaccaaggtgcccgatcctgatgaagaggcaccggctactgcggatgtcgctccgctgtacactttcgagcccagcctcgaaaaggtactggatgcgattctgccgaagtacattcagtcccgtatccacgagtgcctgctgaccgcggccgcgtcggaaaccgcaagccgccagaacgccatgcacacggcaaccgacaacgcacgaaacctgatcgacgaccttacgcgcaagctcaacgcttcccgccaggcctcgatcacccaggaacttaccgaaatcatcggcagcgctgacgcgctgaccaagaaggaagagtaggaacgcatatggctgacaaccagaccactgcggccgagcctaccaacggtcgcgtcacccgcgtccagggctcggttatcgacgttgaattcccggtgggtcatctgcccgacatctacaacgccctgaaagtaacgatcgtcaacaccagcgccaaggaagaaggcgaggcgaaggagaccgagatcaccctcgaggtcgaacagcacctcggtgattccacggtccgttgcgtcgctctgaagcccaccgacggcctggttcgtggtgcctccgtctccgacaccggcgccccgatctccgtgccggtcggcgacgtgaccaagggccacgtcttcgacgtgtccggcaacatcctcaacaagaagccggatgagaccatcaccgtctccgagcgttggcctatccaccgcaacccgccggccttcgatcagctggagtccaagacccagatgttcgaaacgggcatcaaggtcatcgatctgctgaccccgtacgtgcagggcggcaagatcggtctgttcggtggtgcaggtgtgggcaagaccgtgctgattcaggaaatgattcagcgcgtggcccagaaccacggtggtgtgtccgtgttcgctggcgtcggcgagcgtacccgtgagggtaacgatctgatcggcgaaatggccgaggccggcgtgcttgagaagaccgcactggtcttcggccagatggatgagcagccgggtacccgtctgcgtgtcccgctgaccgcactgaccatggcagagtacttccgtgacgtgcagaaccaggacgtgctgctgttcatcgacaacatcttccgcttcacccaggccggttccgaggtgtccaccctgctgggtcgtatgccttccgccgtggggtaccagccgaacctggccgatgagatgggttccctccaggagcgcatcacctcgacccgtggtcactcgatcacctcgttgcaggccatttacgtgccggccgatgattacaccgacccggccccggccacgaccttcgcccacttggatgcaaccaccgagctttctcgtgacattgcctccaagggtatctacccggctgtggacccgctgagctccacctcgcgaatcctcgatccgcgttacgtgggccaggctcactacgactgcgccaaccgcgtcaaggcgattctgcagcgtaacaaggagctgcaggacatcatcgccctgatcggtatcgacgagctcggcgaagaggacaagaccaccgtgaaccgtgctcgtaagatcgagcagttcctcggccagaacttctatgtggctgagaagttcaccggtcgccccggctcctacgtgccggccgacgagaccatcgaagccttcacccgcatctgcgacggcgtgtacgacgacgtcccggagcaggcgttctccggcatcggcggcatcgacgacctcgaagagaagtggcacaacatgcagaaggaactgggtgcgtgatggctgcggaaaaaaccacgatgaaggtcaacatcgtcgccgctgaccaccctgtgtggcacggcgaggcgacgagcgtgaccattcccgcctctgagggcggcatgggcatcctgcccgaccatgagcctgtgctcacggtgatcaagcagggtacgctcaccgtggttgagcccgatggcgatcgccacatgttcgaggtgaccgacggattcatttccttcgactcgaacaaactcaccgtggcggtcgagcgcggccacgacgtccagtactccggcaccgccgagtgacctgaaccaactccttaaggggctctctggttttccagagagccccttttgctatgtatgccatgtgttgcgctacagtggtggcctatgcgagttattgttgccgactgttcggccgagtattcgggccgcctcaacgcctcactgcccctggccaagcgcgtattgctgatcaaggccgattccagcctgttgattttctccgaattgggctcctacaagccgctgaactggatgaccgcgccctgcacgattcgtgagatcgacccagccgccaaatccgcgcaacattcccgggaaagtgtcgctggtggggctgtggatggtgattctgcgacgcattccccggaaagtgtcgccgctggtgagccggaaaaggtgctacgtgtcagcgccgacaagggttcggacattcttgaagtgacgctgcagcatatctattccgaccaaacctatgatctgggcgaagatccgggtctcatcaaggatggcgtggaagaccatctgcagcgctatctggccgagcaaatcgagcgtatcggcaagggagccaagctggtgcgtcgcgaatacccgaccgccattggcccagtggatattatggccgtgaatgccgagggcgagcacgtggctgtggaaatcaaacgtcacggcggcattgatggcgtcgagcagctgactcgctactgcgaactgctcaatcgagatccgctgctggccccggtgcacggcatcttcgccgcacaaaccatcacgccgcaagcccaggtcttggccaaagaccgcggcttcacctgcctcatcctcgattacgacgatatgaaaggcaccgaggacgacagtctcaggctgttctagatatagcaggggctccctcatcagagggagcccctgctatatcttttagtacgcggcgagaatatcgattacgaagaccaacgtggagttggcgggaatcggaccttgctccttatctccataggcctgatccggcggaatcaccagcagaacctgagagccgacggtctggccgaccagacccttctgccagccctcgataacctgatgctggccgctggaatcgctgaacagatcggcgtcgattgtggaatcgcgatcccaggacgaatcgaactgcttgccattcgtaagccaaccggtgtacttgaccaccacggtgttcttgtcggtcagcttggcgccgttacccttgatcagcgtctgcgagatcagcgaatcaaccgaaccctgaccgttcatgtcgatggacggctcgccgtttttggctcgcgtcaccttcggcagattggccggcacatccttgacttcctcgccagtggccttctccaagtccttggacttggacacaaacgtcatcgccagaatgtaagagtacccggacgaatcctgagcgttgacgccaaagccaatcgtggtgttgatcttggcacccttgatctggttgtagtaggtcgaggagagggtcttggaatccaccttcagcgagcaatccggcgtgttcttggtccaggtgtccatgagctcggttccgtctttaacgttgagcgcgatgccttgggcgcagacgcggtcgccctcctcgatcacgtcgccatcgcccttctgcagcaccacataagagccgtcggacacggtcatcggcgtattaaaggagatggtcggcttctcgccgagcttgcccttggcggtcacgccggcaatttggcccttcttgtcagaagagtcggaagatgaagaggaatcggaagaagaggatttcgagtccgagctcgaactggagcaggcagccagcgacacgcacatcgccagcgagcaggcaagggcaacggccttgccgaggggagataacatagacttaacagacttacgcatgacacatcaccctactggtaaaccttgattttctgcgctcctaggtaataaacaggtgaagattgtagaatggttgagttatgagtgctgaagaacagactacaagaccggataagggcgccaagcgtccatcccgtcatgccaaaatcatgcgtggagtggtgacgcctatcttcggactattggccgtggcggctgtggtgttggggtacatgaatgccacgatgtggaagccctccactgaaatcaccgcttccgcaaccatgagcggctcccggtatgtcgtcactgatccgaatgtgctgaccttgttggatcagaatgccacgataaccgtggactcgggatcctctcaggacgaggcgtgcgtggcgttgggtccgtccaaggatgttgccggatgggtcgcgtccgagaagtcctatacccgcatcaccggattggcatcatggagcgagctgagcacccagaagggaagcagcacgagtcagggagcgcctaccagtgccgatgacgcggtgtcgttcaaggattccgatatgtggactgccgtgaaatgcggcactgggtccgtttcgctgaagagcaagaagaccggcgcctcgacggtagccattgtggatttgggtgaaaatgtcaccaacgccaaggtgcagctgcactgggtgcgctccgaagtgccggactttgcgatgccgttctatctgtccggcggattgctggccgtgctggccgtactgtgcgcctccgtgttcgccatgccgccgcataagcgccgcaagcgcatggtggaaggcatggcaagcgccgtaatcgaggaagaggcacccgccagcatcgcagtgtccgggaagccggatggtgcaagtcgacgtaatcgtcgccgtcacgccacacatcggcgttcgggccgtgcgtcctcgcaatcctcgcaatctgaagccaccgaaacaccggttatcatcgacccaagttcgcgtaacctggtcgccgaccagcagaccggtgccgaaagcggcgctgagcccggcctcagcgccggcgataacgaatcgacttcggtaatcacccctgacgaactgcaggcctacttctcccgcttggcccaagaggtcaataccggagacgactcggccgatgacggacaggaggaaagctgatgaacaagcgatggaacaaactgtgtgtgtccgccctcgcctgcatggcgttggtcgtgccgttgaccgcctgtgaaggccaactgccgacgccggctgctgatacctccaccaaggttgcgccggatttgaccgaggcacaggagaagaagattcgcctgaagattctcaagacgatcgatgaagccgatcaggccaagaatcccgatggatatgcggccgttatgggcgggccccagctggacattcgcatcagccagaccacgatcaaccagcgcggcggcggtatgtccaaatacgcgaccattcccaaggacatcgcccagacggtgattcccatggacgacggatggcctcgctcggtgttcaccatcacgaccaccaccgaagatcagcagtccaagcgtttgctggtcttcgatcaggaatccgcccagcagaattacaagctgatggctatggctcgactgtttgagggcgccaagctgccgaagttcgagattccgactattggctcgcagatgggcaccgcaaaggatgagaagctggtggccgctcccgccgatgccttggcccaatacgccgatgtgctgcagaacggctccaagagccaatacgcttccaagttcgcagacgatttgctgcgccaggaactggccaataccacggccaaggtgcaggaaggtatgcaacgcaacaacggtacgcaggagcaaaaattcaccgctgtgcctgaacagatgtgggtgatgcgtgctgcagacggtgccggtgatctggtggttggccgtattaacggcgaatggactcgcaaggcaggggatggccgcgaatcgcagccggcttccgacgacgagaaggcgctgttcaatagcgacaagtacaccagcaccatgaaggtcacgtatgtgaacgtggtggccttgtacattccgttggcaagctccggtgagcaaatcaccgccgtgggtgccgaccgtcagccggtaaaggtcgaagcgctgtagttgttgccgccgcccaccgcgcggttaacgccccaccacgatatgattcatccaccacgatgtcggtaagttttacctttcgcacaatggtgccgttttgagtcacatcgtggtgggcgttttgctacgtggtgggaatttcaccgcgtagtggaagaatccctacgtggtgggaatcggcattacaatcaatgtcagcaaatgtgattgttgttgtacgcgaatcgcgtggaatcgggaggcattatggcagagcagcagttcaatccgggagtctcattggcgggcgccgtcgatttggaggcgctgaagcatcaggtcaaggccaagcccggccaggcgggtggcgctcctgccgctggtgggtacgtgatcgacaccaccgaaaacaccttccaggcaatggtgcagacttctgcgaccttcccgatcctgctgctcctgtggataccgaccgatgaccgcctgttcccgatggcccgtgcgttgggcgacgcggtgaacgccctgaacggccagattcagctctcccgtatcgatatctcgtccaatccttcgattgcccaagcgttgcaggtgcggggcgcgcccgcactgttcgcgttgattgctggccgtccgacgccactgttgcagggccttccgggtgacgacgagctcaagcaacttaccgacgaggtgattccgaagatcattgaggccgccgcgcagtctggtgtgaacggtaccgcgccgtactcgggtgatcctgattccgatgctgccaagagcgctggtgccaccggtgccggcgtgggtgctgagcaggtgccgccggagcatgccgaagcccatcgtttggccgaggagggcgattacgccggtgccgccgccgaatacgagcgcgtgctcgaatccgacccgtccgatgcactggccgcccgcgaacgtgcgaaggcgctgttgctggcccgctccgggtccgctgatgtacgtgacgtgcgtgccgctgccgccgcagcgccggacgatgtggaagcgcagttggctgtggctgatatcgacatgatcggtggccagattcaagacgctttcgaccgtttgctggactttttggccgccgggcacaaggccgatatcgagcaggttcgcaagcgtctgctcgaatacttcgccatccccgaacccaccgacccgcgtctgacccgcgcccgtcgtcgcctagccaccctcatgtactaagtggttttggctcccctctttgagaggggctgtcgtcgtagatgactgaggggagctcacgagcgtactcgattgctccccccccctaaaccatccgattcttcccgaaatactgctggaaccttggcccctccagcgccagctcctcctcgaaatcatccgcccacttacagaacggacggttggcgagaccatcgttattgaatcgcgcctgatcggtgatttcggtgatgcagaatttcggaatcgtcagattggtaaccggcccggatcgttcggcctcggctacgatgagcggcgcattcggcccgccgaacacatccacgctccagccgtcttcctcaatccacacggaataccggttcttgatgattaccgagccgccgcgcttgatgagttcggccgcgatacgcgtatcgatttcgcgctcgacttcgtagcgcgtgccgcccacggacggacctttgacggtgacatatgcttccgagaaccggtcgcggtattcgtccagcacggccaccggatttacgtcgggcgtcatgtcgacgtgaaccttgcgcgagaccagccgcacgcgcaaggcgtaattgtcggcatgcacgtagtagctctgaatgatgagggtcggggcgtcgccgtcgtcgtattccgccggcagttcgcggcagaagaagcggcgttcgtattcgaagtcatctgtaggttccgacataaccccattgtagagccgataatggcgattttctcgttattttggcgacgtatgtgccgcatgcaacgtgatgtggtgtacagtaaagaagttgctcgggtttgtagctcagtggatagagcgtctgtctccggaacagaaggtcgtgggttcgatccccatcaagcccaccagcatggctttcggctaaccgccggaagccttttgcatattcggcgcgtgcaaggctggtgctggtgtcggcaatggcaaggccggtgatgccggctcgcttgggtcgtggaaaaaccgtccggtttggcgagaacggtagccgaatcgtctggaatcgtctggaatcgtctggaatagcaaggaatagtctgttgatggccgtatgccgggcatcatgcgcgctaaacgcgactttgctcagtagactgctacgtaatcggcattgccaatcgttgctgatcgtgcgattggtcgtagccggtggtgatgtgtaccggcgccggccgcagcaggtgggcgcccccaagatgagaaggagcacaatatgagcgaaaagatggaagccgtagccacttccgaggcgccggccgcgctgggcgcatacagccaggcggtgaaggccaatggcttcgtgttcgtatccggccagctgggcattgatccggccaccggcgaactggcgggcgagaccgctggagagcaggctgcacaggcgctgaagaatattaagcacattctcgacactgccggtaccggcattgagcatgtgtgccgtgccaccatctacctgaagaacgtcgaggacttcaaggaagtggacgcacgttacgctgaggcgttcatcggctccgtcaagcccgcccgcgtggcctttggcaacaacatgattcccaagggcgcgctcgtggagattgacgccatcgcggtggagtgattcgaacgttttcccggcggcccgtctgcgcgcatggtgtgtgcagacgggccgccgcgtattgtgcgacgcattcccgggaatgttgcgctggaatcgttgggcggtggtccgtgccacaatagagaccatggcatccaaaggaaaaccgtcgccgcgttcggccgtaagcccgctgagtgatgagcaggtcaagcgtctggccgcccgccacacgcttgtggactcgacacagtattacccgaccggcccccgcacgcccaatcagccggaaatcaacgcccagaatcccaaggccaccaaacgactgctgggaggggtgtccattgtgttccgcgccagctgcaagaccaaggcctggggcttggaacaggtgccggaaaccggaccgttcatcaccgccgccagtcatgtcaccatgtttgatgtgttcgtgccaatgatgagcctgttccacatgggccgccgcccccgttacatggccaaggccgagatggcgaagtggccattgatcggcaagtggttccagttggtcggcatgcagccggtgcagcgtcattcgggcaaggccaagcagatcgaagagacctcgattgatattctgacgtccggccgcccgctgacggtctggccggaaggcaccgtgacccgcgacccgaaaaagtgggtgatgagcattaaggagggcgtgggatatatcgcccttgaatcctcgcgcagactgggacatcaggtgccgctgtacccggcggtgacgtggggtgccgcctccatcaaccactggtggccatggccgcgcaaaaacgtggtgatgtgctatgaccatgcgctcgattactccgatctgcttgccgacatggactcatggggtgaagagccgcctgccgaggccgtgaacgagctgatgtggcgcgtgctcaaacgcatgaacacagtactggaggaaattcgtggcgagcagttccccgctgaaggctactgggactaccgcagtatgagtcgtaagccttggcctgaagccggcggcccgttcccggctgagaagtagccgcaccggttcccgtacggggagcctaggcgagtagcatggcacaagattgtgccgatgaagttgcgcgacaagcgaaggtaggaatttgatatgggtaaaaatataacggttctcggtgcaggagcatggggtactgctttcggccaagtgctggcggacgcaggcaacacggtgaccatgtgggccaaggagcagcagattgtcgagggcattcgcgatcaccaccacaacgccgtgcgcctgccgtccgtcgaaaagttgccggacaacatgaccgccactggggatcgcgccgaagccgtcaagaacgcggacatcgtagtcgtggccatcgctgcgcagttcgcgcgagtggcactcgtcgaattcaagggactgattcccgatcgcgccatcgtcgtcagcctgatgaagggcatcgagcgtggcaccaacaagcgtatggacgaagtcgtccgcgaatcccttgacttgccggccgaccggttcgccgccatttccggaccgaacctgtccaaggaaatcgccgatcgtcatcccgccgccaccgtggtggcttgcacgaacctcgataatgccacgaaggtggccgaggcatgcaccacctcctatttcaagccgttcgtgaccaccgacgtcatcggcctggaaatgtgcggcagcctgaagaacgtgaccgcgctggccgtgggcatggcccgtggtgccggctacggtgagaacaccgcagccatgatcgaaactcgtggactggccgaactgaccgcgctgggcgtagccgctggcgccgatcccaagaccttcttcggcttggccggtgtgggcgatctcatcgccacctgtggctcttcgctgtctcgtaactatacgttcggcgcgaatctcggcaagggactgacggtcgaagaggccaccaaggtcagcaacggtgtggccgaaggcgtgcccaccacggatgcggtggtggctcttggcgatcagcttgatgtgccgaccccgttggcgtatcagatgagccgcgtgctgaacgaaggcatttcctgctcggagatgcttgccggactgttcgggcacgaggttaccggcgaataacgagagaagcgacgtatacgtggcgtatacgttgtacgtgccgcgtggcgtatacgtcgttggtgtgcacgagtagactggtgtgcgtctcttgtgcgcggcggtccgagcgcggttcggtccggttggcggtgcaaagcataggcttgaaaacggttgtagtttcaacaaaaggatggttatggccaagaagcgtgttgtggtgctctatggtgggcgtgcagacgagcattcgatttcctgcatctccactgccggtgtgctgggggccatggacactgaacggttcgagccgattccggtcggcatcaccaaggacggcaagtggatcatcaatggcgaggatccgcgtggctggaacttggacggcggcgagctgccgaccgtaaagatcaccccggaatcgcgcccggtgatgcttgacccctctcgcggacaggacggtttcttcatcggcgagcccagccacatcaattccgccgattccggcttcggcaccagcttcgtcagcatgtccgacccggaaatgcaccatgtgctgacctcgcttggacatgtggacgcggtactgccggtgctgcacggcccctatggcgaggacggtacggttcaaggcctgctggaaatgatgggtgtgccgtacgtggggtgcggagtgtttgcttccgccgcctgcatggataagcattacaccaaggtggtgctggatgccgccggcattcccaccgcaccgggtgtgacggtcgatgcgcgcaacttcaccgccgccgatgtgcttgccaagatcgaggacgccggtcttgcctatccgctgtttgtcaagccttcgcgcgcaggctccagcttcggtgtgaccaaggtcgagaaagccgatgaccgcgagacccagcaggatcgtctggccgccgccatcgccaccgccggcgagcacgactggaaggtgctcgtcgaacaggggattgatggccgcgaaatcgaatgtgccgtgctgtgcccgaaggccggtgacgagcctgaggccagctggcccggcgaaatcgtgctcgatcatcagaacgacgaccagttctacgatttcgattccaagtacatggatgcctccgccagccacgtggaagtgcctgccaatctgccggtcagcgtgcttgaggacgtgcgtgacgtggcccgtcgcgcgttcaaggccgtggatggtgccggcttgagccgtgtggacaccttcgtgacgcctgatggcacggtgatggtcaacgaaatcaacaccatgcccggcttcacgccgatttccatgtatcccaaggcttgggatgccaccggagtgagctacaccgaactcatcacgcgattgattgagggcgtgctgaggtaagtgtggtgcggaatcggccgcaggccggttccgctattgacacatcgcccatacctgtcagtaattcatgccaagttttcctaagttcaacaggcgtacaacaaatggcgaacgcaattcacttgcgcgccagtgtcaggacagattaggcgcatagtttcttttcttggattcacgggccgcgcgaatgccgcgcataccaagcccgactccccagactgtcgtctggatgatgttgagaaaaggaacattatgaacaacctgcgtaagatcgcggccggctccctcgccgccgtgctcgcgttctcgatggccgcctgcggctcgagcaacgcctcctccgatggcaccggcgaaagcaccggcaaggccgtcaccgtgaacgaaaagtccgccaaagccacctccctcgccgacttcggcaccatggaagacctcgagaaggccgccaaggaagagggcgcgctgaacgtcatcgcccttccgcacgattggtccaactacggcgaggtcatcgagagcttcaagaagaagtacccggagatcaaggtcaccgagctcaacccgaacgcctcatccaaggaagagctcgacgccgccaagaccaacaagggcaccgacgccgcccccgacgtcttcgatgtcggccaggccgtcgccgccacctccaccgactacttcgccccgtacaaggtgcaggcctgggacaagatcccggacaccgccaaggacgccgacggcgcctactacgccgactacaccggcatcatgtccgtgggctggaacgccgacaagtacggcgacatcagctccctggacgacctgctcgacccgaagttcgccggcaccgtggccctcaacggcaagcccgccgaggctggcgccgccttcaacggctacctgatggccaaccagctcgccggtggcgacatcaacaacctgcagcccggccttgactacttcaagaagctcaaggaggccggcaacctgaccaccgtcgacgtgaccaacggcaccatcgactccggccagaccggcgtggtcttcgactggacctacaaccaggcctcctacaagaaggagctcaaggacaagggcgtgaactggaagtacaagaccttcccgaaggcccaggtcgtcagctactacaaccaggccatcaacaaggacgcgccgcacccggccgccgcccgcctgtgggaggagtacctgtacaccgccgacgcccagaacctgtggttcaagggcggcgccaacccggtgctgctcgattccatgaaggaagacggcaccgtcgaccaggccactctgaaggacgccatcaccatcgaaggcgagccggtctcctacaccaacgacgactccacccgcatcaccgagtggctccagaacaactgggacaagacgatcggcaactgaggcacagaccgatgaccgccgcaatcgcacccattgcatcgaacggacctgctgccgccaaggccgcgggtccgtccgctactcccgcttctcctctctcctcggcgatggccaagcaccgccaggagctgggcacgctcgccaccacgctcccgttcttcgcctacaccgcctgcttcctgctcgcacccaccgtcatcgtgattgtcggtgcatttcaggatcgcagtggcaacttcacgctcgcgaacttcaataagatgttcgaggccaacaccatcgccgcattcggcacctcgattctggtgtgtttagcatcctctctgatcggcgcagtggtgggcgcgctcgcttcctacgcactggtcattggtgccaagccgaacggcctgctgcgtcgtatggtctccgccatctcctccgtgcttgctcagttcggcggcgtgatgctcgcgttcgcgttcatcgccaccatcggcatcaacggtatcggcaccatgcttatcaagacactgaccggctacaccgtgaacccgaactggctcagctcgttgccgggcctggtgaccatctactgctacttccagattccgctgatgatcatcatcttcctgcccgcggtcgattcgatccgtccacagtggcgcgaggcatgcgaatccctcggtggcaacacgttccagtactggacgcgcgtggcctgcccgattctggcaccccgcttcatctccgcgttcctgctgctgttcgcctccgcgttctccgcatacgcgaccgctgcggccctgttctcccagcgttcgattctggtgccgcttatgatccaaggtgccatgcgcaacgaactggaccccaaccagcagggctttgcccaggtgctggcattcgcaatgatcatcgtcgtggccatcgtcatgctgttgagccacgccgtggaaaagagggccggacgttggcaatgaccgaaacttccgcaaccaagccgccgcagctgcgcgccgctcgtgcgcgtaaacagagcatcatcaaattcgtgatcctgttcgtcaccctggcgttcctgttcgtgccgctgctggccatgctcatcttcaccctgcgtcacccgctgtccggccgctggtcggccgcgccgtggatcgcgattttcaccggcaacggcgagtcgctgggtgccgacctgaccgtgctgtggcagggcatcggcacctcgctggccctgagcgcggtcaccgtggtgatcatgctggtgctgctggtgcccaccatggtcatcgtgcatattcgctccaaggttttggagcgcgcgatcgaatgggtggccacgctgccgctgaccatcccggccatcgtgctggtggtgggtttgggcccgatctaccgctggctgtccgccgacgtgctgagcaccaacccaatctggctgtgctttgcctacgtgattctcgtgatgccgttcgccttccgcgcgatcgccgtggggcttaactccatcgacgtcaagacgctggtcgaggcatcccgctcgctcggtgcctcctggcccaaggtgttcttcaaggtgatcatcccgaacctatggcagtcgattctctcggcatcctttatctccatcgccgtggtgctgggcgaatacaccgtcgcctcgctgctcggccgtatgaacctgcaggtcgcgctctaccagctcggccagtccaattctcaaatctccaccgccatgtcgctgctggctctgctcttcggtgcggtgctcctcgttgcgctcgacctgatctccgacgcaatgcgcaagtcaagggaaggtaagtaacctgatgaacagcaattcgattttcacccgtcgccatgccggtgccgatgccgcggcttctgtttcggcacccgccaccacgtccgctgccgccgaggacgccttcaagaacgatcccaccgccaccctcgaaggcgtgcgcggcaaggacgtgaccaaggccgccaaggccctgctcaaagacagcgtcaagcgcggcggcggctccatccagatgcgcgacgtcgtcaagatctaccccggctccaccgttcacgcgctcgacgacttcaacctggacatcaagcccggcgaaatggtcgtgctgctcggcggctccggctgcggcaagtccaccgcgctgcgctcgctcgccggcctcgaagacatccagggcggccgcatcatggtcggcggccaagacgtcaccggcgtgccggtcaacaagcgcgagatggccatggtgttccaggcctactcgcttttcccgcacatgaccgccctggagaacgtggaattcggcctcgaagtgcgcggcatgggcaaggcagaacgccgcaagatcgccatggaacagctggagctcgtgggacttgccgatcaggccaagaagtacacgcagcagatgtccggcggccagcaacagcgcgtggccctggcccgcgcgctggccgtcaagccgcgcgtgctactgctcgacgagccgctctccgccctcgacgccaaggtgcgcgtccagctgcgcgaccagattcgccgcatccaactcaccaccggcaccaccaccgtcttcgtgacccacgatcaggaagaggcgctggccgtggccgaccgcatcggtgtgatgaacaagggcaagatcgagcagatcgccgccccgcagaacctgtaccagcgccccgccaccgagtacgtggccacgttcattggactcaccaaccgcctgcccggcgcatccaatggcgacgaggccgtggtcttcggccagcgcgtgccgctgctcgccggctccgccaagggcgattccgtggccgtgctcgtgcgcccggagaacctgacgctggccttggccggcagcagcgattcgcacgtcggcgaacgcgcccgcgtggaggtcattcacttccttggctccttggtgcgcgtggatacggtcatcacctccggcgaataccagcgctggaacaagggcgaacagctcaaggccaccgtgcagctgcccgccagcgagctgccggccggtctggcggtgggcgatgacgtgattgtcaccccgcgtccggtcgccgcgctcgcctgctgaatggcgttgcgatgatcgtgcggttctgttctgtttttgtgactgtacgatcgtcgaatggcttatcggcaatgatgtgtgtgggatggcggcgatttttgggcgattatcgcgtgccgtcccacagcaatcttgcagagtaggggactttctcggcattgggaatgattgacgttgatcattccttgcccattgatgatttcctcccccattcccaatgcaatcgaaacgccgtgccgtattcttgaagagtattgcacgtgtgatcggtccgtttgcggccagtaactatgggggataagtatgagcgaaccaatgccgccggcgcagcaacctcagcaaccacagcagccgcaacaaaccccacgcgattggtggttcacggcccatcgccggttttcgacaatcggctcggcgctcgccattatgatggtgttctggatcggactgaatattctggccactgaagcactacgaacgctgcttggcgccgatgtgcccgcttgggctgtgctgctcgcctcctccggaccgctgtatgtggtggccatgccgctgagtatgttggccttcactcgcgtaccggttattcgcacccggcagtaccccatgaaggcgggggagttcattcagattttcgtcatgtgcattccggtaatgttcttgggcaatatgattggcaatatattgtctgccggagccactgatggtcaggccaccaatcgcatcaacgacgtgattcttggcagcgactggcgggtggacgcattgttcataggcctgttggcaccggtttgcgaagaatggatttttcgcaaggagattatctcccgcctgcgccggtacggagagaagaccgcaatcatgttctccgcattggcattcgcgctattccatatgaacgtgttccagttcttctacgcctttggcctaggactgatgttcggatatgtatacacacgcacctcccgactgcggtattcggtggctatgcacatgctgatcaacctgaacgggtcagtactcgccccattggtgatacaacagatcgatccccgcatcctcgacggcacggtcagcgaggccgaaatcatgcgtatggctgaaaccggcaacatgggcggcatgggcatcatgatgttgtacggcacagtgatgttgggcctctgcattgccggtatcgtgctgcttatcaccaagcgcaagagctgggagttctatcttgcgccagaggagttgcctgcggggcttaaaatacgcaccgcctatgccaatcccggcgttatcgcgtacctactgttgactgtgatgcttaccggttggatgctgttcgcatgactgtcatagccggacccagagaggcgagccgggagatatcacagattgcctgacgagctgccatcttcaacaaggtattcggtgcccgaaccggcgatggctcgcgccgccatatctttgatggtggaaggcagcacaccctcgcgcgcgaacacaagcacttggccggtcatgccgtaaggggagaagccggtgaacttgaccagcggtggctggccctccagtgccacatcggcggtggctttggttacgcggtcgagaatatcctgactgatagcggacgggtcgccggaggccttggccgtgaactcaagcgtggacatgccttcgctgaccggcgtgagcttggtcagggcggccgtattgagtaccgaattggggatgaccatcatgtctccggaacgggtgcgcaccacggtctgacgccaggtgatgtcgtgcacggtgcctgtgacgccttgaatggtcaccagatcgccgggttggattacgcggcccagcatcaggccgaagccgccgatgatgttggcgattgtatccttcagacccagcgagatcgccacacctccaacaccaagggcggtgataagtgtggtcggattgatgccgaatacgggctgcagtaccatcgctgcgccggtgacccagatggtcacgcgcgtgaggttcacgaaaatcgaggcgctgggaatctgagaattgtccagaatcttgcgcaacacgcggctgatgacgcggtcggccacaaatacgatggccaatacaatggtcagccagatgagtttgccggcgttcacctgaaaccagcgtgcgatgtcttctgcatattcagtcatacgcctactgtatcggtcgtttctggtgaagtcgtggagacggggtggcagaaagcggaatcggcctacggtcgattccgctactcctggtgctcgcggcaggtctggccgaggcctcgggccagtcgaatcggatcgagaatctcgtccaactgctcggcgggcaggtcggtgcgttcgccggccacctcgcgcacggtacggccggtatgtacggcttcggcggcgatgtcggccgcgcgctcgtagccgatgtagtggttgagcgcggcggaaatcgacggtgaggactgggcgtatgaacgccccaggtcagcattgatttcgatgccttccacgcagttgacgcggaacgtctccatggcgcgcgtcagcaacgccatgccggtcagcagctcatgcaccatcaccgggtcgaaggcgttcagctgcaactgtccctcggccacagcccagttcacagtcacgtccatgccgaagatcgtgaagcagcactggttgacgcactcgggaatcaccgggttcactttggcgggcatgatcgacgatccggcctggcgagccggcacgttgagatcgttgaaaccgcagcgcggcccggaattgagcagtcgcaaatcgtcggcggccttcttcaggtgcacggcgaggctcttgatggcagccgacgtggccacgtacgcgcccatatccgtcatggcggccaccggatcgggcgcggcggtgaccggcagcccggtgatttgcgccagatgcttgatagcggacttgcggaatcgcagatccgcgcaaatgccggtaccgatggcggtggcaccgaggttgagctgggccagcagcggcaccacgcgatcgaatgcagccaaatcagacttcaacagcgtggcaaacgcatgaaattcctgaccataggtcattggtacggcgtcctgcagctgcgtgcggccaatcgtcacgtcattgatatgtttgtcggccagatcgtggaaggccttggcgagtttcttggtggactcggcgagcggcccgatcgcgtcgataagcgcgagtttgcaggcggccgggtaggtgtcgttcgtggactgcgacttgttgacgtcgtcgttcggatggatgtatgtgtaatcgccgcgctggcggccggcgatttccaacgcacggttggcgatcacctcgttcatgttcatgttcgacgaggtgccggcaccgccctgcatcacatcgaccgggaactgatcggccagtttgccggcctcaatttctaggcaggcggcgcgaatggcctcggccttggctgggtcgatcaggcctaattcctcattggcgatggcgcaggcgcgcttgaccgtggcataggcgcgaatcagctcgggatgttggctatcggtgatgccggagaccgggaagttgccgatagcgcgctgggtgtgaataccccagtagacgttcgccggcacctccatctggccgatgcagtcatgttccagacgggtcttgttcgatgtttcgctcatgcttccatcttcctgtgcgtgggttggaaacgccagcatgagaggctgattgcgccttgtgagaaacctcacgcggggttcgtgcggcggaaacaatccagactcgctggttttcggtcaagcggtgtacccggggaatcctgcggggccgttcgacgatgagatggtggatggcgcggcatgcgtggcggcgaccggcatgccggggacggtcgaatcctgcgcattgtgcacgaagatgcgattccagtaattaagcatgtccttttggctcatggccaggtatatgcccatggccagcacggccacatcttctttaagcaggtctttgatttcgatggtgtcgctcaattcgggccaacgttgcagcacggcgagcatgccgcccacggtgaactcgaccatgagatcggttttcaggtcaaggttcttggggtcgcgttgcaatgtgctgagcatttgcagacggcagaagtcgcgcagcgattcggtcagttcaagcgtgctgtgcgggcctgccaacagggccaggcggtcgaggcgctgacgctgctctggatcggagagcgtggcggtgacgcggtctcgccattgttcctcgggattgccgttcggatcgggggtgcggttgatcggaatcgattcgacctgatgcaggatggctgaatcggccaattcgggcaggctggagaagtgatagtagaacgaattacggttcacgccagcctcacgcaccacgtcggtaacggtgatcttgcgatagtcgcggtcggcgagcaattcccagaaagcgttctcgaggcgttctttggcgggcagcacctcggaatcatggcgtggacgtggcatctcttcctcctgatgcaccagcgtgatatggtcacgctgtctaataacttattgggcagtataactgttatttgtggacatgtctatgagttaatcggcgatttcagttgcgtcctccgctgatggcgaagctgtggtgccggcatcggcatcagtatcggctctggctggagctgcgctatctgctcctgctgcagtttctgctggggtctcggctgttgctttggaggtcgcagaacttggtgcggaagccggggcgggcgtcggcttgcgtttggccgtggacgccttgaacagtatcgccagggcctcaaccaaatgacgccggtctgcgggggtcagccctacatacgcgccaagcatcgccggaatcgaagcggggaagttgctcatcacctcgctgaagctggtggcgccgttggcgtgcagcacggtgaacagcgcgtccaccgcacgctcgcgctgttcgggcgtaagcgtggcgatccaatggttcagctcctcgttaaacaactgcgagctggaactcaaatccggctcggtgatgaactggtcgccatccaatagccaggtgaaggcggaatgctgcatgatgccatccgaatcggaagagaccacgcggcaaggctccggggtctcgaaaatcatgcccacaatcgacgaactcggcacgattttcgtcaccttcggctggatggtgcggtaggcggggctggtcacaatctccggcgggaaaccggggccatccagtgaatagacatgctgaatgcgcttgcgcaccttgggatcggcgttcatggccgcgtaaatcgccagattgcctcccttggaatggccgaccagaataatcggaccctcccacagtcgcgccaccatatccagataggcgctggctgaacgttgcgccggcaccggatactggaaagccatattgaaatcttccttccatccgatgagcgaatcatcggtgccgcggaaggaaataaccaacgtgcctttgtaggtcggctttcggcgcttgtggccgtcgggcagttggaaggtggcggcggcgaattgggtttgctcaccctgattgatgtgctcgaccaccgcgcccaggcgaacgttggcgtagcgggggttttcgcctgcggcctggaacaggtcgtgggtcaggtccgggttgaccactgaaaccatttgggcttcgtgcggcttgtcgtcggcatgtgtttccggcgaacgatgcagctcgcggttggcctcgtcaaggcttaccgattcaagctcgggatgccagatacccttcagccagatcagtggatgcttgggttcgaaagcgcgaatgcgtgcggcgaacgagcctgaccgcgtctcatccagcatcaacgtcggacagacactggccacatcctcatagatgagcgtggagatgatcaaggcgtcgatttcgttgaacggcaagtcggcgaaggagcgcgtttcggtgtgcgcgtaatcgataatgccggtcatgcgcacctcctgcttccgttgatattgcatatccccttgggccatgtggtcttgcgattgcgtgcggccgtgcggctgcgcgcagcaattaaccatatgcattccattgtagggattgtacggttttggccggcgcgatcgagcaagactgcaccgacggcgaacaattcgtggaaggattcccgtcggcttgtcgaaaattgtcgggtagcagggttgcgatgccagccagccgaccaccctccggcgctacgcgccatctcccgccggcgggagggttaaccactcaatcctttttgacgaggcggaccgctgggcccgtcaaaggttcggcagatcgaagcgcgccagatccacgccctcgtgttcaagcaactcggccttgatgtcgagtcggccgccgtagccgccaaacgcgcggcccgagccgactacgcggtggcagggcacgatgatggtaaccggattgcgcttcactgcgcctccgaccgcctgcgcggccatgcggccgccaccgcgtcgttcggccaattcggcggcgagttcgccgtaacttaccgtcatgccatagggaatctcggccaccagattccacacttcatgttggaatggcgtgccggcgggatgcaacggcggcgtctgatctaggccggggcgctcgccggcgaaataggcggtcagccatacgcgggtcatacggaacacatcgggttcacgatcggattcgcgattcgaatcgagaacggcttggtgatcggtggcccaccaccagtcttcaagacagagctcggtcaggccctcgccgtccgaggccatcatcatccggccgatgggcgtttcgactgtggcccgcatcagttgtcgttgcgtcataccgccattatcgcgcgttgagggatgaagcccatactgtgcctgatttcatgaaggacgggtcgtgctgtacggtcagtattgcgtgccgggcagcgatatctgacatagtgggggttcttgggccggcatgagtgttctttccgacatcccaaccgtctaactccgtttcgaggggctgatttgggctgttccggaggtctatctccgtttcgaggggctcctcatccgggaaaccacaagtataaacggctccgggctaacgtcattacgccgtttttggcccgtgtctactcagccaccagccccttgaaacgggagtagacctccggagaaggccaaatcagccccttgaaacgcagcgacccctctgattggagtcaatcagaggggttcggcacattgctgatgcagctggtccgccgtccgccttgaggcggaacgtaaccaagattcaggcgggattactccgcaacgagcgccaggaaggcggcgtccacggcggctgtcgggttcgggaattcctcgtcctggttgaagaacggcacgtcggcgtagttcaggaacttcacttcggcacggtcgccgatcaaggccttggcctcttcggccagctgatcggttatcgtcatgcgttcctgatttccacggccatggccgtgcaatgtgcccatcgcttggttctacccgctgtttatgctggccatgcccatcgcctggctgctgtatacggccaccgcgagttatgtgcacggcggcacccgataatcgttggaaaaccggtgggacacgcgggggcttggctttttcctgagattggcgtatctttgtcacctgttgcccgtgaaggtaacacatgcggacatagcttagttggtaaagcgcaaccttgccaaggttgagaccgcgggttcgagtcccgttgtccgctctcggatggctggttcaggatgattgattcagcctgaggatgacccgggcggttggcgcagtggtagcgcacttccctgacacggaaggggtcacaagttcgaatcttgtatcgcccactcgatgaatcgccggcagaatgttgccggttttttcatcacaagctcgggcgattggcgcagcggctagcgcacttcgttcacaccgaaggggtcgtaggttcgattcctacatcgcccacccgatatcacgctcgtcagtctatgatggcgggcattttctatatctgccgtgccacggttcctcatatggcgtccggcctcgggtggcatttggctgtgagcggtttcgatcatgagtggcgtccggccgtcgtacaatcccgctgcgcgcggtgccgtttgggctgtaatacgggtgctttgaaccggccataactgcttcatatgtcccggggcttgtgtcgtgtgccgcggcgcgcttccatagtggatatggcggtgtggaaggggagccgccatacttacttacacaaggacgtcttggtccgccagggcaacgcgcatggaaaggggtttgcgatggtgtgcaccacgctgaatttcgcggagaaatacctgctgaaaaccgaagtcaggtccgttgccggtatgtccggcggtacttccgatgctggtactgatttcgatgtcgatttcggtggcgagggcgacctcggaagcgatcatgccaccggtttcaatcgctcgctatcggccgacgattattgggctgcagccggatatgccgatgagtcattgtattgatggacgtgatgacgcggtaagggcgcgtcgataagtgcggctggtgtcgcggctgatgccgcatctggtgctcgttcggtggtcgcggctgatgttccgtacggagcctgcaatggttttgcatcggtggtgcgtcaaaatccggaccgtcgccgacgctgtggacgtttggcggcgttgaaaggacagataatggattgtcaacgccgctgagaacgattggcgacggtggtgggacagcggatgccccaccaccgtcgccaagagtggtacttgtgtcggtggcgtccaaaacatggcccggcaccgacatcagatactctgaacgtcggcggattcccgttctgtgtcccagcgccgacgtttgattcctgcttatgcgagctggcgtcggtaaaaaggcagaacttggttcaccggcgatgtctcagcacgtttgcgcgcgtcggatccttctggagcagcaggaagacgagcgccacaacgagcaggacggcgatggagagcacgccgaacgaggcgttgccggtcagggacgtggtggtggctaccaggaaggtgccgatgattgaggccgttttagggaagaaacaatagtgagaccggggaacccttgaaatcattggggaatcatggtggcgatgcatgcgattaacacatgttgttaacacagatgtggaatgaggaggcgcgtgaggctcgtggtctgcgacgcatgagtgtgaccgtgagctccccagctgatgagcgcaaaggcagagattggtttcacgcgggacttgtctgccgaagagcggcgattgatgcagggtctgtgcgatgctctgcagcagttgctgaacaagcagtaccagcggcacatgtgggactgttcgatagcctgaaaaattttgccgcagacaatctaggcaatgtgcttggcggggatttcaatctcggttcgattggtgatttgccggcggtaatcggtgagcatttcaatgccgatcagttgggtgaaatcaacaggtcgttggcgaccatttgaacgccgaccgacttgacgagctgcaggcgctggcggaggaaaacatctccgccgaccagatcagtcaggtcgctggcgcaattcaggagcagggtgccaatctggacctcggatccattgccgaacaagcaggactgcccgctgacatcatcagccagatttccggactattgggcaagtagtcgccttaagctttaacgctgacggtgttgtctcggctattgcgtgttttgcggtcgctcagcaaatcatatgggtcgtaggtaaccgattgcgagcgctgctgtacacagatgtgtacgtgggtcgaagcggattcgtggtggcaggtgagacaagctgccctcgcatggctggaaaagcttcggtctcgtggagtgcgatgttaaagctgctcaggtcaacggaatggcggaattccgccgatgcaacttgtggttgcgctcgaataaccggcgattgcaacccaaagatggtggcgggtgacatggacggtatgccatagtgagcccatcggccgaacatgacatgataaagattacgtatgaagggacattccaatgagttttcgcgctaacctgcagtacctacgtgcgcaacgcaacctgacccaggaacgattggccatgttgcttggcgtctcgcgtcaggccatttcgaaatgggaatccgaaaaggcctatcccgagatggacaagctgcttatgatctgcgacctgttcggctgcacgcttgatgatctggtacttggcgatgtgagtcggcctgccgcgtcggcttctacggccggttcgtcgaatgttgactcctcggctgagacggcatcgcctttagccgcttcttccaaaacggcgggcataatcgctcctatcgcggagcttgcgcaggatatcactggctacgatgaacatcgccgccgattcgcgctgctgattgccggcggtgttgctgcgattgtcgccggggttggcatcggcaacctgttcgattccagcaattccattctcggagcgacgccgctcaacgattttctgacgtttctgtgcgtctgtgtgggtgtgattgcggggctggcgatgctgattccaggaggtctgtcgcgtattgacttcaaacggcgtcacccatacgtagaagatttctacaccggggaggaccgcagccgagaattgcggctgctggtaatcggcatcgtcggtggcatctcggctattctgattggcattgcggtgacggtgtatgccgatgacatgctcggcgtctccgatggctggcccaacgcaatttttctgctgctctgtgcgcccagtgttttcgggtttgtctactgcggcatgagatacagtctgctcaatatcaacgcatacaacaaagcggccgaggacgaccgcaaggagcatgcgggcgagcaggatttctacgccaaactgaccggcgcggtgtgcggcatcattatgctgatagccacggcgactggcttgtgcctgctgtttttgaaccctgcggcattgcgcggcgattggtcggccgtcgggtcgagcgccgcggacggggcgatgttctggctgccgtggccgattggcggtgtgctgtgcggcgttgcggccgtcgccattcagctgatcaaggattatcgcgagcgtaagtgatcaagtggcgatggtccattgctattagggcccgttgcaggggttgcgagatgtcgcccgcggcgcagagttgccgagggccggcaaatcactcccgcgtcgggtccttttgcaggagcaggaagacgagtgccgcgacgagcaggacggcgatggagagcacgccgagcgaggcgttgccggtcagggacgtggtggtggccaccaggaaggtgccgatgatcgaggcggtcttgccgaagatatcgtagaagccgtagtactcgttggcgtgatccttggggatgatcttgccgtagtacgagcgggagagcgcctggatgccgccctggaacatgccgaccagaatcgccagaatccagaactccacggccgacttcaggaagaacgcggcgaagaacacgatgcacatgtatgccacgaccgccgccgtgatcatcactttgcagccgaaccggccggccaaacgaccgtagagaatcgcgcaggggaaggccacgaactgcgtgacgagcagtgccaccaccagctgggtggagtcgatgccaagctcggcaccgtaggaggtactcatcgaaatcaccgtgttcacggcatcgatgtagaagaagaacgcgatcatgaacatccacaacggcttgttcttcacgattttgccgaacgtgcccgccagttcgctgaacgtgccgcgcacggccgagcccagctggtcacgggtggcgcgatagtgcacttggcggtagctggtaagcagcgggatggtgaatgccacccaccagatggcggtgatgatgaacgaggcgcgcgtgcaagccaccgtggaccagtcgaagagcgacgggccgccgaagatcagcgcgatgcagaagatgaacggcacggtggagccgatgtagccccagccgtagccatgcgaggagaccttgtccatgcgctcgttcgaggtggcgtcgatgagcatcgaatcgtagaacgttagcgagccgttgaggccgatggtcgccagaatgtagacgactaggaacggtagccaggtcaggggcagggccattgcgcagcaggtgaccacgccagtgccgaagaagccaaggaagaacttgattttcatgccttgcacgtcggcgatggagccgagcaacggcatgagcagcgcgatgaccaaggaagcaatggtttgcgcgtagccccaggcggacacgatgttgccgtccgccggcatcagcgatttggcgtaaatggggatgacggcggtggacagcagcacgaatgccgagttgccgacgtcgtagatgatccacttcttctcgcgggcggtcagtttggcgctttgcggcaccggttcgtggacattcgtgggatcagtcatatacactcctcgacagtattcaactcaatctatcgtagaagcgcggactagggtaggggagccattccggttgaacggcggatgaataatgccgggcctctttctaaggggagccagagcaaaaatagctcccctcgctgaggggagctggccgcgaagcggactggggggagctacctatagtcgactattcgccgatcagcgcgatggcctcgtcgtaatcggggcattgcggcacgccgttgaggctgtgctggatggcgatggatgccgccgcgttggcgatctttaccgattcggccagactatggccctttgccagcatcgcgcacatcacgccggtgtggcaaccgcccgccgaacgggtgtgtacggccttggtcgggtatccctcgatatgaatcgtctcgccacctggctcacgaatccaagcgccgcgggcgccgacacgcaccaccagcggcgcgcgcagtgtagcgcccaagccgtcgcacaactggtgcatgaagtcgtcaagtccgccgccaatggtgactttgctgtcgtcgattggcgcaccaagtcgctcggccagcgtcatggcctcctgacggttgcaggaccagaccgggcgtgcgagcaccaggtcctcaagcatatggtcgttgaccaaacgcaacgtattggtggggttgatcaccagcgtgtagtcgcgtgcagccgggtcggtaccggccttgagcaggaatccgtccacgccggtggccgtgtggtccatcagtgtgttgccgctgatgtgcaccacgtctttgggctgcggctccagcgtgtcgaacgtgtccgagtcgccatgagcctcggcgccataggaagcgatgaatgtcttcttcggcgcgccggagctcagcaccacgcggaagccggaatcctcatcaagacgatcctggccgatatgcgtaatgccgttgtcttggaatgactggcggatgaaatgcgcccacaggccgttgcccagaatgccggcgtgctcggtcggcacgcccatgcggctggccgcctgcagcacgcgatagctgccgccaatggagggcttcggatgatcggccacggcgaatccgccctgtgccggcaccttgtccacattgagcataatgtccacccagacttgccccagtgaaatcacgctgggctcgtgagtgccgatacctcgcttgagattcaacatgacagcctccttcgtcgtaagttgcacgaggaccccttcgtcccttgccgtctcttataccgagattatatgagagtttgctggatgcggaaaaggaaggccggcgtgttttatcgggtaaacgctatgatttgcagcgtaattcgccgctggcgaactgctgacgaactacttgcggaccgctggcgaaccaatgccgagccgctcgcgaaccgctgatggcccactcgcaagttacgctcgaaccgcgcgtgaaccgccgaggttcgcccatgatacacgcaagagttgcggttgtcggtattgggctatatatttgtgaagttgtgtgttcggcatgtcgggtgaaaccggcggtcgaatgcgtgaaagacttgacacatcaaggttaagggagtccatcatggcagctcgttgcgcagtgtgcggcaagggaccgcagaccggtttcaccgtttcccattcgcaccgtcgtaccaagcgtagcttccgcccgaacctgcagtctgtgcgcaccacgattgatggcgagaacactcgtctgcgcgtgtgcgtcaagtgcctcaaggccggcaaggttcagcgcgtggccgcgtgaatcgcgtactaacgtggagcaaaacccgtttgagcttcggctcagcgggttttgttgtttctgcggcctaaagaggccgtgcgaatagaataggccaatatgagcatcactatgggcaccactctcgcttcgctggtcaccaacaagcgtcgcgtgtccgcgctcaaatcgctgggaatcgtcactgtcggcgacgccctgacctactatcctttccgcgtcaccgaaccggtgccgcttcgcgccatccgcgaggccgcacccggccagcagatggcatttgccgccgtgatacgagatatgcgcgtggtgccgatgaacgctcgccgcggctaccgactcgaagcgacggtcgatgacgccgacttcgcccggtctcgtcgcgtacccggcagtacggcccggctcacgttcttctcgtatcgtaaatcgtatgtggattgggtcagcgtgcgactgcgcgccggcacgtctgtggtggtctccggtatgcccggcgaatacatgggtcagctgcagttcacccatcccgaaatcctcactgtcgcgcccgtgccggccggagcaggagcggggcttgagggttacgctcggggcgcggcatccggcaatggtgcgtttgcgggaagtgccgattcgtatgccagtgcgcagtccgcgtatccgccggccgcgactgccccttccggggccgcgttgaaatacgacgccgataccgtgcaagaggcgcttacccgcgtctgccggccccgcccggtatatcacgccagttcgcgtatctcgtccgaacatattcatgagacgattctgggattgctgtggatgatgggggcccgcacgtcatccacgcctgacgggcaactcgctggcgctggggcagccggcattgtggctcccgcgactgacaccatcgccgtccaaaacggggaagagaagtccggcacgaccgccgaatccggtgctgaggcgctctcccaatccatcccagatgtgctgcccgaatcggtgcgcaaggccaagaacctcatgcatcgggctgaggcgttcctggccattcatgatccggcctccacggcccggttcaaggaggccatcgaaaccctgcgctatgaggaggctttcgtttcgcagacctcgctgctgaagtctcgacagcacgcgcacaagtcatcggcgcatccttgcccgctgaacgaggcgctggaaacagctcgagcgtcggtgggcgaagcggttgcggagccaagtacgcaaccagaagcatcggagcgcggttctgcgaccgatctgcctgatctgcccaatttgcccaatttgcgcgaccgcttcatcgcatcgttgccgttcacactgacagccgggcagagtcaggtggtggacgacatcgcgtccgatcttgaacgtgactggcccatgcagcgtctgttgcagggcgaagtcggctccggcaaaaccgtagtggcgctcgcggccatgctgcaggcggtcggcgccggctatcaggcggtgctggtggctcccactcaggtgcttgccgaacagcattacgagaccatcagcaagatggtgtcggggttgacccttgcacagccgggtgccaaggagaccgatgccgcggccgacgttgagggcgcgatgggcgcgtccggtgcttcgacggtctcttcttccaaggtgactgcggaaattcccgtcaccctgctgaccggtggtatgaagcttgccgcccggcgtaaggcgctcgctgcggccgccagtggtgagccgggcattatcgtggccacgcacgcggcgttttccaagaccttccaagccccgcacttggccttggtggtgatcgacgagcaacaccggttcggtgtggaacagcgcgaaagcctcaacgccaaaaccgatgacggcaccacgccgcatctactggtgatgaccgccacgcccatcccgcgcaccgccgccatgacttggtttggcgatctcgatatttcctggctcaccgaattgcctggcggccgcaaaccgattcgtaccgtggtggtcaatgaggccgacgccgccaccatggggcgtatgttcgcgcacattcgcgcgcgagtcgacgcgggggagcgggcctatatcgtgtgcccgcgcattgatgcggatgatgaggagaacgaaggcggttccggcgtttcggcagcagccggttctgcccgcggacgcgccgcagcatctggttccagtgcccgcacagctgcgggcggccgtgcgacgcgcgcggcggccgatgccatcggcatcgacgacccctacgaaaccttcgacgaaaatggcgaaaccgtggctcgcccgccattgcatgcggtggccgaaatcgccgaccggttgcagaaacttccacagttccaaggcattcggtttgcgactctgaccggccgcgacaaggatgacgtcaaaacccaggtcatggccgattttgccggcggcgagactccgatcctggtgtccaccacggtgatcgaagtcggcgtggacgtcaagcaggccagctgcatcgtcatctttgatgccgaccgatacggcctctctcagctgcatcagctgcgcggccgcgtggggcgtggcggcaccaactcgtgggcgttccttatttcccgtgcggaacccggctccccggccgagcaacggctcgaagtgattcaccactcgctcgacggtgccgaaatcgcccaagccgacttggaattccgcggtgccggcgatgtgctcggcgacgcccaatccggcggcaagtccagcctgaagctcctgcgcgtggtcaaggacgccgacatgatcgccgacgcccgcacccgtgccgggcagcttctggccgccgaccccgaactggcaggtgaggtccaactcgccggtgccgtcctcgacttcacccgaggcaacgaaaccttcctgacctccagctgaggcacctccagctgaggctagggctgcgcccccgtaatcgcacgatatagtttttccgtatgccgatcgtgaggaaatcacggtcgggaagccctcgaatgtgcttcagtggaggcaagaccattcgtacatgaggtactcgaagtgcatatatcattggtgcgcttcgagcaccccattgttgttcatgattggtatgcgcagatgaacctgtacagtgaaagctatgcgtgtaatttctggacgattcaagggtgtggcgcttgctacgccgaaaacgggtacccggcctaccacggatcgcaccaaagaggcgattttctcgcacctcgactcatggggagtgctggatgatgcccgtgtactggacctgttcgccggtactggtgcgttgggcatcgaagcgctgagccgtggcgcgcgagaactcgtggccgtggaaagttcccggcctgcggcggcgctgattaccaagaccttggcgcagctacagaagaatcgttcgtgggatgcttcgctcaaggcccgtgtgctggtcaaaaaagccgagcaagtggctggcggcttcggcgaaccattcgacgtgatattcatcgacccgccctatgcctatgagaccgctgaatgcaatcagctactgtccgatctggcggcgggcagcgccaccaacgagaacacggtgatcatgctcgaacgctcggtacgctcggatgatcccactgcccccggaggctggcaaatcaccgaaagccgcaactacggcgaaaccgccgtcttctacatcgaatccgcggatgacgactcggatatagagcgttccgacgattccgccgcgtagtgaatctcccaccgtgtggtgaattaatcggcgagccggcgcggatgggcggcggagacctcccagcccaaggccatcagggtcttgcgatcggccttatccagcgccttgcaatccagtgccgcgataaggtctggccgaatctcggcggtgcgggccagcgcttcgtcgcggcgaaaacggtccaccttgccgtggtcgccggacaacagcacatccggcaccgcaataccgcgccacacggccggcttggtgtactggcgatgttcaagcagtgcgccctcgccggtgtaggattcctcaacaatcgaatctgggttgcccatgaatccgggcatcaggcgggtgatggcctcaagcatcaccgataccgctacttcgccgccgttcagcacatagtcgccgatcgaatattcgcgtacgtcgacgccttgggcgcggtagtagtccgggatgcgcgcatcgtagccctcataccggccgcagccgaacagcagatggtcggcatggctgagctcggtggcgtcgcgctgggtgaacaacggggccgatgggttcgggaagatgagcaccggtgcgccggatggggcgggggagccggacggctgcgagaatcccagcagttcgtccagacattcgctccacacttcgggcttcatcaccatgccggccccgccgccgactggcgtatcatccaccgaatgatgcacatcgtgggtccagtcgcgcaggttgtgcgccttgatctccaacaatcccttggcctgggctttgcccatcaggctgaggttcatcacctcaaagtattcggggaacacgctcacgatatcgatcttcatgtcatccagcctaacggtagcccctcccgcattacacggccaccactacactattgcggtgatgaatacgacgatgaacctccccacccgcaaaaagcccgaagtgttgtccccggccggcaacctgaggggcctgaaaaccgcggtcgattatggtgccgacgccgtctactgcggcggcaaagccttcggcatgcgatcggcccccaaaaaccttagccttgaggatttcgaggaaggatcgcgctacgcccatgaacgcggcgctcgcgtgtacgtgacctgcaacgtgctgccgcgcaacaacgagatcgaagccatgcgcgagtacgtcggccagctcaaagacaccggcgtggacgcgctgatcgtctccgatattggcgtgatgatgatggcccgtcaggtggctccgaatctggaactgcacgtctccactcaggccggcgtgactaattatcaggctgcgaacgccttctacgagcttggtgctcgccgtgtggtgttggcccgcgagatggacttgcaggccgtgcgtgatattcgcgccaacattcctgatgacctcgacatcgaatgcttcgtccacggtgctatgtgcatggccttctccggccgctgcctgttctccaactatctgaccggccgcgatggcaatcacggcgaatgcgcccagccatgccgctggaagtattcgatcgtggaagagaagcgccccggccagtacttcccgatcgagcagaccgagaacggcgcctatctgttcaattcgcaggacatgaatatgctggggcacttggatgatttgattgactccggtgccaccagcctcaaaatcgaaggccgcgcgaaaagcgcctactatatcgccgccatgaccaacgcctacaaaaccgcggttaatgaatacatgattcaacgcggttttgaagacgctgatggcaatgttttgaagcctttccatgaccgtgtgattcgcccgggcgaccccgattttggccaaggaaccgaagatcaagtgatgcgcaatgctgatgccgcgttcgccggtgtggccgatgagggatatgaccgtggctctgatactgcggttgccgattcggtcaccggctcggttgccgcagaacgtgaccgcgtgacggttgctgatgccgtcgactcaactgcctctggtacgccggccggcaccgccgtcgaacccgacggcatgagctctcacgcccgttccacgcgccgcaagtccaacaccgcggtcgaacagattgagaccgattggaaacatgcggccgttcgcccggccccacacgtcgaactgcccgaatggctgctcgaggaaaccgacaaggtggcccaccgcgactactccaccggcttctattacccggagcacaaggtcacacagaacaccgaccgctccgcctacttccgctcatggctggtagtgggcgaagtgctgagctggagcgcggacgaagacggacgtgtcacgctgatgagccgtaacaagattgagcccggtcaacaggtcgaattcctgctgcctggcgagagaccattggtctttaccgtgccggaaaccggcctgcgcgatgccgatggcgcgccagtacccgccatcaataatccggcgcacgtgttctcgatgccctgcccgcaccaggtgcccatcaacgccgccatccgctcgcgcaccaaaaagcccaccctcaaagccgaataacctaccactccgcccccgctgactggggggtggtcatgaaaatcatgaacaccgcccgcacccaagaaagaatgccttatgcctgaatacagcgaagaaatcctcgattccaacagcatcagctctaccgataaagccggtcgccctattccggtgaccatccccatcgcactggcccccggcatcaaggtggtgtacaccacgcgactgggcggcctgagcgccggcgattacggcaacctgaacctcggcggcaagtccggcgacgaacctgaggccgtgctgtcgaaccgtatcgcactcgccgaagcggtgcaagcccgcctatcgctggtctcccaagtacattccggcgtggctgtggacgtggacgactcgttcgtcatcaacacccccttcggcttcgacgtgtccggcacacatggtgagactgacactccgcacgtcatcgaggcggacggccaggtcaccgcacaatccggcatcgccctaggcatgttcgcggccgactgtctgccggtgctgctgggcgacccggtcaccggtatcatcggtgcggcccactgcggccgtcgtggtctggagcgcggcgtgatcggcgccacggtggacctgatgaagagcaagggtgccgacccggcgaacatcgtggccacactcggcccgcgcatctgcggcgactgctatgaagtgggcgacgagatcgccgaccagttcatcaagcgcttcccgctgaccaagacgaagacccgtttcggcggtgccggcatcgacatcgccgaagccgcgatgatcgacctcgctttcgccggtgtacatcaggtggtcgattcgatgccgcgcgtgcacgccgccacccagtaccttgaggaagacccggaactcgccgaactgtgccgtacggatggcgaaggcccggccgagctcgcggagcgcatcgacaacatcagccacagcatgtgcacgctcgaaaacccactgtggtactcgcaccgccgcgccgcgctcgccaacaaaacacacgaaggccgcctcctcgccctcatcgtgcgtgactaaacggagaatgcgagcacattccgtggagaagatgtgatgcagttcacggacggccagccctcaccctacggtggtgcctatgactgagagagatttcgatacccccgtcgagacgcctaccgtccagccggcccccgctcagggcgccaaaccggcgcaaaccgtgccggtggtggccgtggtgctggccgccggcttcggtacgcgcttcgaccccgataatcccaagcagcttgtctccgtgggcggcaagcccatcgtgtgctggagcattgatgcctttgaacattgcgaccgcgtcagcgacatcgtggtggtggtcaatcccaaggtgcgcggtgaagtggaaacgttggttggcgagatgggctacaccaaggtccgcgtcatcattgacggcggtgacgagcgtgtggacagtaccgccaccgcgctcgacatgctggctacggctggcattccggacgatgccaagattctgatccatgacgccgtccgtccgttcgtggaacagtccgccatcgacggttcgattgatgcgctcgaccagttcacggccgcaaccgtggcctacgcctcaaccgacaccgtgctgttgaccgaggatctgggcgatttgaaagtggtcaagtcggtgccggaccgcccgaacaccttccgcgcgcagaccccgcaatccttccgcttcgcgacgattcgtcacgcttacgatttggctgccgccgacccggacttccatcccaccgacgacacgcgcgtagtggtcgattatctgcctgatgaacccgtcgccattgtctccggtgcggaaaccaacctgaagatcaccacgctggaagatattcccacagctgagcgtatcgccgaggagattctcggtcgtgatcccaaggaagaggcccgcgcccgcatgcacgccctgctggcccaagcggccggccagatgcatcgctagactggcattatgcgtgaacttaatgttgtgatctccggcttcgaccactatgacggcgtggaggtcaatcccgccgtcgaagtgcccaaggccatcgccgagcagggactgggcgtctcctctgctccggacgatccgttggagcaggtcgccgtcaccgttcatgctgtcagcatcccggtgagcttcgccaaagcctggcccacgctgaaagagacgattgaggccaccaagcccaatatcgtcatcgccaccgggctcaagcacgcagcccgaggcgtgatgcttgaacgatgcgccaccaacctgatggacgcgatcaagccagacgcggacaacgtgatcccacgccgcgaacccatcgatcccaatggcccggccgcctattggacccgcctgccgttgcgctcgatcctgaatgatttcacggacgattcgattccggccaccttgagttcggacgcaggtacgttcgtatgtaattcgctgttctacaacttgctcaactggaccgccacccaggagcaggtgctgggcggattcgtcagcttccctccggtcgttccggcgcattccagccagcatggtctaccactcgaccagcagatcgccgctggccgtgatgtggtgcgcgaagccgtgcgctactatctcaagccctccagctccgacatcctcatcgcctagcacgctgtgcgccacgccggaatagaacatggttcgcacgcattgtaacgattgcgcgtcgctcaacgctcagcgctggtgcgatgcgctacagtgcttcaaggatgtgccaagagctttatgcgtgtgcgaaaggaataaacagcgatggtggatcgtttcccggtggtgctgcgaggatatgacaaggagaaggttgatgctgccttcgacgctactcaggagagtatgaagcgtgcgcagcagacgttggccagcatgcgtgagcagattgcggcggatgacgaccgtattctgcaactgcaggcccaacttcaggaagagaagaacaagaagccggaaggcaacagcttcgcttccttgggagcgaacgcccagcagatgcttgcctccgccgaacagacgagtaccgaactgctggaacgcgccaagcaggacgcgtcctccatccgtaccacggctcaggctcaggccgaaacactgatcaacaacgccaagctggatgcccagcatattgttgacgacgccaatgccaaggccgcctcgattctgacgaacgccagcaatcaagccgaatcagtgaccacctccgccaacgaggatgccgcacaactgcgctccgaaactgccaagaccatcaccgaacagcgtcagaccgtcgagcttgagctcagcaacgcgcgcgaagagcacactaagaagatggcttccgaacgctccactcaagagcgcgaaatcgccgacatgaaggcggaggcgacccagcaggttgccgcaatgcgcaaaagcgccaatgaggagatcaccaagcttaagtctgattccaacgatcagattgaggcggcgctcgccgaggccaacaagaagctcgccgacgtgcgcgagcaagtgtccaagatgatgaccgaagcccagcgcaaggccagcgaaatcattgatgcggccaaaaccaagggtcaggaaatcactgatgaggccgaggtcaagcgcaccagcacgatgagccaggtcaacgccgaggtcgagcagatccgtcacgacatcgccgctcagcaggatgaggccacgaagaaggtcaacgaactgctgcagcacctcgaagagcgtcgtgtggcggccaagcgggaagccgatgagttggtcggtcaggccaagaacactcgcgaccaagccgattcgtatgccgcgtccaagcgcgaggaggcggacatccaggccgccgcaatcgtacataaggcgggcgaggaagccgatgcgcagatcgaggagcgtcgcgccgccgcccaaagcgagcttgacggtctgtccaagcgcatcgccgatctgcaggaacgcgagtccgtcatcacccagcgtgtttcggaactgcgttctatgttctcgcaggcgttctccggattcgctttcggcggtaatgcggcggcctctggtcaggatcaggaagccgctgccgtggcggcattgccggtggttgcgcccgtcccggaagtcaagcctgtacacaacgaggccgatgaccagccgggtgagttgggcggaaacgagtcggctgccgacgatcacaatgagacagatgcggcaccggctgattcggctgattcggctgcgcagaatgagcagtccgaatcgtctgagccgtccgagcaccagacacagggcgaaccggaggccccgactcaggagaatccggccgtatctgagcagaacggcgaatgacaggccttcgattagactactagcggtaagaattacggcacctgcgctttcgagccaggtgccgtattcgtttgaatctgcgccacaagcgcaccatcacagaaggagtatgacatgagtgaattgacgcctctgaccggtgaagcgttgaataccctgcgcggcgatttcgcacagagcggcaccaaccgtctggccatgaacgcggtgaccgccgccggcatcgacaaggtggctcgcaattatgaccgcgctcgtctgatgcagcgtcgtttctccaccatcgttgacaatggcgaagccacccatcaggatcgctccggccgctgctggctgttcagctccctgaacgtggcccgtttcgtggccaagaagaacatgaacttgaaggagttcgagttctcccagaactacgcgatgtactacgacaagctggagcgcgtcaactacttccttaaggatgtggccgctctggtggctgccggagagccttccgactcccgcctgatgcagcacctgctcgccgacgtgatgggcgatggcggccagtggaccatggccatgaacgtgtacaagaagtacggcgctgtgcccaaggacctgttcccggagaccgaatcctccaagaacaccggtgaaatgaacatccagctgcgccacatgctgcacaccgccgtggcgcacatgtacgccgctgacggcgatgcctccaaggtcgaggcgattattgccgacgccactgctgccggccaccgtattctgaccatccacctgggcgagccgccggtttccttcgactgggaatggaccgacaaggatggcgaattccaccgcgacggcgagattacgccggttgagttctggaagaagtacgtgggtccggctgatcttgaggactacgtgtgcctggtggacgatccgcgcaccgagcacgccaagggcaagaagatcggcatcgagcacctcggcaatgtggctggcggcgacgccaccgagtacctcaacgtgccaaaccagttcatgaaggactgcgtcaagcagattctcgttgagcagggcattccggtatggttcggtgccgactgccacccgttcatggaccgtgagaacggcgcttgggccaccgacctgttcgagtacggccgcgtgtacgacgtggacttcgatttggacaaggaagcccgcgtgcgcttcggcgactccgccatgaaccatgccatggctttcgccggcgttgacgtggccgacgacggcaccacccgccgctggcgcgtggagaactcttggggcgccaagatcgccgacaagggctacttcaccatgtccgacgactggttcaccgaatacgtctacgaggtagccgtcccgaaggccctgttgcccgaggaataccagaaggccctcgaagagccagccaccatgctccccgcatgggatccgatgggcgctttggcctgacttcgtcagcctcccggaatcggcctgacggccaatgctgtgttttctcgcagcctgtcggctgctagggtctctccctctgtcagcgcgaagccgctgacagagggagagaccgcggtcgcaggccgcacaacaacacagcatcgccgcaggcgagtccacacaggcgagtccacccaaagtccataactgccggcccaacaagcagtccccgtaacaaactgctatagttgggcttttgcgtctatggcgacataccgacagtacgtatacaaggaaaggagtcgagcaatggcagcactacgtggtccggatagttccgaggatgaacgtcgtttgggggagcaggccgtctttcctgagaccgtcgatgtcaacattcgtcagcttgaccccattcccgcgccgcgtgctttcctcagggagcagccgctcaccgatgagatgagcgagctcgtgctccactcgcggcaggaaatccgcgatgtgctcaacggccgcgacgaccgactgctcgtcatcgtgggcccctgctcaatccacgacccgaaggccgcgcacgagtacgcagaaaagctggctgccgtcaagcgcgagttggaagaccgactcgtgatcgtgatgcgcgtgtacttcgagaagccgcgcaccaccatcggctggaaaggcctcatcaacgaccccgatctggacggtcgcttcaatattcgtaagggcatgtggctggcccgcaaggtgctcaccgacgtgctgagcctcggcctgcccgccgccaccgaatggcttgaccccatcaccccgcagtacatctgcgacgcgatcagctggggtgccatcggcgcgcgtaacaccgaatcccaagtccaccgcgaactggccagtggcctgtccatgccggtgggcttcaagaactccaccgacggctccatcaaggccgccgccgattcctgtttcgcggccggcttcgagcatcacttcctgtccattaacttggacggtcgcgtgatttccgccgaaaccaaaggcaacccggattgccatctggttctgcgcggctccagccacggcccgaactacgatgccgaatccgtgcgtcaagctctggaagacctcaaggtttccaaagcgtccggcccgagccagcatggcctcgtcatcgatgccgcccacggcaactgcggcaaagacgaaaaccgcgaagccgaagtcatcgaagagatcgctgagcgcctggcgcacggcgaacaaggcatcaccggcgtaatgatggaaagcttcttggtcggcggtcaccaaaagccggccccgctcgaccagttggtctacggtcagtccgtcaccgactcttgcgtgccgtgggaacgcaccaacgaactgctgcacaccctagccgacgccgtcaccgctcgccgctcggctaaatagctttgtctttgtaaaaatgctcactgagacccactcagtgagcattttttgccaataacggtggtcatgtcagtttgttcccgtgacaccttatccttgggaaggatactgacccaaggagagatgttatgcagcagcaggaggaagcagcacattcgctgcatccgttgcaagtcggtccgcagccgttgaacaccccagaagagcttcgcgccattcgtcaggcgatgggggaggggaagaacccgctcgttgccactgatgtgccgcgttgggaagatcaggtgggtgtcagtcgcatcatcaaccgccgcgtattggagttggagccgctgcccacgcccgcgcaagtgctcgctgaactcccgctgactgatcaggctcaggaaatcgtcgcctactcgcgtgatgagattcgcgcgtgcctgtacggccaagacgacaggctgttggtcatcgtcggcccctgttcggttcatgacccgaaggccgcgctggactacgcgcgccgattggccaagctgaaagatgagctcggtgaacagctgctcatcgtcatgcgcgtgtacttcgagaagccgcgcactaccattggctggaagggcctgatcaacgacccggatattgatggcagccacaatattcgcaagggcctgttgcttgctcgcaaaaccttgcttggtgtgctgaaggaaggattggcggccgccacggaatttctggagcccaccagcccgcagttcatctcggacgcggtgagttggggcgccattggtgcgcgcaacacggaaagccagatccaccgccaattggccagcgggctttccatgccggtcggctttaagaatgccactgacggctcggtgaaggcagcggtcaacggttgcttcgccgctgctcagcagcacacgttcttcggcattgaccatctggggcgtgcctgcgcagtcgagacccttggcaacccggactgccatgtggtgttgcgcggctcgattcacggcccgaactacgatgccgaatccgtggccaaagccatggaagacgtacgcgccgaaatgcccgccgaatccgcagcctcgcatggtctgattgttgattgctcgcacggtaactccggcaaggacgaacatcgtcaggccgaagtcgtgcgcaatattgccagcagaattgcagctggcgaacagggtattaccggcatcatgatggaaagctttattgaaggaggcaatcagaaggccgcgccgcttgatcagctggtctatggcaagtcgattactgacaagtgcatcagctgggaagaaaccgaggccttgctgcgcgagcttgcggaagccgtagccacacggcgttggcactgagttgcgtcatcggctctctcgcgggagcaatgcaacgaaacgtctctacccctcagcctgccattcggcggccacctcccctgacaaggggagccgaaagtgttgtgaaaggaacttacgtatgggtatgaaaactgtagctattattggcgcattggatgaggaagtggcgctgatcgccaaatcgctcacgcatgtgacgcacaccgccaagggcagccttgacatcgtgtccggcacggtcgactccttcggttctgacgtcatcaaggttgccgcaacggtaggcggcatgggactggtcaatgcggccgccaccacgcagctgctgattgacgagattgccccggacgccgtgattttcagcggcatcgccggcaacctcaacacccacctgcacatcaacgacgtggtgctcggcggcaccctgcgctacctcgacactgacatgcggctcgtaggccagtggaagcccggcactgcggacgctccggtggaggaattccactctgatgaccgtctgctggaagtcgccgacgaggcgcttgccaatgcgggcattacccacatcaccggcatcatcgcctccggcaactacttcgtggacacgccccaaaaggtcgaggaggtcatccgactcaccggggctgacgccgtggagatggaaggcgccgccgtggcacaggtcgccgcccgcaataacgtgccggcactggtgattcgtgccctttccgacaacgccgacaccgattacgaggtattcaaggagttcgacatctccgaatacgccgataccgccgcccgtctggctgtcgacatcgtcaagcgcctgtaactggtcacctccaagttcggcgttgccggtgtgggctggtacatggctatcatgactgccctcgctctgctcgctctgttcctgatcaaggaaagcaaggacaaggactacgagctgtaaatagagctccccatattatgctcccgccagcgggagcattttgttatgtcgtcccgccaaaaatgaacaatagacgaacttacgtagtttaggcatctcactacgcctcgcacgttttactctggaaatcatggatatctggcagatcgtcgtgattgtggtgctcgccgcgctgatactggtgtgggttgccgtcatcgcctacaacaaaggccgcgtttcaggccggctcgccgccgaacaggacctgtccggcgacgaggatacgcattctctattcggtgatgatgcgcccgtgcgccccaccgagcgtcgcctgattgaagtcctgcccgaagccctgatcgtcaccgaccgcaacggtctggtccaatattcaagccccggctcagtgccattcggcctagtctccggcgaccgactcaactcgcgtgaagtcgaggacatcctcactcaggccgccgccgacggtggcatgcgtgagcgtgaggttcagctgccggtcaatcgcaattcctatccgtcctctaatggccgaggactggaggccggccagtcacgcccgtccaacacgctgtatttgcgtgtgcgcattggcgatatcggcgatgacctgtacgccatcttcatcaacgacatgtccgagcagcgccgtttcgaggccgtccgccgtgactttgtgaccaacgtttcgcacgaactcaagactccggccggtgccatcgcgctactggccgaaaccgtgaccgacgccgccgatgatccggacgccgtacggtatttttccggccgtatctccaaggaatccgcgcgcctgaccgaactggtgcatcatcttatcgacttgcagaaagcccaaagcccgcaaagcgtgatcgatgcgcggcgcatttccgcgctggatgtggcacgcgccgccatcgccgccaatcagacccaagccgactcccgccatgtggatatccgactgagtgtcaacggacagtcagtacccacgaaggtcgaggagccggccgatggcgaaggttccttggaagaatcaggcagcccagccacgaacggtccgatgatcaaggccgacaaagaggccatgcaaaccgccgtcaagaacctcgtagagaacgccatccattactcgcccgaacacaccactgtggcggtcggcgtgggggagcgcgatggcaaagtcaccattcgcgtggtcgatcagggcatcggcatccccgccaaatcgctggaccgcattttcgagcgattctaccgggtcgacccggcccgttcgcgcgagaccggcggttcgggactcggcttggccatcaccaagcactgcgtgcaggagaacggcggtcggatttcggtctggtcgcgtacgggggaggggtcgacgttcaccatcgagctgccggccgccccggatgaggatgacgacgaggcccggtcggacgagtcgacacaagcgtagggccttggttggtgcccgacatggtgccattccattgccacacaatcacacagtgggcgaggtgcgcacaccgcgcgtagcccaattacgcaattacgtactttcgggaaacagcaggctaacggagaacaaatggttacgataatgtcggaaaactttgcgcctatgcgcacgggaacatacccaagaaaggctactatgacacgcattcttatcgtcgaagacgaggaatcctatcgcgagccgctggtataccagctcacacgcgaggggtacgacgtgtccgccgccgccactggcgaggaaggtctggaactgttcaccaagggcggcatcgatttggtgctgcttgatttgatgctgccgggcattgacggcactgcactgtgccgccgcattcgtgagcagagccgtgtgccgattattatgctcaccgccaagagcgccgaaatcgataaggtcgttggccttgagattggtgcggacgattatgtgaccaagccgtactctttccgtgagctgctggcacgtattcgtgccgtgatgcgtcgcaatcaggccactgcccaggcttccggcactgtggatgacgatattccgctggtgtgtggcgatatcgccatgcaggttggccagcatcaggtcaccgtacgcggcgaaaccgtgttcttcccgctcaaggaattcgaactgctcgaatacctcatgcagaacaagggccgtgtgatgacgcgtcaccagctgatcgaccgcatctggggttcggattatgtgggcgacaccaagacgctcgacgtgcatgtcaagcgcgtgcgctccaagatcgaggaagatccggcgcaccccaagtatctgactaccgtgcgcggtctcggatacaagatcgatactcccgcggagtaaatggaaggcggccttcgggtcgcctttttttgttgtggattgtgggctcgctgtggactcgccgcaggcgagcccgctccaaaaactacgtagcctcaacgtagcccacaaacatccaagtgttcatcttctgtttactgatttcggttttgggcccttgaaaccaccaatacgcttgtagttgtcatgaattgaccgggcagcgctgagccgcccgcgaatagttgatagagggattaagtaataatcatgcagaagaacatcctcgttcgctccattgccgctctgtccggcattgtgatgctcgcttccgtggccgcctgcggcgataacaccgccaccacgaccgacaacagctcctcctccgattccacttccaagtccaccccgatctccggcaacttctcgggcgccggcgcctcctctcagcaggccgctgttgaagcttggatcgccggcttccagggcaccaaccctgaggccaagatcgcctacaacccgtccggttccggcgctggcgtgcagaccttcctgaccggtgccaccgcttgggccggctccgacaaggcccttgccgatgacgaagttgagcagtccaagtccgtgtgcactgaaggcaccgccttcgatgtcccggtctacatctccccgatcgccgtggttttcaatctcaagggcgtttccgatgccggcaagcacatcaacatggacgctgccaccatcgccaagatcttcgacggcaagatcaccaagtggaacgatccggccatcgccgatcagaacaaggacctgaagctgcccgacaccgccatcaccgtggtgcaccgctccgataagtccggcaccacccagaacttcgtctcctacttcaaggacgtcacccctgacaactggacctacgacctctccgagaactggccgaacgaggttggccagggtgccaagggcacttctggcgtgatctccaccgtcaagcaggccgacggcaccatcggctacgctgacttctctcaggtcggcgacctgggcaccgtggccgtcaaggtcggcgacaagtacaacgagatttccgccgaggccggctccaaggtcattggggattccaagcaggacgacaccgttaagggtgacaaccgcatcgtcatcaagatcaaccacgccaccgaggccgagggcgcttacccgattgtcctggtctcctacgacatcgtctgcccggcctacaaggacaccaagcaggctgagttcgccaaggcttggctgacctacgtgacctccgacgagggccagaaggccgctcaggatgccgccggcaccgctccgctgccctcctccctgaagtccgagatcaccaagtccatcgaggccatcaagaccaagtgatgacgtcggcccgcaagggtcgtgtggactggacctgacaactgaacgatagactgtagtagtaagagcagtcgccgccaactttaagccgcagtcgtaaaccatacggctgcggcttaaagcgggtcaggacccgaacggtttggcaacgtcacagacgaaaaccgcaccacttgaatacttgataaccaccctatataaggagaatccgtgagttcgcaagacaaaacggctgtgcagccagttggtggcaagaccgccgacaaggtgtttcgcggtgtggcatacgcctgcggcatcctgatcctggttgtacttgccgctgtgttcctgttcctgttcttccgcgcctggccactcatcggtggcgatcaggccgccaacagccagaccgtgtccagctttaccggcggcaaggccagcagcttctggggctacgtgctcccgctgttgttcggtactgtgctcgtgtctttgctggcactgctgattgccttcttcgtgtccatcggcattgcgctgttcatttcgcattatgcgcctaagaagctcgccaccgcgctgagctatgtggtcgatttgctggctgccatcccgtccgttatctacggtttgtggggcggcctgattctggtgccggccatctacccgttctggaactgggttgccaaccacctgggcttcattccactgttcgagggcccggccgccaacccgccgcgcaccgtcgccaccgtggctgtggtgctcgccgttatgattttgccgattatcacctccatgtcccgcgatatcttcatgcagaccccacgcctgcacgaagaggccgcgctggcgctcggcgccaccaagtgggagatgattcgtctggccgtgctgcccttcggcaagtccggtatcgtgtccgcctccatgctggctctcggccgcgcgcttggtgagacgatggccgtgttgatgatcctgtccccgggcctcaactactccatcaagctgctgcaggcctcgcagaaccagaccatcgccgcgaatattgccgcacagtaccctgaagccaacgatctgggcgtctccacgctgatcggaactggtctgattctgttcctgatcacgttcgtggtcaacttcatcgcccgtaagcttaccgagaaagcgactgcgtgatgactgctgctgagaacactgaaaagactccgatggacggcgcgcccgaaatcgacttcgatcgtttccgcccgacccgttccgccatccagcgccgtaatatcatggaccacttcatgcgggtcctgatcgcggtggcgtttgtgatcgcctgcatcccgctgatctccctgctgtggaccactatcgtcaacggcatcaagcgcctgaacctgaacttcctgagctacaacatgaccggtgtggtcggtggtaaccagaccccgtccggtggttacggcggtgtgctgcacgccatcatcggtactctcgaaatcaccgctggcgctatggttatctccattccgatcggtttgatgtgcgccgtgtacctggtcgaatactcgaaccgcggcaagctcgccaccacggtctccctgctcatcgacgtgatgagcggcatcccgtccatcgtggccggcctgttcgccttctcgatgttcacgattctgctgggccccggtaccatcaacggtttcgaaggctccgtggctctctccctgctgatgttgcccaccgtggtcaagtccagcgaggaaatgctcaagatcgtgccgaacgatttgcgtgaggcttccttggctctgggcgttaccaagcagcgcacgattaccaagatcgtgctgcgcaccgctctgccgggcatcgtctccggtgccattctggccatcgcccgcgtgattggtgagaccgcaccgttgctgatgaccgccggctacatctccagcaccaacgtgaacctgttctccggccagatgaccaccctgccggtgttcgtctaccaggagtactcgaagctcagcgcgaactgcccgcccaacgccgacgccacctgcgtgaccacgattccgatggaacgtgcgtgggctgcggctctcgtgctgatcgtcatcgtgctgctgctgaacctcattggccgaatcgtggcgaaggtcttcgccgtcaagaccgaacgctaagccagtcgctaagcctaagccttaagaacacaaggaaatataaggaaacatcatgggacaacgtattgacgtcaaccacgagaacatctactacggcgactttctggccgtggaagatgtgaacatcaacatcgagccgaacaaggtcacctccttcatcggcccgtccggctgcggcaagtccaccgtgctgcgcaccttggaccgtatgcacgagatcatccctggcgctcacgtcgagggcgaggtgctgctcgaaggcaagaacctgtacgacaaggacgtggatccggtggccgtgcgccgcgacgtcggcatggtcttccagcgaccgaacccgttcccgaccatgtccatccgtgagaacgtgctggccggtgtgcgcctgaacaaccaccacctggccaagtccgacgccgacgatctggtcgagtgggctctgcgcggtgccaacctctgggaagaggtcaaggaccgtcttgacaaccctggcatcggcctgtccggtggccagcagcagcgtctgtgcatcgcccgcgctgtggccgtccacccgcaggtgctgctcatggatgagccctgctccgctttggacccgatttcgaccctggctgtcgaggatctgatcgacgagctcaagagcgactacaccatcgtgatcgtgacccacaacatgcagcaggccgcccgtatcgccgactacaccgccttcttcaacctgaaggccgtgggccagcccggtcacctcgagtacttcgcggacaccatcacgatgttcaacaacccgcaaaacgaagaagccgagcgctacatctctggaaggttcggctgatcgtttcctgcgcgcagcgtaatgatttgtgcgtaggagaaacggcaaagcccgccgcaaggcgggctttcgcatattcaacgcgagtattgccgagtattatcgttctcgcaacggagcgagctggaatactttgtcggactgggcggcgacttcccgcttcggtcgatcgacgggagaacggcgggtaaagcggtacaagacaagtccgcacgatgaatactccgtgataaattttctgttaacgtgcgagtatggaagaatggtcgcagcgaggtccagcaaaggagcataggtgagtactggtctgatcgtcagcatcgtcgttgtcgttattatcgttgtcttgattggttggggcgtcagcgcctataacaacctggtgacgctgaagaaccgtgtgaagaacggttgggcgcaaatcgacgtgcagttgaagcagcgcgccgacctcatcccgaacctggtgaataccgtcaaggggtacgcatcccacgagtctgaagtcttcactcaggtgaccgccgcccgcgccggcgtagtggctgcggccagcaacccgagcacgaccactgctcagcgcgccgccgctgaaaaccagctgtcccgcgccctgttcaacctgcaagccacggctgaggcatatccgcagctgcaagccaaccagaacttcatggatctgcagaaccagctcaaggaactggagaacaagatcgcctacgcccgtcagttctacaacgacgtggtcctgaagctcaacaccgccatcgaaaccgtgccgacgaacatcatcgccggtttgttccactttgaacaggcgcaatacttcgaggccgatgatgcctcccgtcaggtgccacaggtccagttctgacccgctccaggcccgtccggtaagccgccggccgggcccgtattgtcttaagagagggaagatatgtggatacgattcattcgcgccggaatcgtcagcattgttgccacggtggtgttggcagttatcaccttggcgataatcgagacttccgcgttcggcgattcggccgacctcagctaccgcacgctggactatgatgtggccgccaccgcgaacggtgatttgaaggtcacgcagcatatcgacgtcaagatgcgtgagcgtaccgacagtgacgacaacaccaagccgtggaagcagctgtttcagcaatacacgctgaactccggcaccctgactgatatcagcgatatcagcgtgcgcaacgtcacagacggcatcgactatgcccaacagagcgagcccaagctgcccagtgacgtcttttccgacaaggaatggaacagtgactacgccaaccattggtatgtcgccgatgtgagcgatggcagcgaccatccaaaggcatacacgcccggtaccgatggcctcaagcccagcgcctccgccaccgaagatgacacgaccgtggagatcggctggaatattccggtcaccaccgaggccgacagtatgaagttcgacgtgagcttcaccatgcacgatgtggccaccaaatggaaagacgtggcctccttccaatgggagccgttcggcaagaagaaccaagtgcctatcggcacggtcaccggcaccgtccacttccccaacggcatcaccggcaaaacctcatgggcatggctgcacaccgagcgcacttcggaaaccaagcgcaacagcgacggcagctacacgttcacggcctacaacatccacaatggcgactacctcgatgtggtcgcggcgttcgatgccgccaaagccaagggcatcgcccgcaagggaaccggcaatcatctcaaggacctgaaacaggacgaatataagcaacagcagcgctggctcgacaagcaacgattcgctgccagagctcgtctcgtgttctggattgtcagcatcgtgctcggcatcgcgttgtgcgcgtggggtatctgggctgtgatctccagcaaccggcgtgcgcaataccgtggcagcgtcgaatactggcgcgaccagcccggcatcagtccggcttccgcagcccgtctgattcgcgtggtcgatccgtcgacgcgccaatccgatgaagaccgccagctgaccgccaccatgctgtcgctcgccgtcaagaaggccattgccgtctatccggggccgtcggacatgtatcgcggcatcgacatgagccaggccacgccggtgggcttgagccaaatgattgccgccgaccaaggcaagcagtatgcggcaggcatcaccagcaccatcgtgattctgccgctcgccattgatgaggcacccaacgcgcaacagttgggattgagcgaatcggaagatgcgctgctgaacctgctcatcgtcatttcgcagcgcgtgggcagcccggtattcgacctgaaccagatgaaggcgacctgccagaactggcaagacggctatattgagctcggcaaattcaccggtgcatgcagcatggaataccagcggctgggtgccacgcgctctgtgggctggcaatggatcctacccggcgtattggccgtcgtgctgggatttggttcgctgctggccaacagctttatcggatacccggtggctggtcttatcgagctgccgatattcctggtcggcctgttctgctcgatggccggcgcggtgaccgtgctcaccgaccaaggccaggatatcgccggccggactctgggccttaagcgttatatggaagacttctccaacttcaccgaccgtggtgccgccgatttggccttgtgggattggtatatggtctacgccgccgcgtttggcatttccgatcgcgtgatgcgtgagctggccaaggcctatcctcaggtcaacgatccggcttggctggatgccaacgcctccaactcgttgttctactggaactaccgcccgtatggctggtacagccaccgccacaatgacgatgctgccgggcagatggacccgggcattagcggcccagctccggcttacggaggcacgtcgtttgccggcggattctccgacctcggctcgcagctgaactccggactcgctgacatcagctcgaccatcagcgcggcagcaccatccgccgattccggtggcgatttctccagcttcggctcgggcggcggctccggtttcggtggctcgttcggtggctcgggtggcggctcgttcggcgggcggtaaatccagcgttctgcttacgctggaatcggacacagaccgtctcattactgttgaagggaatcaccatggcattgttccgtaacctcggaccgttctccaccaccgccatcggccacggcgaaatgccgctgaccatcgaaaacaatcgtggccacgaggtcggcatcgaaaccctgcatgcctcgctggacgccggctgccgtcacatcgacaccgcttgggcctactactgctccggcggcgaagaacagaccggtgaaaagctggtgcgcgaggcccttgagacctggaaggggccgaaggacgaggtgctggtggccaccaaggtgggccacttccgcaacttcaccgacggccgccccacgtgggatgtggacggtcgcccggagaacctgattcgtcgcggcaaggagagcgcactggcgctcggcgtggacaccattgacctgctgtacttccaccgccccgatccgaaggtgccgtacaacgagtccgtcgaagccatcaagcagctggtggacgagggcgtggcgcaggaggccggtatctccaacgcctccatcgagcaaatcgacattgcgcgcggcattctgggcgacaagctcgtggccgtgcaaaaccagtactcgccgattcacctggagacccaggacacgctcgactactgcgccaaggttggcttggccttcgtgtgctggagcccgctcggcggctaccgtcacccctatgatgagaccaagttcgacccgttccgcgaggtcgcggcggcccacggcgtgagctaccagcaggtcgtactggcatgggagctcgccaagggcgaccacatgttcgtgattcccggcgcgcaccgtcccgaaaccatcctcgactccctgaaggccgaccagctcgaactcacccccgaagaactcgccaagctcggctgaactttctcagctccccttgtcaggggagctgtctcgcgtagcgagactgaggggtagtcgccggagtagtcccgggtagttccacaaggagataattgtgcgcaaaaaactcatcctcgacctcgataccggcatcgatgacgcgctcgccatcgcatatgccctaggcagtgccgacgagatcgatttgatcggtatcacggccacctacggcaatgtcgcggtgccgctggccgcgcgtaacgcgctggcggtactgcacttgttcggccgtgacgacgttccggtctatcccggagtcgaccatcccatcgccccggcaacattgccgaaaatgcgtggcaccacaccagacgagcgggcccaggcctacgcgcgctggcagaacggcggcgcggacggctggcaaacggacgcttcgtggtcaccaactcccggctcggtggcggtccaccattccaacggcatcggcggcgcaatcatccccgactccccgcgcgctccggaagcaccaggctcggcggtcgatttcatcatcaccgccgcgcgcgaatacggcccggacctgaccatcgtacctacgggcgcgatgaccaccatggccaccgtattccgcaacgctccggacctgaaggattccggtgtgaacgtgacgttgatgggcggcgcccttacattgcccggcaatgtaagcccggccgccgaagcgaacatctcccaagacccagaggcagcagactatctgttcaagtgtggcgcacgcaccaccatgatcggcctcgacgtgacccaccagaccgcgctcactcgtgagaaagcccatgaatgggcgtctctggggacgccagccggcgacttcctcgtcaccatgaccgactactacatcgacttctacctgaagaaccagccggagattcgcggatgtggactgcacgacccgctggccgtggccgccgcgctcgacccatcgctggtcacgaccttcgggttcaacttgcaagtcgatctcgagggcccgttccgaggccgtaccatcggcgatcgttcacggcttcaggaccccgacaaacacacgcaggtcgccttgggcgtcgatgtgccggaattcctggatcgtttcatggggcgcgtcaccgcggcggcccggtgacgcggacggcggccgtccggtccgctccacgccgtggatggatatgacccatggcgtggagcgcccttttgggaaccgacagaacataggggggcgctgcatgcgcagcgcccccctatgtgtcagatcatgccgcagcccggaatcaggccgccgggcggatcgagcgtgagatattgctcctccagatcgatgtcggggaccaaggcctccacgaacgggaccaacgcggtcttttcgaccacatcctcgcccttggaattctggccggttaccaccggctcggtcaaacgaatcttgagcagggattgggcgggggagtcgatcacatccaccactttgccgaccacttggccggcgggcagtcccagaccgttgccctcgactagacgggcctcaaggccaataagatccttgggataccattcgtcggcctcgagcatgtcctccgcatcgtcgacctcgccgtagagttcgacaccgtttagggcctcggcggcattgcggtcgtcgacgccctcaagcttgagaatccaacgatccttgaacgtgcgcgagccctcgacgatgtactcggtctcgccatcctggctgtagagcacggagtccggctcgaagcgccactcgggatcatcggtgtacaggcgcacggtgacttcgcccttcaggccctgtgcgcggccaatacgagcgaccctcagcaactcgagctgctgagggtcgtcgtgcatgtcttgctgtgccatgctgtgaatcgttccttatcggttatcgacggacgtccatgatgtcaacgcggaccttgtggtcagacagtgcctgaatcacggtgcgaatcgcgttggcggtgcggccgccacggccgatcacacggccgatgtcttccgggttcacgcgtacgcgaagcagttcgccgcgcgcgttctcatgagacttgacggaaacatcgtcgggaaaatcaacgatgttcttgatgaggtgttccacagcttgtgcaagcatagctagcctttcgtttccgctcaggcctcagccggagcttcttcggcggcctcttcagccggggcttcctcagcggcggcagcggcttcggcttcagccttggccttggcagcagcttcggacttggcggccttcagcttctgagcctggtcctcaacggccgcgatgcgggcctcggcgtccgggccagcctcaacggtcttcagggtgccttcggcaccttcaaggcccttgtacttctgccagtcgccggtgatgttcagcagcttgaagacgggctcggacggctgagcgccgacgccgagccagtactgagcgcgatcagacttgatctggatggtcgagggctgggtgttggggttgtaggtaccgatctcctcgatgaccttgccgtcacgcttcttgcgggaatcgacgaccaccacacggtagaaggcgtagaacttcttgccctgtcgcttcagacgaatcttggttgccaaaatggctctccttgtaatgctaggtgtgcgggttctcggtttgccatgtggggcatggccgtccggaatccacgtgtcctcgcggctcggggtgtagagggcgccacgcgcgcgcgaataactggcctattatagcgcacagggccggactgggcgtggcgcactgtggttgcggtgtggtgcgcgttccccgttgcgcaacattccggggaatgtatcgcgaaaatgccggctatcgcagtgcaagcgttgcggtcagggccagatgatcagtgccctcgacctcaaacgacttcacgccggacggtttgagcccgggagtgaacagcacgtgatccagctcgatgcgcggccacttgagccagctcgggaaggtgagattcgggccggcggcttgaatcagacttgcgtccttgaatccggacttgagcaacgcgcggaagctcggatggtcggtgctcgagttgagatcgcccataacgacgacgatattgcgattgctgacggattttgcacgggcgagttctcgcagacccagaatgccggccgaccaatccgcgcagccgcgcatcggcgatttcgggtgagccgaacaaagcgtcaccgtgcgattaccggaggttttgagggtgatggcgggaacgtcggcggcggggatggagaccacgttgggcaccgctgcgctcggctcgtagcgggaatagatcacgttgaatccgccattatcggtctctttggcgtctccgaactgatggtaggggagaagttcgttgatgtcggcttcggtaagacgtgtgatgaggtcgtcggtgacttcctgcaaggccaatacgctgatattgcgttcgcgaatattgcgaatgatttcagcggcgtcggcgcgtccgtatcgacaattcatcgtcataaccgagaactggggcgagagtgtttcacgcgttgtttcacagtgtccatcggagatggtttcgggcccttccttcggagtgtttgaggtacccgatgtattgctgttatggctttttgacagcgtcggcgaagttgtttcacgggctgtttcacggtgggattctttgcgtttcccggccgggtcgattgacgtaccccagtagttgatgcgctgtgagctggcaatcagcgcgaccacaataagcaacgacatcgcagtccattcatgttgccatgcggcgaccgcggccagaatcatcaaaggaacccacaacagcggcgtcagggcaatcatgtacggaagcggcatacgggcctcgagaccggcgggcagcgcgcttaaggtcgtccataacagtgcgatgattgccaccgcgctgaggattgtcgtcatggaagttcctttcgaaatataaattgaaccgagatataatttggctcccctctgcgaggggagccaagttgtgagatcagcgaccgaacagtccgccaaggcctccgccgaggttcggcggcagttcagtgccaccgtcgacgttgcccatcatctgctcaaggccagcgggcagggccgggttctgtggcttcttggcgaaggcggaaccgccggtcgaaccggaggacttgccggccagcttatcgcgcaatgccttctcctcggcctcgcgcttcatcggattgccggacttgccgcccttcttcttgttcttgcccttcttcttgccgccgcccatagccgggccgccgaagccggggatgccgccgcccatgccgccacgattggacatgcgcttcatcatctttgcggcctgctcgaaacgctgcagcaaagcgttcacctgagaaaccgtcacgccggaaccataggcgatacgggcgcggcgggaaccattgataatcgacggatcgcggcgctcggccggggtcatcgagcgaataatcgcctcggtgcggtcgatttccctctcatcgaactgctcgagttccttgcggtgctgggccatgcccggaatcatgccgagcagcgacttcattgagcccagcttgcgcacctgctgcagctgatcgaggaagtcgtccaggccgaaggaaccttcggagattttctcggcggccttgcgggcctcttcctcatcgaactgcttctgcgcctgctcgatgagcgtcatgatgtcgcccatgtcgaggatacgcgaggccatgcggtccgggtggaagacctcgaagtccttcaggccctcaccgttggaggcgaacaggatcggcttgccggtcacggacgccacggacagcgcggcaccaccgcgggcgtcgccatcgagcttggagagcaccacgccggtgaagtccacgccttcgtcaaaggccttggcggtcttgacggcgtcctggccgatcatcgcgtcgatgacgaacaggatttcgttgggacgcacggcatcgcgaatgtcgcgagcctgcttcatcagctcctcgtccacgcccagacgaccggcggtatcgatgatcaccgtgtcgtagagcttctgcttggcgagttcgatggaatcgcgggccaccttcaccgggtcgccggaggtctggcccggagctgcgacggcctcgccgccatcggattggacgcccttttcgggagcatagacgggcacgccggcgcgttcgccgaccacctgcagctgcgtcaccgcgttcggacgctgcaaatcggccgccaccagcagcggcgtgtggccggaatccttgagccagtagccgagcttgccggccagcgtggttttaccggcaccctgaaggccggcgagcatgatgatcgtcggcgggttcttcgcgaagttcagcggacggtcgacgccttggccgagcacgtcggtgagctcctcgttgacgattttcaccacctgctgggcggggttgagtgcgtcggacacctcggtgcccagtgcacgctcacgcaccttgccggtgaaggaacgcaccacgtcgagcgccacgtcggcgtcgagcagcgcgcggcggatttcacggatcgtgccgtcgatatccgcctcggaaagcttgcccttgctcttcagatgcttgaacgcattcgagagtctgtctgtcaaagatgaaaaagctgccataatgggcaacagtctagccgccacgcgggaaattgcggtgttggggacgacgcttttcggggaatgtgccgcgtagtagtcagggatgttgggcattcagacggcaaatgccgtgccgtccgctcgtggcgaagccaatcgagtgcttccgataccatggaaaccgtaaagaatcctgtgttttttggaatacttacgctgttttgaaaatcgctggacaccgcttatacgcagactgccgtgcgctccgaaccatgacgttcgggccaacgcagacatgccgtgcaataaggaaggcccactgatgcccacccaaaaactactcgaacgcaaagccctgatcgttggtatcgtcatcaacgtgctgcaggtcttagccggcatggccgtgttcttcatgaccggtctcaaggccatgttcctcgacttctccttcaccgcgatttccgtcctgtccggaatggtggcggtgtacctctcgtcgcgcacggtgcgaaccaccgagcgcttccccaatggcatgttcgcactggaacctatctacgcgatctgcaaggccattttcaccatgtcgttgttggtgtattcgctgattgacgtgtgccgagtagcgtacgactacttcgtgttcgggtccggcgaacgcattgaaaccggcccggtggtcatctacgagatcctgaccgtaatcgtgtgcttcagcctatacacgtattaccggcgctccaaccgatccatcggcgattccagcaccatgctcaccgccgagtgcaagagcacgttggtcgacggatcgatgtcgttcggcatcggcgtagttgccatcttcctgatgctgctaccggccggcggtccgcttgacttcctgcactacaccggcgatttcttcatcaccgtggctttggtggcattgaccatcaaggagccgttcagcgtgctcaaagaggcgttcgtggaattggtcggcggcgtgcatgacgacgatgaaaccaacgcctacgtggaggccgaggcacagcgccatctgcctgccaacaccgactacgagcagacgctgatcttcaagaccggtatgaactacaccgttgacgtgtatctgagcggcatcggcgaaaccattgatgtagctgacctcatcgaatgcaagcgctcgctggaaaaggagctcagcaagcgcctgcacatcgtggacgtggacttcgtgtttgactgattgatgggtttgaagcgactacttcagactccaagtggaaccctgcgggccgtcttcgatggcgatgccggcctcggtcagggcgtcgcgaatctgatcggccttggcgaaatccttggccttgcgagcttcggcacgggcgttgagctgttcggcgatcagtgcctccagcgctgcatgctcgggcgactcggccgtgccatcagcggcaccgccggcagcgccggcggacacccacggttcggccagcgggtccaggcccaaggtgtcgagcatggcacgcacggcgagcagcgcctcacgcacctcggccttggcggtttcggaatcggcgcggtcagccagctgtgaaagcaacgtattgccggaacggatggcggtgaagatcgcggcggttgcaccagacacattgacatcgtcattcatggcggccacgaaatcggcgggcaaatcgtcggcggagacggcagtgacttcctcgcgagaaggctgtccacccagcgccacaccggcacgctcgatgaagttcgagacgcggtcgtatgcggcctgcgcctcgaccagcgcctgatcggaccattcgagcatcgaccggtactgcacggagcccagggcgtaacgcaccacccaagcggaatgctcagccaacacgctcggcacggacaggccggtgcccagcgacttcgacatcttctcgcccttggcggtcacccatgccgaatgcatccagcgcgcagcggaggggtagccggccgcacgggtctgagccatttcgttttcgtggtgggggaagcgcagatccaagccgccgccgtgaatgtcgaagccatcgcccaggtaacggtgggacatggcggagcattcgatgtgccagccagggcggcccacgccaaacggcgtcgaccaacgggcgtcctcgggatcggtgtccttcggagccttccacagggcgaaatcacgcggatcatgcttgtcgggggaggcatcggccgggtcgaccggattgtacttgtcggcaccggtggcgtccacggacgggcccatgcggtcggccacggcggcggcctcatcgacttcggaggtctgcttctggtgagtgagttcgccgtaatgcggccaggatgccacatcgaagtacacgttgccggtgggcttgccgtccgcatccgtgaccacatagccgtgaccgttgtcgagaatgcgctgaatcaggtcgatcatgtccgacatgtggccggtggcgcgaggttccacagtgggcggcagtacgccgagcgtgttgtatgcctcggtgaattcgcgctcgtagtaataggcgcgggcccaccaacgctggcctgcggccgcggccttaacgagaatcttgtcgtcgatatcggtcacattacgcacaaaagtgactttgtagccgagcttcaaaaaccagcggcgcacgatgtcgaacgccacggcggcacggatatggccaatatgcggtgacgattgcacagtcgcgccacacacataaatgccgacttcgcccggcttgagcggcacgaaatggctgacctggtgcgaggcggtgtcatacagattcaggccttctgcggccttggcaacatgcaccggcgtcaggcttgaaggcatgacggaaatgttgaaatcctgcggttcttggctgtttcccataacactcaagcgtagggtccgaaccagacatgctgaatcgttactcgaagagtttgatgaacgcttcacaggtggggcccgaacgaggtgacagacggatgagaagcgggacaacagtctcgcgagaacacgtctttgaccgctgcggaaactgcgagattcatggatttgccctgctcgttacgcaaacggggaacgctcgtgccacaatagaagtcatggccacaccacaagtgctcattttgcaacatgtcccatgggaacgcccgggacgcatattgtcgaacctcgaggacatcggtcttgagacggtgacgatgaatatcgtcgacaaaaagaaaccggacttgcctgatttcggcgaactggctggcgtggtaatcatgggtgggcctatgggcgcgcttgattacgacaagtatccggggctgaaggcagaagccaagttggcgcgtgccgccgtggcttcaggcaagccgattctcggtgtatgcctggggcatcagattatcgccactgcgcttggtgcgcagctgcgcaagggcgatgcgccggagattgggttcgcgccgatcaagcgtgtggacaagcatgacttcttctccatgtgggataagcagctgacagtgctgcactggcataacgacgtggtgggcctgcccgcggaaggccagctgctgtcgcgttcgtcttccaccaaggtgcaggcattccgactgggatccgcgctgggcatgcagttccacctggaagtgtgcggctcgctgctggacgaatggctggatgagccgagcatggtcaaggatctcaaggccgcgggtggttccaagtcccaattgcgcgagcagttcgcccaatacgaccagctactgcaaccgctcgccgagcaagtgttctccggttttgcggcccgctgcaactcctacgctcagacgctgaacaaataacgtttgcgggccgccgctgggcaagcgtggcgctacattggtgagtcatgccgacttatgacattggactggaacacgtttcgctcgctttcgctaccaaaaccatcttcactgatgtaacgcagggtgtttttgaaggcgaccgcatcggcatcgtcggcaagaacggcgacggcaaatccacgttgctgcacctgttccgcggtgctcaggagccggattccggccgcgtgacaaagcgtggcggactcacgttcggcatgcttgaccagcgtgatccccttgatgacaacgccaccattcgcgaagccgcacttgaggggcgcgccgactacgaatgggcgtccgataacacttcccgtgaaatcgtcgaggcattgctcggcggcatgagcctggatgccaaggtcggctccttgtccggcggccagcgtcgccgcgccgatttggcccgactgctgctcaaggattgggatattcttgcacttgacgagcccaccaaccatctcgacgtggtcactatccactggcttgccgaacatttgaagaaccgctggtccaaaggccagggcgctctgttgctcgtgacccacgatcgctggttcttggacgaggtctgcgaatcgatgtgggaagtccacgatggcgtgatcgagccgttcgagggcggctattccgcatatatgctgcagcgcgtggaacgcgatcgccaagccgatgtgcgcgaaaccaagcgccgcaatctggctcgcaaggagctcgcatggctttcccgcggtgctcgtgcccgctccaccaagcagaagttccacgtcaaggccgcacgcgaattgattgccgatgtgccgccgatgcgtaacacacttgaactgaagcaaatggccacctcccgtctcggcaaacaggtggtcgatttggtcgacgtgacgcagattttcgaaaaaccgcagggcatggccgatatcgacccggatgtggcggcgctctccgcgtccgcttcccgcgtggatgtggtcaacgccatgtacgccgagccgcagctgcatggttccgttgaggtggcggtcaccgacatgactgacccgcgcctggtggacgccggcgtgccggaagccgtcgagtccgctgaggaagcgcgtaagaaggccgaggctgagagcggcaatccgcagcttgctgacgatcgcgaggttcgtcgcatgaacacgggtggtgaaaccatcggcggtggcactgctgcaacggattcggatgatgacactgctgcagccggtgtcacctcggctgcacgcaaggtgacggtttccggccgcgagattcttgacgatgtgacttggctgattggcccgggcgaccgcttcggcatcgtcggtgcgaatggtgccggcaagtccacgctgcttaagttgattgatggtacactcaccccgaccgcaggccatgtgaacattggcaagacggtgaagttcgcggtgctctcgcagcgcctcgatgagctggagaagctcggcaagtacaagatcaaggaagtgctttcccgctataagccgagctacattgtggatggcaaggaagtgacgccgggacagttgatggagcgtctcggcttcgaatccgcccagctgatgacgccgatccgcgatctctccggtggtcagaagcgccgcatgcaactgctgctgattctgcttgacgagccgaacgtgctcatcatggacgagcccggcaacgatctggacaccgatatgctcgccgtgatggaagacctgctcgatacttggccgggcacgttgattgtggtctcccacgaccggtacctgctggagcgcgtcaccgatcagcagttcgcgctgattggcggcaaagtacgtcacttgcccggcggcgtgcaggactacctcgatatggttgaggctattaagaacggcaagggattgccggctgacacgcctggcttcgcgggcaccggtagcagctcggcgaagtctggtaagggtaaggcggccgccgtcaacgctgccgcatctctccctcagtccgcttcgcggatagctccctcgtcagagggagccaataacggtgagaactccacctcgaagctcaccggcaaggccttccacgaggcatccaagcgcgtgaatgccatcgaacgtaagctcgctaagcttgaagagcagaaggccgatctcgaggcgcagatggccgcccatgacccgagcgactacgagggtctcaacaagctcaatgaacaactcaccgccgtcaatactgaaagcgatgatctcgaagccgaatggctcgaactctccgaacaattggagtagcgggagaaaccgtaacgttcacaaggcctcggcagtttgccggggcctcccgctatgcaaactcccacggattaatcaattccacgtcggtaccttcgaagtccttgatattgcgcgtggctatggccgcatcccaggaacaggcaattgccgcaatcatggcgtcttgaatactggtaggtgtgcccctgtgttcgcgttcgacaaggatatgggcataatccgcagctgcctgagtgtcaaatgcgaacgttctgtcctctaatgtcataagcgccagcttgacggtcgtatctgtgtactttcgtcgtttgccttcaggcatgcgacatattccggccaacaactcggcgacggtgatggcggtggttgccaaattgcttgtatcttggttcctcagccaattggcaacgtgttcgtctggctgtttcttgatgatttcgctgatgacgttggtgtccagaataatcatggccgattcctattcaaaagatactggcggtcgggaatcggcggaatttcgctcggatagtgggagttcccccttgtcgagtccctcaaaatccatgttcttcatgaattcgcggatctcgtcatagaaattggtctttcgcgtgatttcatgcgccaccgtgccagccagccattcttcaagaatggatcgcacctgagattccatggagcggttgtttttctcagccacttctttgagctgctgaatctgctcatcgggtatttttcggatggtcaatgttgccatgatgcacctccttgttgctgtcataatgctagcatgaggtgctgtcgttttgcttgcagtacgggtgatgaggtatgcacgcatgaaaaaaggcggatatgcatcatgcgcatccgccttttgagcttggactgggtcttcccgcagtcgccgaatcagcgcccggtaacctcggaaccgacgaccttttcgctcagggcgcgcgggccgcgggtcacggctacggcaccggagcgcaccagctcaatcacaccgtaatgctccaaaagccccagcagggcgtcgatcttgccttcggcaccggtggcctcaatggtcagcgattccggattcacgtccaccacgcgcacgcggaacagacgcacgatctccagcacgtcggaacggttggattcgttggcggccaccttgatgagcaccagttcgcgttccacggtggagttcgggtcgagttccacgattttgagcacatgcagcagcttgttgagctgcttgatgatctgctccagcggcacggcctccacgtcggcggtcaccgtgacgcgagagatgtccggacgctcggtgggggagacggacagcgagttgatgttgaacgcacggcgggcgaacaggccggcgatacgcgccagcacgcctgggcggttctccaccagcacggacagcgtatgacgctgggaaccaggctgggatgcaggatagttagccatgagtgttctcctctcctcagtgctcgctcgcagtggcagcggcggtctcgtgctcgaacacgccggtcgcatgctcgtccggaccggttcccggagccggggtgccgccagccagcggcttgatgccgggcttgtacgtcacctcgtcgttgggggcgccggcggctaccatcggccacaccatcgcatccttccacacgcggaagtcgatcagcaccgggcggtcgttgatctggttcgccttttcgatggcggcaatcgcctcttcctcggtgaacgcgcggatacccacgcagccgtatgcctcggccaacttgatgaaatcaggcacttcgagcggcgcatcgccgtcggccagtgccgccgcaccatcggcaccgtgcgcttcaccatcgagcaggttggtctgcgagtagtggtgctcgtagaacagcgtctgccactgacggaccatgccgtatacggagttgttcagaatcgcgatcttcaccggagcgtggtccaggaacgcggcggccagctcctcagaggtcatctggaaggaaccgtcaccatcgatcagccacaccggcttcttgccctcgaattcacgggccgagcccacggatgcgccgatggcagccggcagaccgtagcccatcgtgccgaggcctccggaggagatccaagcgtgctggttctcaaaatcgatgaactgcgaagcccacatctggtgctggcccacaccggtcacccagatggtggacggatcggccatctcagagagcttcttgatgacccactgcggggccagcgatccgtcggtcggctcatcccacgtcatcgggtattcctcgcgccagccgtcgatcgccttccaccagggggccagattcggcttgccctgaatggcctgcgtacgctgaatctcgggaatcaagtcgtcgagcacggtagccacatcgcccacgatcggcacgtcgggctgacggttcttgccgatttcagccgggtcgatgtcaatgtgaatcacgcgggcggtcggtgcgaaggcgtcgagcttgccggtcacgcggtcgtcgaaacgtgcaccgatggccacaagcaggtcagcgcgctgcacggcgccggttgcggcaatcgtaccgtgcatgcctagcatgccgaggttcttcgggtcggagtcgggaatgatgccgcgtgcgggcagggtcgtgaccacgggagcgccggtcaggtcggccagagccttgacctgtgcgccggcgttggagcgggcggcgccgccacccacatacagcaccgggcggtacgactgagagaacagcttcgccgcgtcggacagcacacggccgtgcgccttggtggtggggttgtagccgggcagaatcatgcgctgcggccatgagtagtacatgtcgccggtctgtgcggtcttggtcagatccacgaccaccgggccggggcggccggtgttggcgatgtagtacgcctcggaaagcacgcgaggaatgtcctgcgcgcgggtcacgaggaaggagtgcttggacaccgggtaggtgatgcccacgatatccgcctcctggaaggcatcagtgccgatggcttgcacgcccacctgaccggtaatcacgaccatgggcacggagtccatgttcgcgtccgcaatggccgtgaccacgtttgtggcacccgggccggaagtcacgatgcacacgcccaccttgccagtggccagtgcgtagccttcggcggcgtggccggcggcctgctcgtggcgcataagcacgaagcggaacttcgtgttgtctttgatctcgtggtagacgggcagaatcgcgccgccaggaatgccgaagacgtcctcgacgccgaggtcctccagcgaacgaatcagcgcctgggcgccagtcatcttctcgccatcgacgatggtctgcttatcgggggccgtgttgattttcggtacaccgctgaatgcctgcaaaggcgtgggtaaagccatgattcctctcacctcataggttttgtcgcgaacctgcccgaccttgggatggggccgggtgcccgcgtgtctgattccagtcgcttccccgagacttgtggccccggcgcgactcgtcgctcatgttggtattagtctattcgcaaatccgacagcgggcttacttagtccgcgtcttgaacgagtccagtgacttccagcccgcttcggcggccgccagctgcgccttacgcttgctggagcccttaccgatgccgatgatgtcgccgttctcgcccaatgagacgcgcgcggtgaagatctgcgcgtattccgggccggagacctccatatggtagacaggctcctccttgccgaggccgtgcgccttgacggtcagcgaggtcttccagtcaagtgccgggccctcggtggccacttcggcgagcgtgtcgtcaataagccggtgaatcaccttgcgtgcctcgtcgatgccgtgttccaggaaggtcgcgccgatgagcgattccacgatgtcgcataggatggagttcttctccgcgccgccctgctcggcttctccgtgacccagcagaatgtaggggcccaccttgagcttggttttggcgatggcgctcagcgcgtcttcggagacggccttggcgcgcatcttggccagttgcccctcggtcatatccgggtgaatggtgaacagcgtttcagtggagaccagttcgagcaccgcgtctcccaggaattcgaggcgttcgtaattggccacgccggggtgctcatgcgagaaggaacggtgggtgagtgcctgcacgagcagatccgggctgagagtggtgcccaacgcttcaagaagctcgttggccggcgtcggctgctgtggggtttcattactcatgattgttgtatggtccttcacgcgatggtgatgtgttgtgttgtgttgtttgcgatgcgatggtgtacgcaatggtgcacttatgcgaagaccccgccacccgtcgatggcagggccttcattcaagccgttatcgcaggactcacttggtgtgagccggctggatggcggagcggtaggtgcggccgcggtagttaccgcagctcgggcaagccatgtgcggcagggccggagcgccacagttcgggcagttcacggtcgcagcagcggtggccttccagttcgcgcgacgcgaatgcgtgttggcgcgcgaggtcttgtacttaggcagtgccatttgagtatcctctatttcgttcgaacaattgagcttaagcgtccgttatcttaacgcacggctcgtacaaacttcgttcaggcgcgcgtcacttggcctgctcgccgttctgctcggcctcgagctgggctttgagccccgccaatccggcaaaacggatatccgtcacatcgtgatgatggtcgggatcctcgttcagatcggcaccgcactgcgagcacagacccctgcaatccggtcggcacagtggttgcaacggcagcgattcgaccagcgtgtcgcggatcatcgcctcgatgtccgcgaatgcgccgttctccagcagcggatacgtgtcttccgactcgtcctcgccggcgatgatgtcgatttcgtcgtccttcttgctcttgccgcccttgccgttggccttgtcctgacccgactcgtacgggaagaacaccgtcacatcaaccggccagtcctcgtcaatcggcttcaggcagcgcgtgcactcgctgacgaatggcgcgaccaggcggccggtgaagatcaggccgtccacaatcgaatcgaactgcccgctcacgtgtacgggctcaccttccttgatgccgacaatgctgtcgccaatgccggaaggtgccgggaaatcggcgtcaatcggcttggattgaccggcgcgcgaagcaatctgcgctaccggaatggcccacggggaatcttcaactcgtgccatggtatgttcttggtgcctttcgtatgttggctggagttattcgttactggcgttatttcgcgttactgatgttgccggcgttgctggcgttactgggcttcgggatagtcgttcagcgtcaggtgcggcatctgttcgcgggccgcgcgctggcgctcttccagcacgttaagaccggcctgcacatcctgactgagtttgccgagctgctgggacagcccttccatcaccgtagtgcagtactggtccgcgccttgggtcagatggtcggctttggtctgtgcctggtcaagaatcgcgcgcgctttctgccgtgcaagctcggtgacgttctcttggccggccaggaactgtgcctgttcgttggcgtccctgatcatgttggctgcgcggctttgtgcggaggcgacgatggcgttggactgggtctgtgccgattccagacggcgctcggcctcgcgcatgagggcggaggcgcgctccaactgcaccggcagcattttcttcaactcggaaagctggtcggtgaattcgtcgcggtcaaccttcaccatgccgggggcgaatatgctggacttcgcttcgcccagtgccgcctcgagctggtcgatgatgtcatacaccgtggtgaattcctcgtggctcttgaccgtggccgggtcgtcgtccgtggtttctcgcaggtcgggcatttcgttcatgaacgaggggcgaatgccggcggcctgagcggtctgagcctgtgcccgggtctgctgagctgcttgggcctgcgctttggcctgcatttgtgccggagtaggggtaggcgcggcgggcggcgatccggcgagaacatcggcctcttcggtgggtgccggcgcggcttgcgtagacgcgggcggttccggggcggacggctccggagtggacgatgcggcgtccgcattcggtttggtcagatcgacgtatccagtagggtggtcatcgctcatagtcattagtgcatcagtccttccgctgacgttcctcggccagggcatcggccagcatcggcacgacgcaatcgggcaccatgccggtcacgtcgcctccatggcgggccacgtccttgacgatggaactggagatgtgttcaagaatcggatcggccggcaaaaacagggtttcgatgccagcgagcttgcgattgaccagcgccatgccgagctcggcttcatagtcgccgttctggcgcagacccttgatgataacggtggcgccgaccttcttgcagtagtcggtgatcaggccgtcggtggaagaaacggtgacgttcttgcaaccggctttgtcaagggcgcggcggatcacgtcgactctggtggcttcggaaaacatcggtgttttcgcggcgttgacggccaccaccacatgcacctcgtcgaaaaaccgcgccgagcgctcgattacatccaagtgtccggcggtaacggggtcatacgagccggggcatactgcgatagtcatgctttatagcctaccgctagtggtgtgcttcgtgctgccgagcgtgcattgttgtcgcgtcggcgtatgaggcagtgtgtgcggtgccgtatgtggcgtcggtgtggcgtcgtgtgcggcattgtatgtggcattgtatgtggcggggtggcgtgatgcgcgacatgggtgtgtggaggtgtgcggattacgcgccaatgggtttcgcgggtaacgacgggaatctatgatggagtgcagtcgaatcgttgaatacgaggaaagaagtgcaccatgacttttgccgagatgttcgttgatgatgccgaaccgctgcgcaacccggaccaaggtgccggcacgtcggtgctggagcgtccggagaccaaggagtcgccggttcgtgacgatggtggcgacgccgatcgttttgcgcactacgtatccaaggaccgtatcgctgaatcgcgtgcgaccggccgcccggtggtggccctgtgcggtaaggtttgggtccccaagcacgacccgtccaagtacccggtttgccccgactgcaagcggatttacgaggaaatgacgcgctaaaggtggtacttggctcccctcagcgaggggagccaaaatggtcaccgagccgaaatctcgtcgatcagcttgagctcctcgtcgctgaagtgggtgttcttcagcgcgccgatgttgtcgagaatctgctgcggcttggaggctccggtcagcacggaggtcaccttgccgtcgtgcagcagccatgccaggctcatctcggccagcgtctggccgcgttcggcggccagattgttcaggtccacaacctgcttgtgcagtttctcggtcagagcggaatcgttgaggaatcgcggatcgtgagccatgcggctgtcggccggaatgccgttgagatagcggttggtcagcaggccctgagccagcgggcagaaggtgataaggcctttgcccagcttgaaggcggtctctttcaggccgttcttttcaacggtgcggtcgaggatgttgtacttgttctggttgatgatgaacggcacgtgcagttctgccagaattgcggcggccttttccatcgtcggaccatcgtagttggacagacccacgtacagggccttgccggagttcacggcctgagccagcgcgcccatcgtctcctcaagcggggtttccggatccgggtggtggtggtagaagatgtccacataatccaagcccaagcgttccagcgactggtcgaggctggcgagcaggtacttgcggctgccgaggtcgccataggggcctgtccacatttcatagccggccttggtggagatgacgagttcgtcgcggtgatgtttgaagtacttggcgagcagcagtccgcagttcttctcggcctggccgggttcggggccgtagttgttggctaggtcgaagtgggtgatgccgttgtcgaaggcggtgaagaccagggacttcatctggtcgaatggcgtgatgtcgccgaagttgtgccagaagccaagtgagacggccggcaacttgaggccggaggtgccggcacggttgtaggtcatcgtgtcgtaacggtgcgggttgggggcatagatggcggttggctcgaacattgagtctccttacaatgtcattcttgttcttacgaatgcttacctgcgatgggcagaccgacgccgattgagcggtattcgtaagtgttcttggatactatggttccagttcaagtgaacttgaatgcaagcggctgcgacgcttcggcgtgttgccgcagtaaggagtcatgatgtcctacaccattcgtcaggtggccacgcagttccatatgcagccctctgcgccggtgaagactggccggattggcgcgagtacaaaaaccgcgcctattccattgaatgctgaggccatcgagtgctgagctggatgccggctgggcactaagaccgatgtgcgtcgatcgtgggcgcgtctatccgagtaaggccttgctcggcagtgcgcggtcgagcagccagacaacgagcgatatcacgaagaacgctatggccagcttgccgcagctaatgccgaacccttgccagccgagtgcgtcgaggttgatgaagtcgtacggatacggactgccgccggccgccggtccggaccccggccaaatcgccgcacgggccagcacgaagaccaagtatgcagggaagtacgccagccacgagaacatgtaatgccagcggaaacgccggtgcgggtcgaatagcacgaaatcgataaccgccataatcggggcgattttgtgcagcatcgtattggtcatgatgccaataacctgtggcacgtatgccgggtcgtccggaggcatcaggaagaacgccaccagtgcggtgactatggcgtacacagtcaggcaccccttaagccatgcaggcggctgaatacctttgagcagtgtggccgcgccggaccacagcatcacgatgcccagcacgaaaccggtctggaacgtgaaatacacccagaactgcggtttggaccatgcctcatatgtgcccacgaagcagaaaccggcgatcgcaaagcgccacaacgccacgatgaatctcatgcatcgagtctaccgcttcgccagtgggctgtatggctttgcccggactacacttaggtgcaacttcaccacttatgtaggaaaggccttgcaatggtcgattattcgccggctctgatgaccgacatgtatgaatacacgatgctcgacgccgctctgaaagacggtaccgccgaccgcaagtgcgtgttcgaggtgttcacgcgtcacttgcccgaaggccgtcgctatggcgtggtggccggcaccggccgcattctggatgcgctggaacatttccacttggatgaagcggatctgaagttcctggccgaccgtcacgtggtaagccccgagaccattaagtggctggagaacttccacttttccggtacgattcgcggttaccgcgaaggtgagatgttcttcccgaactccccgattttgcaggtcgaaggcacgttcggcgaatgcacgctactggagacgttgattctatccgtgctgaactacgattccgcagtggcctccgccgcctcacgtatggcgtcggcagccaaggatcgtccttgcatggatatgggcggacgccgcactaacgagtgggctgccgtggccgccgctcgagccgccgtagtgggcggattcaagggtaccgccaatctgctggccgcccagctgtatggtctgaaggccattggcaccgccgcgcattgcttcacgttggtgcatgattccgagcgtgacgccttcgaatcgcagatcgaggcattgggcaagaacaccacgctgctggtggacacctacaacatcgaggaagccgtgaaaaccgccgtcgaggtggccggtcccgaactgggtggcgtgcgcatcgactccggcgacctagccgccatggcccagcgtgtgcgcaaccagctggacgccctgggcgccacgaacaccaccattaccgtgaccaacgatttggatgagtacgcgctcgccgcattgcagaccgcgccggtcgactcctatggtgtgggcaccatgctggtcaccggctccggcgctcccacttgtgcgatggtgtacaagctcaccgaacgtgaaggcgctgacggcacgatggttccggtcatgaagaaatccaaggacaaggccacagtgcccggtcgcaaactggcattccgctcctacgaatacgcgttagccgaagccgaacacgtgatttccggctcggaggagaagctggccggtttcacgcctgaaccgacgtggaagaacctgctggtcgactttgtggatcatgggcagatcgacgctcagtggcagggccatgacgccatcatggccgcccacgactaccacgccaaggcgttgtccgaactgcccatcaccgcgcagagcctcatgaagggcgagccagtgattcctacggagactcaggtcctctgaccgtatctcactggccgcatccctttggttacattggctactcttccctctgtctgtgttggccgcactcctgtggtcgccgccgaggcggggagatccaaccccggtcgcacccccgtgtttgcaccccctgtggctgtgtcccggggctgtattggccgcgtcccctcgggctgaactgcgtcccggttcgccggacgtggttccagctgagggtggccccggcagattctagtggtggttgcaacacctggggtttgagcggccttccatggtcacgttgtcggttgttgaggttatcacgcggcgtcgagcagttcgatgatcttctcgcttggtttcatgaaccttcggatggcgttgtgtctcatgggctcggagatgtgtataagagacaggaggggtgcgttgacggtgacgtgttggcgacggtgaacatatcggcggcaggagaagataagctgttctcaggggaacatcagcacaacaaaggagttacgcatgcgagatttcattttccacaacccggtgaagatctacttcggcaaagggcaggcgcgccatatcgcacaggaggtggagcgtgtcgagggcgccgttctggtggtgtatggcggcggatcgattaaacgcaacggtgcctatgacgatgtgatggctgcgctggcaggaaccgggcgcaaaatcatcgagctgcccggcgttacgccgaacccgcgattggacaaagcgctggaaggcgtacgactggtcaaggagcatggcgtcggcctgattctggccgttggcggtggctcggtaatcgactgcgcgaaatttatttcgttgggttccggcatcggtgacgatgaggatttgtgggatgactacatcgaaaccggcaaaccggcacctgaagggctgattccggttggcgtggtgctcaccaccgcggcaacgggctcggaaatgggagatgcggccgtgctcaccaattgggaacgtaaccgcaagctcggctatacgtcgttcccgctgatgcccaggttctccgtgctggatccaagctacctgatgacattgcccgccgaacagacggtgtatggcttcgaggacatgttctgccacacgtgtgagcagtatttctcctatccggtggacgacaacctttccgacgaaatcgccgagggaatccaacgtcatattctgcgttcgtggcgagcgtgcttgtccgatccgaaagattatgaggctcgctccaatgcaatgtgggattccacgttggctctgaaccgcattatctcgcgcggcaaggaagaggattgggtgacgcacggcatcgagcacgcgctgtccgcatacaccgatatcgctcacggtgctggtctggctgtggtccacccgcattggatggcatacgtgtatttggtcaacgatgaggtgacggctcgctttgcccgctgggcggtcgacgtgtggggtgtgacgcccaccggcaaaaccgatcgcacggtggccgaggaaggcattgatcgctatgtcgatttcctgcgtcgcgtaggtgcgccgctgactctttctgaggccggcgtgcccgacgatcccgcctctctcgacaagtacgccgatcatgccggtgaggccggcggctcattcgtgcagattcaccgtgacgatgcccgagcgattctcgaggcatgcaaggaaccggtgtcgttctgacggttggactaatcccgtgatttgagccgccgcgtgctgtcccgcaccaccaaagacgtagaaagaaccacgcgcttctgaatcttacgtccttcattggtatcgatgaccatgcgggctgcagtggcggccatgtcttgcaatggctggcggaccgtggtcaacgccgggcccatgtacgcggcggtctgtatatcgtcgaatccgataacggacagatcttcggggatacggattttcagttgacgggccgcctcgtaaacgcccatggcctgtaggtcattgcctgcaaagatggcggtcgggcgactttgttcgtcttcaagtaacgccatggctccttcgtaaccgcctggcgtggtgaaatcgccttcggtgatgagttcgggagaggtggggatattgcgttcggcgagggccgccgaatagccgtcaagccgggcacgtgagcagagcatttcatccggtccggtgatgatgccgatgcgcttgtggccgagttccagcagatgacgggtggcgatgacgccgcccatccagttgtccgcctgtacggagagatcatctaatgccggattgccggaagggtcgaagacgacgaaaggaatgccgtgtgattggaacatgctgcgttccttgtccgtcaagttggagaacaccagaatagcgccaatgggctggcggtcgatgatgccttcaacccaggaagagtcggggtgctgccggtcgccactttccgcaaccatgacattgatgttgtgcggcttggcctccgtgatgatgctcctgagcacctccagcgcccaaatggtctcaaaatcccgaaataccacctcgatggtgcgttgtttacgggagagggagacgcggcgaatgtagccgttgtctttcagggctttgtcaatggcctgccgggccgcctccgaaatatccgccttgccgttcagggctttggacacggtggccagtgagtagccagtctgtttggcgatgtctgcaagtttgaccttgttctcgccgttgcttttgcgctgttctgccgacgccatcattgaccgccttcatcagagaatgttgatatcagtatattcgaaactttcgtaaagtcaatttgacgataaagaatggtatgtatagataaaaaaggttggaatttcaacgattttgatagtaaaaaagtcgatataaatttcgtttgaccgtcaaactaaggctctctatgatagagatatcgaaaacataaagcgagttttcgataaagttaaagaaggttgatggaataggtgaaacggcgaggtttcactgaaaacatcattaattaccagctgttagatatgtaaccggctgatatacctttcgaaactttcgtaaatcgcggatcggtttcatgctggtcaagaacaataaggagacgataatgaagttcaagtccgtggccgccgcacttctggcggcggtaacctgtgtcagcatggccgcttgcgggagcggcggcgacacgaatgccgatggcaaggtggaaatcaccatgtggcacaactccaccactggcgacggcaaggcatactgggaatccgccgccaaggcgttcgagaaggaaaacccgaacgttaccatcaagattgaagccattcagaacgaggatatggatggcaagctgcagaccgctctgcaggacccgaattccgcccccgatatctttatggcgcgtggtggccagaagctacgtgatgtggtcgaagctgggcaagccatggacctgaccgacaagatctccgacaccgtcaagaaccagatggccactgctgaagccaccggcaccatcgatggcaagatctacagcgtgcagcagtcagtgcttcccggcggcatctggtattccaaggatctgttcgagaaggccggtattactgaaactccgaagacctgggatgagttcaagaccgtggtgcagaagctgaaggacgccggcatcacgccgattgccgtaggcggtaaggacgcctggccggccgcccactggtggtactggttcgcactgcgcgaatgctctgctgacaccttcgacaaggcccagtccgataaggacttcagcgataagtgctggacccgtaccggtgatgatgtgcaggcgctgctcgacctcgatgccttcaacgatggcttcctgaccactccggcccagcagggcgcaagctcctccgccggcctgctcgccaaccacatggcagctatggaactcatgggcggctgggagcccggcgtgatcaaggacctgactccggacaagaaggacatggccgacctcggctacttcgcattcccgaccatggacggtggcgaaggcgatccaactgccatcatgggtggttccgatggcatggccgtgggcgagtgggcgcctgaagaggctgtggacttcctcaacttcgtctccgagaaggaatggcaggagaagtacgctgaggcgttctccaccatcccggccaacaaggaagcccaggatgtggtgaccaacgaggctctgaagcaggtgctgaccgtctacaacgacgcatcctccgtgtccatgtggctcgacaccgtgttcggtcagaacatcggcaacgcactcaacgaaggcgtggtcaacatgatggccggtcaaggttccgcccaagacattgtcaagggtgttgaaaccgctgcggccaagggctgattcgctctgccccgaccgtaattcccgggccgcggcgaatgcttgcacagcaacaaccgcggcccaatttgttttcttaggaaggcctcaacaatgtcagtttcagcaggcgcgaaggtacagcgccgcacgtcgggcttaagcgacaaggttcgcaaacgtatcgaaatcaccatcctttcgcttcctgccctgatcatgttcctcggattcgtcatcctgccggtgttcatggccggctactacggattcttcaagtggaagggctatggcaagcccaccgtcaacggccagttcatcggttttgaaaactacaaggtcattctgaccgacccgaacttccagcaggcattgggacacacgctattcgtggtcgtcgcttcgctcgtcatccaggggccgctggccatcctcttcgccctgctgctcaaccagaaattcaagggccgcgcactgattcgtaccctgattttcgtgccgtacgtcgtttccgaagtcatcgttggcaccggctggagtctcatcctccagaccacaggcgcattgaacgcgctactcaagaaaataggacttggcggggcggactggatctccgatccgaaaatcgccatctggacattgatgttcatcatttcgtggaagtacatcggcttcgccgtcatcctgatgattgccggcatgcagtcgattcccgaagacctctatgaagccgcgaaggtggatggtgctggattctggcgtcagcagtggagcatcaccctgccactgctcggccccaccattcgtatctgggcattcatgtcgattatcggttctcttcagctgttcgacttggtctacatcatctggggccagtacgtgtcgtctaccgcaggaacgtccaccatggcaacctacatggtgcgcgaaggtcgactcgccaacaactatggttacggttccgccgtggccgtggtgatcttcatcatctcgctggtcattgccttgacctaccagcggttcgtacttaaccgagatctcgaaggtgcgctcaccgacgagaaggatgccaagcgtcgtgccaagcgtgcggcgaaggaagcggccaagcttgccaaggccaatggcaatgccgcagcagttgcaaatgaggtggtttcacaatgacgaccgcagtctccccgtccgtgggcaagggcaagaacaagacctatgatccgtatgcattgagaaaatccgcaaagaccccgtggggcaacccggtcgtctacttcttctcactgctgcttgtggcgctgtgcgttggcccggtgctgtacatcattatcggcggcttccgcaccaatgcgcagattacgagggacccggccggctggcccgatccatggaactttgagaattacaagacggtgttcacttcgaacatcttctggccggaactcgtcaactccctgatcgtctccattggcacaatggtgggcatcgtggtgctggccttgatggtgagcttcgtcattgcccgatacgagttcaaattcaacaaactgctgtactcgctgttcgccgccggcatgatgttccccatcaccgtggccatcaccccgttgtatctgctgctgcgcaatctgcacctgatcaactcgcatctgggcattattctgccccagatagcattcggcctgccacaggccatcatcatcctggtgccattcctcaagtccattcctaaggaactggaagaagcggcagagctggacggctgttctcgcatcggcttcttcggccgtatggtgctgccgttgagctggcccggcgtggccaccgtcggcatcctgagcttcgtgagcagctggaacgcctacatgctgccgctgttcctgctcaacgattccagcaagtacaccttgccgctcggcgtgcagatgttcagctcccagcattcggtcgataccgctcaggtactggccttcacctcgctgtcgatgatccccgcgctgatctgcttcaccattttccagaagaagatcgttggcggcctgaccggtgctgtcaagggctagtcgcagcaaccataaccgtgccgtggaaaggtacatggctctttgggccgattcctttcaacctcttcctttcctcctttccacggcccctttcttttcaatgaggagaagaccatgaagatctccaatcccgtactccccgggttcgatgcggacccctcgatgattcgcgtcggcgacacctactacatcgcaaattccacatttgactggtggccgggagtccgtttgcatgaatcccgcgacatggttcactggaatctgctgcccgggcccttaaaccgcgtttcccagctggatatgaagggcaatccctccggtggcggcatctgggcaccggacctgtcttatgcggacggcaaattctggcttatctacaccgacgtgaaaatcgtcaacggcgcgttcaaggattgcgcgaactatctggttaccgccgacgacattcgtggtccgtggagcgatccgattcgggtcaatggcgtcggattcgacgccagcctattccatgataccgatggacgcaagtatctggtgcagcaaacctgggacttccgtgaatatcatcatccgttcgacggcatcaccttgactgaattcgatgtcaaaaccatgcaattgaagccggaaacagcccgcaccatctggcgcggcaccgatgtgaaattggtcgaaggaccgcacctctacgccatcaatggctggtactacctgttttgtgcggaaggcggcacccaatacgagcatcaggagtccgtggcccgttcgcgaaccttggatgagctttcgttcgaaagcatgccgagcaatccgttcatctccaacttcgatacccccggcacctacctgcaaaagcaggggcatggagcactcgtggatacgcccggcggcgaatggtattacgcttcactgtgcggcaggccctggcggcacgagaacgagccggctcatggcgtgcgcggctggtgcacgctcggccgagagacttcgattcagaaggtcgagtgggatggcgatggctggccgtatgtggtcggcggccatgggggagagcgttatgtcgaagccccggccgacgccatcgcaactgaggcccctacggatcatagccagcatgacgagttcgaatcgagcgaactcgacctcaactggaacaccctgcgtgtgccattcaccgagaccatgggccgcgtgggcggcggctcgctgaccttgcgtggtcaagggtcgctggcaaacctgtttgaactgtcgctggtaggacgccgttggcaggcgttcgatttcaacgccgaaaccaaggtgacgttcgagccgagcaactacatgcagatggccggcctgaccaacttctacaaccacctatgctggtcgtgggtgttcgtcacttgggacgagaagcgcaacaaacgtgtaattgaagtggctcagaacgacttcgacacgtacacgtcgttcctcaaagacacagccatcgccattcctgatgacatcgaatccgtatggttgcgaaccaaagtgcgtactcgtacctacacctacgagtattcgttcgatggcaagacatggcatgagattccggtgacgctggacgccgccgtgctctccgatgatcatgtggcccaacgttatggcggattctttaccggcgcgttcgtcgggttggtggccgtggacctttccggatacggcaaagaagccattttcagccatttcgattacatggaaatatgatgacgccaggcggctttcctgataatcagggaaagtcgcctgactattcggcactggggaatgaaaggcgacacttgtggcaagcgacaatgaacattgcggcgaccgtggccgcgaatgtaccataaccgtctccaacccggtgctgcgcggcatgtacccggacccgtcctggatctgggatgcgacgcgcgaggaaatcgtgctggtcaactcctcgtttgaattggtgccggggttgcccattcatacgacccgtgatcttgtgacgtggacgcacacggcgaatgcggtggatgaggcgatgtctcatcgactgctcattgatggcgtcgaggattccggcggcctgtacgcgccgaccattcgccgtatcggcgggcgatatgtgatcgtatgcaccgtggcccgcgtgaatgaggtgaaggcgctcgctgcaggatgctcgcagaaggatgtcgatggctgtcgcgccgcccaaggcaatttcgtcatcgaggccgatgagttgaccggaccatggcgcggtccgtactgggtggccggggccgaaggcattgacccggacatctttgaagacggcgatggcacagtgtggtggacgcaaacgcgcccggcattacatccgcagtgggatggtcaaaccgagatctggacgcagcccatcgccccaggcacgtggacgttgcaagaccataaaaccgtgatttggcgcggctatggcatggatgcggtatgggctgaagggccgcatttgtaccgggtgggcgattacctctacctgatgaccgccgagggcggcaccagcttcgagcacagtgagatgataatgcgcacgcacgcaccgcgcggattcgcggcggcgctcgccggttttgagaagaaccttgccgcgcaagatatctggattgagccggcgcgtgacggtgaacgaagcgtggtgggtcacgataaccggctgtttgaggcttgcaaacgcaatccgatcctcacacaccgtcatttgggagcgggggagccggtccaatgcgttgggcacgccgatctgctgctgcatccgaccgtcggctggctgctcgcgtgtcttggcatacgcgagactccgggcgaggaacccggagaaacgttcagctactgtggccgggaaacgttcgtggcaccggtcgtatggcagcacaatccggtctcgtggaagctggacggtggggagccgaataagcgtatcgatatcgtcgatcccggttggccggtcgtggctccggggcttggccggcttcccgagaagttggtcgtggacgttgacgaggatggattgccatgtgcagtgaggggtgtggattctgcggggtgtgattgcgctgctggtaataatgccgcatgctctgctgagctcatccagctcgacgatacccgcctagtcggcgttcgaggccgtgacgattaccggttcctgcgtgtcgacgggcaggaatatgccgcgttcacccggcccgaatacacgatgatgatgcatcaggattccacccatgctgtcatggtcatggcggaagcggaatccggccaattgacggccgaaatcaccgataggggagataagcggtgcattgcgcttggagcgcttggggccaacgaatggttcggattgcgcttgcatggcaatcgtttggaattccttgccgggcagcctgcacctgacagcattgatgagggaacaatgcctgatattgcactaattgcgcacgcggacgttacttatgctcgtatcatggcagattgtgatgcgcgattcctcagtaccgaatgggccggcggattcgtgggttgcctgatcggcgtaaaacgacggtaatggtctcagcccgctctacaatattgtacaatcatattgtttaatcgttaaacaaatgcaagggggggcaatcgatggcgcacgatctcgaacaactcaagcaagatcacccggatgtggcgaaactgttcgccgatgactggttgcagtaccgtaagtcggagattttgccggaacttacgcgcgaggcgcagtccacgtgcgaccgcatcaatcgcatctactttgaagacaccgccgaagctgagcgactgttccgcgaactcgtgcccgaggccggcgagggcgtggacttccgcccgccaatccggcttgattacgggctgggcctgaaaatcggagaccgtacgttcatcaacatggacctgctgattgtgggcggcggcccgatctccatcggctccgattgcctgatcggcccgcgcgtgagcatctatacgccaaaccacgccatcgcccgcaagcctcgactggaaggctggcagcacaacgccgacgtgaccatcggcaacaatgtgtggctgggcggcaatgtggtgatctgccccggcgtcaccatcggagacaactcgattatcggtgcgggcgcagtcgtcacccacgacattcccgccgattccatcgctgtgggcaatccgtgccatgtgattgccgaagtcccggatgactggactcctgaagagcgggccgctgccgagggtcggtaggtttgctgctctggccaactgtcacggcgaaaccgggatacaggagagaaaggaacaatgcaatgacgcaatatcatgtttccgcgcaggcggcgaagacgaacggcgccggcagcgcggccgacccgtttctgaccatcggccaagcggcggccatcgcccgagccggcgatgaggtggttgtgcatgccggcacctatcgggaatctgtcgacccccgattcggcggagagagcgccacgaaccgcatcgtctaccgcgcggccgcgggcgaaccgcgcccggtaatcaccggctccgaacgtatcgacacatggcagcccgaaggcgatggcgtgtggaaagccgtaatcccgaacgcattcttcaacggatacaacccgtacgtggaaaccgtattcggcgattggaccgtatacccggacccaaaggtcgaggtacgccacctgggcgatgtgtatctgaatggcaaatccttctacgaagtcgcctcgctggacaaggtgcgcaacccacagcgttgggataccggccgtgacgccgccaccgattccatcgtgccgctgattgatccggatgccaccgtgaacgtgtggtgctgtgcggtcgatgatgaggccacaaccatttgggccaatttccatgaagccgacccgaatgcggaacttaccgaaatcaacgtgcgcgagacctgtttctacccgagccgcccgttcgtcaattacattacggtctccggctttgaaatggcgcaggcggcctgcccttacacgccgccgactgccgatcaggtcgggctggtgggcccgcattggtcccgtgggtgggttatcgaaaacaatcgcattcatgacgcgaaatgttcggcgatctcgctgggcaaggagatttccaccggcgacaacgaatcgacgcgcacccatcgtaagtccgggtaccaataccaaaaagaggccgtctacaaggcgctgcatgccggctgggagaaaggcgtagtcggcgggcacgtggtgcgcggcaacgtaatctacgactgcggccagaatggtgtggttggtcatatgggctgcgccttctcgctgattgaaggcaaccacatataccgcatcggctccaagcgcgagttcttcggctgggaagtggccgccattaaaatgcacgcagccgtcgacacggtggtgcgcggcaaccgggtgcatgattcggtgctgggtatgtggctcgactggcaggcgcagggcaccgtggtggattcgaacgtgttctaccgcaacacgcgagatgtgatgaccgaggtgacccacgggccgattacgtttatgaacaacgtgtttgcctccgagttcagtttcgacgattatgcgcaaggcgcggcgttcgtcaacaatctgttcgccggtcgcattcgtcacaccgccgtcttggaccgatccacgccataccatttcccgcacgtcaccgatgtggccggcgaggcattcgtctacggtggcgatgatcggtacgtcaacaacctgttcttggctgtggacgattccgccaaaccgttgtgtaccgcggatgccgccggtgcggccggtatggcggaagctggaaccgcgttctttgacggctatccgcgctcgcttgaggagtatgaacagctgattgaagaggctggccttggcgatgaggagttgtatcgcagcgtgaagcagccggtattgctggcttcgaacgcctatgtttcgggcgcgaaggccgcttccggcgaagccgaggccgtggtgagtggtgacggctcttcgttggcattgcgcgaaaccgatgatgagctatggatgaccgtttcgttgcccgaatcgattcggtcggcaactggaccggtgatctccactgctgatcttggccaaccgcgtattgtcgaggagtatttcgagaatcctgacggttcgccgattgttgtggaccgggatatcaccggtgctgcgcgcggcgcatgctcggctcgaggcccattggcggcgtatggcgatggggaagtgctcatctggtcgaagtgacgggatcgcggtttcgactgttgcctctgcctcggcctttgtgtggcactgagtggggctgggctgccagtatttggcaggccggccccttttcgatttgcattggtaacaaatatgatatatggttaaatcattaaactaaatactgtaagtccatgcatacctacgcaacgtcaatggagatactgctatgcgcgcacatcatgttctgctgctgtcgctctgcctgttggccgcagcctacgccgtactgctattcgtttcaccagccgctgcgccgattggcgtcacgctaaccgttgttggtctggtgctggtctcgacgcgctatgcgtggcgcgccaaattcctggctctattcaacgaagcatgatttgatgaatcttcttcctctcttctccttttaagcccggccgctcgccgggctttttcttttgaccgaggtcgaagtggggaagggtgtgctatgggcactttcgtgtcgggggtgccgtgttctcgacaacggcctaccgacttggggtgtatttcgacaatatgattcggcgatgtgcctcagcggatatgtgcggccaatgaaaaagcgggataccgatgtcgatatcccgctttcagcgaataggtaaggccagagcttacttcttcctggctttcttgacgcgcttgggggtgggagccattttcttgggttcgaagaacggccacttgtgcaaagcccaggcgtgcagtgcggggatcttggcaacggcgaagccgatgaccagaccgattaccatggcccaggtctccagatcatggcctgcgaccagcaagccgatgaacactatggcaacgatgaagctcaccatctgcgaggcctttgactgcttggcggtcaccaggtcggccttcatgggaacaagccccagaaacaggccgcaaggtatgcagatgacggccaatatcgcgctgagggttattgacaatgtggttgcatccatgatgttcctttagtgctgtgggttgtggttttctttggcgtctgcggtgtcggtgtctgcggtgtcggcaacgtcgtcgtgttcgttttcttcggcttgttcggcttcggcctcggcgtccgtgctgtcggtttcgtcgtcatcagccgcgtcatccttgccgggctggcgccaccacaggattagcgcgttggccgcgcagtagatggccgcgatgccaatgcataccagaaaaatgatgttcgaagtgctgatgatcgtgccgtcgttcatcgactctttgacagactgccatatccacatcacgcaggcgacggcggtcagggcgtacagcatcatacgggagcggtcgttcataggatcatctccagacttgttcaaacgacttgattatagccgtatttgtggattgcgtgggaaacgaaaaatgccgccatgtgtgcttcagcgaggagcgcggtataacagcggctcttcgcgatgctcgccatggcggcattcatcaggaatcgttattcagttgttatctcatggatttgctggcagcgtatcagccgcgggccttggcgtacgcctcatacacggcttcggtgggctcgccggtctccacgccctcgatggtgagctgccaggtcggcggttcggcctcgccggacagcacccaggcggcctgacgggcggcgccgatggccacgtattcgtcggtggccggacgggtcacgtccatgccgaggattgagggggccagcgtgcggatggccacggacttcgcgccgccaccaatgagcaggatgcggttgatctcggcgcccagcgagcgaatcagctcgaggcagtcgcgctgggaacacagcaggccttcgacgaacgcacgggccagattctccttggtggtgttgtgtagggtcaggccagtcagcgaggcggtggcgtccggacggttcggcgtacgctcgccgtcgaagtacggcaccagggtgatgccgccggcacccggctcggccttgaacgccagttcggccagttcgtcgtagtccacgcctagggcggcgcgaccggcgtccagaatgcgcgaaccgttgattgtgcaggcgagcggcagatagtggccggtgcagtcggcaaagccggaaatggcgccggtcaggtcgtacaccgggttttcagcgatggccgcggccacgccggaagtgccgagcgatacggacacatcgcccacggccatgccgaggcccagcgaggccatggcattgtctccgccgccggggccgatgatgcagccgccttcaacgtccttgccggcaatggcggggtcggccttgacggcggctgcctcacgcgggcccagcacggtgggcagcacaatggcgtcggcgtgggccttggcggcttcctcgccctcggcaggggccagcaccatggcgatgagatcgcggcggtactcgtcatgcgcggcatcgtagtaaatggtgccggaagcgtcggaacggtcggtgaacagggcttcgagatgagcgtcctcgccctcggccaccgggccatagccggcgatacgccagctcagccaatcgtgcggcagacagacggcggcaatcttcttggcgttctcaggctcgttctcggccacccacgccaccttggtcagcgtgtaggaggcgacgggggaggatccgacggccttgacccagcgttgcttgccgcgggcggtcacgtcgtccggttcgtcgccctcggccggagctgcaccgagcttgtcgatcaaggcggcggcctgcggggcggaactggtgtcattccagagcatcgcatcgcgaatcacgttgccctgcttgtcgagaatgaccatgccatgctgctggccgccaaccgcgagggccgcgacatcgtcaagcccgccggcctgctcggcggccttggtgaaggcctcccaccagaattccgggttgaccgaggtgccatccgggtgcttggcctgcccgaaccgaacctgttcgccggtggcggcgtccgtgatgcggaccttcgttgattgggttgacgtatctacgccggcaaccagtactctcgtcatgcattcctcctcgatgagggtcgcgctcaaaagtttcggcgcgccatagccaataagttagacgattaaactatactgtatctcaacgttcgattgcaaacggaaacacgcgaaggtgcggtccgattcaatcgtttgacgcacaatatcatggtgtgatagacggatgtgagcgcctgtgcggcgctcgagactaggggtgcgaggaggtaggggccaatggcaaatctacgcaggatcaatcaggaggatctgcgcaaccataacctgtcggtgacgctcgacaccttattgcgtgcgcagaaaccgatgagtcgtgccgatctggccaaggagacgggcctgaccaaggccacgctctcgctgttggcctcgatgctcattgaaagcggcgtggtgcaggaaggcgagccggtcgtttccaccacatatgggcggcccagcacgccgctggagattcgcggcggatccatcgccggcatcggcctgcagatcaacaccgatggttacggttgcctggcactcgatctgaacggcgacactctcggccgggagtgggtgagtgaggatatgaccggcactgacccgtacgagatcttcgccaagctcgatgcgatgactttcccgttggaaagccggctcaaacgacgcggctgcaaggtggtgggagccgggtttgcgctgccgggcatcgtcaccgacgacatgtggctgttggtggcccgcaatctgggttgggaaaacgtcaacctcacccggttcaacgtggtgcgccggctggatgtggtggccggcaatgaggcgaagatggccgccatcgctcagattccggggtatgccaccgaacgtgcgcccttcctgaatgtggtggaccgcacggactcctttatttacctgtctaccgatatcggcatcggcggcgcggtggtgcgcgacggcgaagtggtgatgggctcgcacggattcgccggcgagatcggccatctgtccgtggcgatggatgggccgttgtgcagctgcgggcgtcacgggtgtcttgaggcgtttgcgggccgtcgcgctttggtcgaggctgccggcattgccgaggatggggatgccaccagcagcgaggccatcgatatgttcctccagcgttggcgagccggggattcggatgtggccaaagtggtcgatcaggccgccgatgcgctggtttccgccatcgcttccgccgtgaatctggtggatgtcgatacggtgctgttgggcggactgtggacgcacttcggcgacgagctggccaccgtgcttgaaggccggctgcgttcggaaattctgggatacccgaatgtgaagattcgcgtgtttgtgccgccggtggcgctgcatccctcgctatatggcgcggccgaaatgggcttgcgacggttcatcgagaacccgttggggtacatgggggagaagtagcgccgggagatgctgcttgttgctggcgggtgcatggtatgggtgcatggcgcgcgtgccggcattagcgggctcgtgctacactttggcaagttggctgttttgtgcagcgaacgtggggccgtagctcagtcggttagagcatgcgactcataatcgcccggtccagggttcaagcccctgcggccccactcttttgcgtcgtctcctgcggcggcgcagcgcgtcttcacgtccagataggcgcgtacaatcccttaggttccggttcacgtcttgccataggggcatgacgacccgggtcccccgaatccataggagacgtaaaatgcagcagggtatccatcctgattatcaccccgttgaggtgacgtgctcgtgcggcaacaccttcgtgacccgcaccgctggcaaggaagatcacatgttcgttgacgtgtgctctcagtgccacccgttctacaccggcaagcagaagattcttgacaccggtggccgcgttgctcgcttcgagaagcgctacggcaagaagagcaagtagcatacttcacgccagtccgattcgatttggcatgctccggcatacccgatcgaggactggcgttttttgtattctttgacaagttttgttgcagcattgacctgcgcaatcgaataatcgaacagaacagcaccatacagaagaaagtgtgttatggcagacgaacagttcccggcggcggcaaccgcgcttgaggagtaccagtccatcgaagaacagatggcaagccccgaagtcgtgtccaacccggacaagctgcgcaagctgggtcgtcgtcacgccgaactgggtgccatcgtgggtgcctacaaagcctggttgcaggtgaaggacgatctggcagccgctcaggagatggccggcgaggacgccgacttcgccgaggaagccaagcgtcttgaagccgaactgcccggtgtcgaggagaagctgcgcaccgcgctgatcccgcgcgacccggatgacgcgcgcgacaccatcatggagatcaaggccggcaccggcggcgaagaagccgcactgttcgccggcgacctgctgcgcatgtacacccgttacgccgagaagcgtggctggagcgtgaacgtgcagtccgagaacaccaccgagctcggcggcgtcaaggacgtgcagatcgccatccgcgccaagggcacgcccgctcccgaagacggcgtgtgggcttcgatgaagtacgagggcggcgtacaccgtgtgcagcgcatccccgtcaccgaatcgcagggccgtatccagacttccgccgccggcgtcatcgtgttccccgaggccgacgaggatgacgacgagatcgagatcgatccgaaagacctgaaaatcgacatcttcatgagctccggccccggcggccagtccgtgaacaccacgtattccgccgtgcgcatgacccacctgcccaccggaatcacggtgaacatgcaggatgagaagtcgcagattcagaaccgtgccgccgcgttgcgcgtgctgaagtcccgcctgctggccatgaagcatgagcaggaggccgccgaggccgccgacatgcgtcactcgcaggtacgttcgcttgatcgctccgagcgaatccgcacatacaacttcccggaaaaccgtatcgtcgaccatcgcacgaactacaaggcttacaaccttgacgccgtgctcgacggcgacctgcaggccgtcatcgattccgacatccaagccgacgaggccgaccgtctggccaatcagaaatgactttgccggatggctcccctctgtgaggggagctgtcagcgaagctgactgaggggagcctaatgtccgatcaacggagaccgccagtgcttattaccgacatcatcaaccaagcctcttcgcaattgcgcgaagcgggtgttgagacgcctgagcatgatgccaagttgctccttgccgaggcggcaggcgttgaactgcgcgacgtcgacagggctctgcttatgggggaggaacttggcacaaccggacagcttgccgtcttccgtgccatgctcgaccgccgtgccaagcgcgagccgctgcaatacatcaccgggcatgctcctttccgctaccttgacctgaaggtcggtcccggagtgttcattcctcgtccggaaaccgaaaccgtggtgcaggccggccttgactggctgacaaaaaacggcatgatccatccttgtgtggtcgatttgtgcgccggctccggcgcgattgggctgtccgttgtcagcgaggtgcccggcagccaggtgtgggcggtggagctgtcgccgaacaccaccgaatggacgcgaaggaatctgtcggaaaccgcgaaaaagtacccatccattgcctcgaattaccatctggaaatcgcggatgccacgtccttcgccacattggcccaattggacggcaccgtcgatatcgtcatcaccaatcccccctacgtgccgcagaccgatattcccgagcagccggaagtgcgtgattgggatccggaattggctttgtatggcggctcgatggacggtacgttgattcccgagcgcattatcgagcgggcctgccgtcttctcaagcctgggggcgcgcttgtcatggaacatgacgtgacccagggggatcgtctcgtggcctttgccagggccaccggattcgctgccgcatcgaccggccaggactggacgggtcgcgaccgctacctgtttgcagtgtcctaagccccacgaatcccacatttccttgggattgcattctcgtttccgtaattgcgctgtctcataataagaacactttattgcgggttcaaagccggtctggttataacagtccgcgacaaacatcggatgagagagacgtggatgacggtcacaagccgtgtgatgtagttctgtggtatgcgaattatgtgagtggaacgtctcacgcgcacatcccgcgcgttggttgacagatgaacgatgttgaaatatcccaaggaagaaggaagaggatgaacgtgaagttctccactaagttcgttgcggccagcgcggccgcggttatggcgttgtccctcgcgggctgctccggcggcagcatggatgattcctccagctccggtgccaaggcctccggcgactccatcaccatcggcaccgtgaccaccaactccggtaccgccgccgcttacggcgaggccgaggtcaagggcttcgagctggcggtctccgagatcaacgccaagggcggcatcaacggcaagaaggtcaagctcgagtccatggacgacaagggcgacgccaccgaagcctccaacgcctacaacaagctcgccggcgacaacaacgtgctcgccgtggccggcccgaccatttccgccaccaccgcagccgtggccccgctggccgaccagtccaagctggtcaccatcgccccggccgccacctccgactccatcgaaaccggcaattacctgttccgcacctgcttcaaggactcctaccagggtgaggtggctgcacgcttcgccgccgagaacctgaaggtcaagaaggtggccgtgctctacggcaccggcgatccgtactcctccggcgtgggcgaggccttcgccaaggccgccgaaaagctcggcctcgaagtggtggacaaggaaagctcctcctccgccgacgacaccgagtactccgcccagctgcagaagatccaggcttccggcgccgagctgctctacgctccgtactactactccgtggctggcccgtacatcatcccgcaggcccgctccgtgggtttcgagggctacgtgatgggacccgacggatacgatggcctcaagctcaccggtgacaagtcccagtacaacaagacctactacaccacccactactctgccgacgacaacaccaacaccaaggtgcaggacttcatcaagtcctacaagtccaagaacaacgccgagccgaacacgttcgccgctctgggctacgacaccatctacatgatcaagcaggccatcgagaaggccggtaagaacgccacccgtgaggatgtgcgcaacgccgtggccagcatgaccttcgacggtgtgaccggcaagttcaccatggacaagtccggctcgccgaccaagtccgtgatcgtgctggaaatgaaggatggcaagccggtgtacaacaccaccgtgcagcccaagtgaattccatgaattcccaccgcataatcacgatgtcctagcgtgacttccgcatgaacaggagagcgaccggttttgccggtcctctccctttcgtgttttcacgggctcggatgcataaggacagccgccgatatgcggatatcgccaggcgcgggcgtatcgcgccatcaatcgcaagacatacgaatatctctacgcgcgcagcggtagagaaccacaacattgatagaaagggggagctatgaccgatcagatcatcatgttcatcagccagctgttcaacggtctgaaaatcggcagcgtgtacgcgctggtggcattgggctacaccatggtctacggcatcatccgactgatcaacttcgcccacggcgatttcatcatggtcggagcctacgtgctcatgctcaccattccggccatcgtggccatgggactgcccgcctgggtggcggtcattcccgccatcctggtatgcgtggccgtcggcgtgatcgtcgaaaaggccgcctataagccggtgcgtgaaaagggcaactccatgaccgccctgatcaccgccatcgccatgtcgttgctgctggagaacggctcacaggccatcttcggcgccgacttccagaccgtcccgaccatcttccacctgccgtccatcgcgttcggcaagctcaagctgccgggagacaccctgctgaccatcgtcatcggcctggtcatcatggtgggcctgcagctgttcgtcaaattcaccaagcagggcaaggccatgcgcgccgtctccgaagacaaggaggccgccgtgctcatgggtatcaacgtgaactccaccatcgccctgacattcgccatcggctccggtctggccgcggtcgcctcgctgatgtactgcgccgcctacccgcaggtctcgcctatgatgggcgccatgctgggcctgaaggcgttcgtcgccgccgtgctcggcggcattggttccatcccgggcgccatgatcggtggtctggccatcggtctgatcgaaagcctgaccaaggcgtatatcggcaccatcacggcgggcatcatcacctcggcgttctccgacgccatcgtgttcgccatcctgatcatcgtgctgctcgtcaaaccgtccggcattatgggcaagaacgaaggggagaaggtctgatcagatgaagaagacaatgctttccaccaaacagtcctatctggtgtgcttcatcggcatcctcgccgcgttcggcatcgtgatggcgctgtgcgaatccggcttggccgactcctacatcaagggcatcatgatgaccgcgtgcatcgccatcatcatgaccacctccctgaacctcaccatcggcgtgctcggccagctgacgctgggctgctgcggtttcgaggccatcggcgcctacgtggccgcactgacctccaaatacatggtcgccgccggcattgccatcgaccccaccgcccgcttcctgctcaccacgctgatcggcggcgtggtggcctgcgtgttcggcatcctgatcggcattcctgccctgcgactgcacggcgactacctggccatcatcacgctgggcttcggtgagatcatccgcgtgatcatccagaacctcaaggtagccggcggcatgggcctcgacaagggcgccgccggacaggcgctgatcggcatcgaacgcaccgccaacctgtacgtcgtgttctggatcatggtggtcaccgtggtcgtgctcttcatgttcggccgctcccgttacggccgtgcggtcaaggccatccgcgacgacgagatcgccgccggcgcctccggactcaacaccacgtacctcaaggtgctcgtcttcgcaatctccgcgttcttcgcgggcatcgccggcggtatcttcgcccagtacatcggctcgctcaaccccaccatggccggttggctcaactccatcaactacgtgatcatggtggtgttcggcggcatgggttcgctcaccggctcgatcgtctccgccatcggcctgaccatcctgcccgagctgctgcgcgccttcgccgactaccgtatgctcgcctactcggtggtgctggtgctcgtcatgatcttccgcccgcagggcatcttcggatcctgggagttctcactgccgcgtctggtcaaccgcatgctgttccgcggcgccgccggcaagggcgcgaaacccgcggccagcgccaagcagcatgaccagtccgacgacaagaccgtgaaggaggcctcacgatgagcgacgcaacccagcccatcctcaaagccgaacatctcggcatcaccttcggtggtctgaaagccgtgtccaacttcaacatgaccatcaacaagggcgaactcattggcctgatcggccccaacggcgccggcaagaccacggtgttcaacctgctgaccggcgtgtacaagcccaccgaaggcgagttctggctggacggaacccggatgaacggcaagaagacctatcaggtcgtgcgtgccggcatcgcccgaaccttccagaacatccgcctgttcaagcagctcaccgtcgaggagaacgtgctcgtcgccttcgatgagtcgttcacctaccacatgggcagcgccatcttccgcaccccgggcttctggaagcaggagaacgagatgcacgagaaggccatcgacctgctgcgcatcttcaacctcgagggactggccaccacccaggcggccaacctgccgtacggccagcagcgcaagctcgagatcgcacgcgccctggccaccggcatgaaactgctgctgctcgacgagccggccgccggcatgaaccccaccgaaaccgaggatctgctgcactgtatcaacacgatccgcgaccgtttcggtatcgccatcctgctcatcgaacatgacatgagcctggtgatgagcgtatgccagcgcatccaggtgctggactatggccgcaccatcgcatccggcacgccggaggagatcgccaacaacccgcaggtcatctccgcctacttgggcagcgacaacaacgatgacgcggacggcgattccaccaccaaggcggaaccggagccaagcattgccaagacactgacggaaggagcgcgctgatgctggaaatcaaggatctatgcgtttcctatggcgcgatcgacgcggtcaagggcattagcctcaaggtgaacgacggcgagatcgtctccctgatcggagccaacggcgccggcaagaccaccaccctgcacaccatcaccggtctggtgccggccaaatccggcagcattacctatgatggccacgatctgctcaaaacgcatgcgaacaagatcgtcacgctgggcatggcccatgtgccggaaggccgccacgtgttcacccgcatgagcgtgcaggagaacctggagatgggcgcgttcagtctcaaagaccagtccagtctgggtaaggatcttgagatggtgttcgactacttcccgcgtttgaaggaacgtcgccgccagctgtccggcacgctttccggcggtgagcagcagatggtggccatgggccgcgccctgatgagccatccgaagaccatcctcatggatgagccgtcgatgggtctgtccccgctgctggtcaaggagatcttcgacatcatcgtcacgctgcgcaagcgtggcatcaccgtgctgctcgtggagcagaacgcgaagatggccctgtccatcgcggatcgcgcctacgtgctcgagaccggcaagatcaccatggagggcaaggcctccgacctgctgcacgacgagaaggtgcgcaaggcgtacctcggcgcgtgacgtctcacattactatgctcccgctggcgggagctacctcacgaagtgaggctgagggtggttatcggagatttccggcaaccaccctcagtcagctccgctgacggctcgccagcgggagcattcatatatcactgcgcgtaatactgtagcgcggaagcatccttatccgtaatctcgcgaatcggacgggccggattacccacggccacggtgtgcggcggaatatcgcgcgtcaccaccgagccggcaccgatcacgcaaccctcgccgatcgtcacgccgtcgattaccgtcacattgccgccaaaccagcagttcgagccgatgacaatcggcttgccatactcgcagtcgtatgcggaaccatcaggtgcctgcctcacgttacgatcctgccaacgcaacggatgcatcggtggcagcagcgaaacgttcgggccgaacagcacgtcgtcgccaatcgtcaccgggcaacaatccagcacagtgaagttgaagttggcgaacacgcgctctccgatggtgatgttgcagccatagtcgaagaaaatcggccccatcacgtcaaggccggcaccgtggccgggcagcagctcatcgagaatcgcggcacgggcggcatgatcggtacgcgacgcggcgttgaagcgcgcgcacaggtcgccggccttctcgcgcagggcattcaattcagggtctaccgaattgtacagtttgccggcgagcatctcctcgcgctcgctggcgcgcggcatacgcagttcgacgggaggcatggtggtggattcagcattgatttcgctcattgaacactcctgtaatttcgcgaaagagcatggatggactcattgtatctacggtctgtgcgtgtggggcgaatcggaaaacggcagtacggcaaacgagcgatgatgaactatgcaagtcggggcgcaatggtgcaatggtagattgtgaatacacaagcgaacggaggtggcgtgagcgtggaaggcggaacaacgctgaaagtcacggatgaatcgctggcacaggcggcgcgtgtcatccgggatggtggattggtcgtcattccaacggatacggtatatggagtggcgtgcgatccgcgtaataaggccgctatcgaccgtatctaccggctcaagcgtcgcccgcgctataaggcgttgcaggtactgctcgcatccaccgaccagcttgatgagctcggtctcgacctgccgtccccgctgaatcgtttgtcggcggcgtttctgcctggcgcgttctcgccgattgccgtagcccggcccgactgcacgttggagactttggccgacaccgccgatggtcgccccggcacgcaaggcatccgcatccccaattcggcgctgtgcctcgcgattctcaaggcgactggcccgctggccgcgtccagcgccaaccgttccggcgacgaaagcgcgcagaccgtccaggaggcggttgacgcgttcggcagcgaagtcgacctgtatctggacggcggtcccacccaaggccatgtctccagcaccgtcgtcaaagccgatccgtacgcgcgcgacggcatcgagatcctgcgtgaaggcgtcatcgcccaaaacgtgattcgcaaggccctccacctcaacggcggtggactcggcgcatgagaatctacctactgattgccgccatcgccggtggcgtcacctggctggtgactccgctgattcgccacgtcgccatcgaaatcggtgcggttggcgaggtgcgtgcccgagacgtgcacaccattcccacgccgcgcatgggtggccttggcatgctgatcggttttgccgtggctaccgtattcgccagtcggctgccttttctctcgggattgttcaacggcaattaccagatgtgggtgattcttgccggcggcatcatgatcagtctgctgggcatggccgatgacctgtgggatctcgattggatgctgaaacttgccggtcagctgctgatttccgtattcgtggcttggggcggattgcagatcatctcactgcctttgggcggttcgctgattaccgcctcgccgagtctgtccatggcgatcaccgcattcctgattgtcgcctcgattaacgcggtcaatttcgttgatggcctcgatggcctggcggccggtatcgtggcgattggtggcatagcgttcgccgcctattcgtatatcatcgcccggtcttccccgagttatgcttcgtcggccacgctgatcgacgtgatgatggtgggtatctgcgtgggcttcctgctgcataattggcatcccgccaaactgtttatgggtgattccggttcgatgctgcttggctatctcatcacctgcgcttcgattgtgatgaccggacgtcttgacccggcctcgattcatgccagcatctatctgccggtgttcatgccaattctgctgccgattctggtgttgttcctgcctgtgctcgacatgtgtctggcgattgtgcggcgtttggccaaaggccagtcgcccatgcatccggaccgtatgcacctgcaccatcgcatgctgaagatcgggcattcggtgcgtggcgccgtgctgatcctgtggggatgggccgcgctgatcgcattcggttcgctgacgattctgttcttcaaagcgcagcatgtggccgtgggcatgcccatcgccgtggtggtgctgaccatagccacgatgtacccctatctgcggcatcgtattcccgagatccaagccgagaacctgacgctcgaatccgcacgcaagaacgcgcagcatgctacggttaagtcgcagtctgcagtaggggagagccgggattcgattggctctcaggcagcggattcgatgactgattcgcctgcggattcgcgggactcgcaggcgggtgaggtgcaggacccggcagcggataagtgagcgctcacaagcgtgtgtcgtgaaggtcagcgcgtgttcatatagtgtttgtatggctacaaacctcgatgaattgaacgcccaatcggcgtatgctccccttcctccgattttcgccaagctcggccttgcttatgatgatgtgttgctgctgccgaacgagacggatgtcattccctccgaagtggacaccagcactcatctgactcgcaagatcgtgatgaaggccccggtcctctccgctgccatggataccgtgaccgagtccgagatggccatcgccatggctcgtaacggtggtatcggtgtgctgcaccgcaatctgtccatcgacgaccaggccgctcaggtcgatgtggtcaagcgttccgagtccggtatgatcaccgacccgctgaccgtcaaccccgaggtcactctggccgacctcgacaagctgtgcggcaagttccacatctccggtctgccggttgtggacaaggaaaacaagctcgtcggcatcatcaccaaccgtgatatgcgcttcatcgcctccgaggattacgacaccctgaaggttaaggatgtcatgaccaaggagaacctggtcactggcccgtccaacatttccaaggacgacgctcaccgtctgctcgcccagcacaaggttgagaagctgccgctcgttgacgaggaaggccacctgaccggcctgatcaccgtcaaggacttcgtcaagaccgagcagtacccggacgccaccaaggatgagcagggtcgtctgcgcgtggccgccggcgtcggcttcctcggcgacgcctggcagcgtgcctccgctctgatggaggctggcgtggacgtgctcgtggtcgacaccgccaacggtgaggcccgtctggcactcgacatgatttcccgcctgaagcacgactccgccttcgacggcgtgcagatcatcggcggcaacgtcggcacccgctccggtgctcaggccatgattgaggctggcgcggacgccgtcaaggtcggtattggccccggctctatctgcaccacccgtatcgttgccggtgtcggtgtcccgcagctcaccgccgtgtacgaggctgcccaggcctgccgtgccgctggcgtgccctgcatcgccgacggtggcatccactactccggtgacatcgccaaggccctcgtggctggcgcttcctccgtgatgctcggcggcacgctcgctggctgtgaggaagccccgggcgagaaggtgctcctgcacggcaagcagtacaagctgtaccgtggcatgggctccctcggtgccatggccccgcgcggcaagaagtcctactccaaggaccgctacttccaggccgacgtgacctccagcgacaaggtcgtgccggaaggcgtggaaggcgaagtgccgtaccgcggaccgctgaacgccgtgctctaccagatgctcggtggcctgcaccagtccatgttctacatcggcgcccacaacatcgccgagatgccggagcgtggcaagttcatccgcatcaccgacgccggtctgcgcgaatcgcacccgcacgatatcgtgatgaccaccgaagccccgaactactccggcttccacaacaactgatcggttgatgcccgctagcttgcgctagttaggggttgattccttgtgaaaagggtctgcttatgcaggcccttttcgcgtatgtggctcgagatagcttgtatgcgctggggtatagtctgaactgttcttgtaataacgggtgacatgacgaaaagaggcttaccatggtcgacagccatgatgcagaaacttacagcgcaaaggattcgcgcctgatttggattgactgcgaaatgacgggcttggatatcttcggcggcgacgaactcgtcgaggtgtccgtagtgcccactgactttgacctgaatgtgctggacgagggcgtggattacgtcatcaagccgtccgagaaggccgtgaaccatatgaacgatttcgtgcgccagatgcacacccgttccggcctgatcaacgagtgggagaatggcctgagcctggccgaggccgagcagaaggtcaccgaatacgtgctgcgcttcacgccggaaggcgtgcgcccgctgctggccggcaacaccatcggctccgataagaagttcctcgaccattacatgccgaacctcatgagccacctgcattaccgcagcgtggatgtgagcacattcaaggagctcgcccgccgctggtacccggccgtgtacgagaaccgcccgccaaagaacggtggccatcgtgctctcgcagacatcatcgagtccttggacgagctgcgctactaccgtaaggcgtttatggctcccgcccccggcccggacgatgccgcatccaaggccatcgccgccgacatcgtagccaccagcatcctcaataagtagtccgccgtacttggctcccctccctgaggggagtctagagaggttgatatgcgccaaaccgaagccctggccattctgaacgccggcgcgaacgtgttcctgaccggtgcgcccggtgccggcaagacctatgtcttgaacgagttcatccgccaggctcgggccgacggcgccagtgtggcagtcaccgcgtccacaggcatcgcctccacgcatatcaacggccaaaccatccattcgtggagcggcgtcggcgtggccaccgccctgagcgccagcctgctcaaactcatcaaatcccggcgcaaacgcaagattcaggccacggacatcctcgtcatcgacgaggtttccatgctgcacgcctggctgttcgacatggtcgaccaagtctgccgcgaagtacgccgtgatccacgcccgttcggtggcatccaggttgtcttgtccggcgacttcttccaactgccgccggtttcggtgtccgggcgcaaccgcgacctcatcgcccccacgcccgaattcatcgccagtcgcgaacggtatgcccgtgccggcttgaaccccgaaggcttcatcaccgaatcgctggtatggcccgaactcaacccggtgatctgctatctgaccgaacagcaccgtcaggataccggcgaactgctgaccgtgctcaccgacattcgcgaaggcgacgtgacccagtccgaccgtgacgtgctcgtcactcgtctgggcaaactgcccgagcccggccaggtcgccgtccacctgttcccggtgaaccggcaggccgacaatctcaacgacatgcgcctgaaccagatcatgcttgagccgcacgagttccacgccgagacagcaggccctgccaacctggtcgaccgactcaaaaagaacatgttggcccccgagcgattgatactcaaggaaggcgcggctgtcatggccctgcgcaacgacaccgatcgccagtacgtcaacggctcgctcggcaccgtgcgtggcttcgcacaggagaacaagggcggctggccgatcgtggaattcgagaacggcaacatcgtcaccatgaaacaggccacatgggagatgatggacggcgacaccgtgctcgcctccgtctcccaggtgccgttgcgctgcgcgtggggcatcaccatccacaagtcgcaaggcatgacgcttgaccgtgcggtcatggacctgaagcgcactttcgcgccaggcatgggatatgtggcgctgtcccgagtcgaatcgttgggcggcctctatttggccggcgtcaacgaacgcatgttcctcgtctcgcccgatgccgtggtgctcgacggcgacctgcgcgaagcctcggccgcggcctccgaccagttggccgatgaaggtgcaagcgcgttcaaacctgttgagccggacgaattcggtgccaattccgatgatgacttcgcccaggacgcgttattctgatctttagaagcgctccgtagcggctaccatggaataagaggtggtagttatggtgctatctgagatatttcgtggaaacaatgaggttcgcgaggccgcccgagccggtgtgcaaatcgatacggtcagtgtggctagtgcgtcagatgcagcaagcgcggcagacggcagcggcaaaatcactggcgcaatacgtccgtcagcggtggccggttcgttttatccggctgaccgcaccgcgctcaaacagctaatcaaccagcagctcgattacggccgaaagcttctgcaacagttggagcccacacttccagcgggggtgccgagggcggtaatagtgccgcacgccggatacatatattccggcacggcagctgcgctcgcttacgcgctcttggagcgtgggcgggggagcgtgactcgcgcggtaatcgtagggccgactcaccgcgtggccgtgcgaggcgtcgcctgttccacggcagcggcgtttgaaacgccgctgggcactgtgccggtagacattgcagccgagcgtaaggctctgggcctgtctgtcaatgagccattgcgctccggtacacatgcccgtccgggcgcgccggctcccgcaatgatcgtcaatggcccaacccacgcacaagaacatgcggtagaagtgcagattccgttcctgcagaccgtgctcggcccagacctcactatcgtgccgttgaacgcgggcgatgccacgccacaagaggtgggtgatgtgttgcgtgctttgtggggtggcccggaaaccgtcatcgtgattagttcggatctctcgcactatcatccgcacgaagtcgcccgcgcgttggatgaccagaccattgcggacattgcggctttgcatctgccgattcaccctcgccgggcctgtggcgcatacccgatcaacggccttctggatgtgttaaaaggccgcaagggcatgaggctcttcgagctcggctgttccacttccggcgacgacggcgtggtggcgctcgccggccaacctcgccccgcaatgcgagacgccgacgagccggtagtgggatatgtctcgtttgccgcgtgggaatccaagccggaagcagatgctctagccggtgcagatgacttaggcacatcgggtacgccatcccacggtgaggtgctgctgaaacttgcccgtgccgctatccgggaacggctgcatatcgagcatccgaccgccgctgattcgaccgcgtccattcttgccgcaaacccgtggctgaacgagtccggtgcctgtttcgtcaccctgaccgagggtggccggctacgcgggtgcattggttcgttggtcgcccaccgctcgctcggcaaggacgtggccgagcacgcagtggatgccgccacccgcgacccacgtttcaacccggtcaccgccgcggaatacccgttgctcaacgtggaggtatccgtcttgggcgagcccgagccgattaccgtgaactcctgtgacgccgattcgcgcggtaccggctcgaagaccgcgactctggcattgctgcaatccggacctcagaccgacgccgtcaaacgggacggcagcaacgtcgaacgcccggtacgttcgcgcactgaacttgaggaagtattacgccccggcaaagacggtctgattctcgccgaccgtcgtggccgcagcgccacattcctgccacaagtgtgggatgagctgcccgatccgcatgatttcgtcgctcacctgctcgccaaagccggtatccgcccttcctacgactggaccgatagcgaaatcgactgtcaacgctacgaggtgaccgcctatgccgagcactaacgcagcaaccatatctcctcccgctggcaggaagtggcgcgaagcgccggagggtggtcatcgggaatcgtacggtcatgcggcgtcagtcacagatgttcgtaaccccgccatagcccgctggcaaacgcaattccacgacggtaccaaccgcgctcgctgcgaactatgcccgcgccgctgcgtactgcgccccagccaacgcggcttctgtttcgtgcgctcgaaccacgacggcctcatcgtctccgacacctacggccgcagctccggcttcgccgtggacccagtggaaaagaagccgctcaaccacttccaccccggttccagcgtgctgagtttcggcacggctggctgcaattccggttgccgattctgccagaattgggatattgccaaagcccgcagtttcgaccggctcggcgtggaagccagtccggagaaaatcgcgcaggtcgcggccgaccggggcatcgattcggtggcgttcacctataacgatccgatcgtgttcgccgaatatgccatcgacacggccgaagcctgccgagcgctcggcattcatcccatcgccgtgactgccggatacatgagcgccgaagcccggcccgacttctacgccgccatggacgccgccaacatcgacctcaaaggcttcaccgaagagttctattggaaagtgaccggcactcatctggccgatgtgctcgagaccatcgactatgcggtcaacgaggcacgcacaccagaaggcgaacacgtgtgggtggagctcaccacgctactcatccctggattcaacgatgacgacgcccagctgcatgctgaatgtacatggatacgcgagcacttgggtccggacgtgccgctgcacttctccgcattccaccccagttaccgcatgatggacgtaccgcccaccccgcacgagactctgacccgcgcccgagacatcgccctcgaagagggactcaattatgtgtacacaggcaacgtgcatgatcgtgaaggcgataccacgtattgcccaaaccctgaatgccgggccaagctcgtggaacgcgattggtatcgaatcattgccaatcgtttatctgccggatacggtggcaatgggcactgccccgtatgcaggactgctatcgccggacgttggtaatctgcctcaggtcgcccgcgcgattcaccgcagatcgccaatacgcgtggcaatcgtcctcatcgatttgaggctcgcctcatagcgcgcggctgccacaatcagaatgatgccgcccaaagcaagccacaatgccggccagctacgcagcatcgggcgtacttgcggcaaacgcacacccacaatcagcgcggccgctccggacaggccggcgataagatccaccggggcatacggttgcgggttggtccatgcaagaccgaggagtattacgccggcaagaatggtggcgcatgtctcaataacctgtgatgcggtcagccgtcccgacgaacgcccgaatcgctcttgcgcgactgatggttggttcggctgggccattgccggattcgggtaggggcagggagaagcataggcccggcccggctgttacggttgatacgggcaggccgcttgttccgggaccgacataggcgattgcgcaaacggtggcatggccattggctgttgcgataccgcttgttgtggaactgccgttgggaattgcgggggctgcagcagaaaattgcggggcccatgctggggccggttgatacaccggctgctccgaggattccggctgattcccctgttgctcggtcggttgcgtcatcgtgcccttctacccttctagccgtcattgttgcacgagtgagtccgaatgccaagatgaaggtcggaatagtgcgaatagcaggcgggcttgtcggttcacgcgaatatcgtggaacacatgacttccaatacccttcgtatgtcaaccatgttcctgcgcaccctgcgcgaggaccccgctgatgccgatgtcgattcagccaagctgctgcagcgcgccggctatatccgcaaggccgcacccggtatctggacctggctgccgctcggtctgcgcgtgctgaacaagatcgaggccatcatccgcgaggagatcaacggcatcgccgcccaggaagtgcacttcccggccctgctgccgcgcgaaccctacgaggccacccatcgctgggaggagtacggcgataacatcttccgtttgaaggatcgccacgaggccgattacctgctggcccccacccacgaggagatgttcacccttctggtcaaggacatgtactcctcttacaaggacctgcccgtcaccctgtaccagatccagaccaagtaccgcgacgagttccgtccgcgcgccggcctgatccgtggtcgtgaattcgtcatgaaggacgcctactccttcaccatcgatgaagaaggcatgcgcaaggcctactatgacgagcgcggcgcttacgagcgtatcttccagcgtcttgacctgaagtacgtacctgtgttcgccatgtccggcccgatgggcggctccgcatccgaggagttcctggctccgatgccgatcggcgaagataccttcgcgctggcaccttccggcaaggcatggaatgtggaggccctgagcactccggaactaccggaaatcgatgcttccaccactcccgccgcttccaaggaagccaccccggatgccaagaccatcgataacatgatcgagcgtgccaacgccgaccacccgcgtactgatggccgtgaatggcaggcttccgacatcctcaagaacgtggtgatcaccgtcaagcaccctgaggatgaagagcatgacgagccgtggcgtgaagtgattgtcgtcggcgtgcccggcgaccgtacggtggatatgaagcgactggaagcccagttcgcgcccgccgaacttgaggaagccactgaggaagacctgaagcagcaccccgaactggtgcccggttacatcggaccgatggtgcttggcccgcaggccgaggctgctggcgtgaagaacccggttcgctacctgatcgacgcgcacgtggtcaagggttccgcttggttcactggtgccgatgagaacgaggtcgactactacaacctggtgtacggccgtgacttcaaggtcgacggcgtggtggaagccgttgaggttcgccacggcgacatgagcccggatggttccggtccgttgagcttcgagcgtggtgtggaaatcggccaggtgttccagctgggtctcaagtactccaaggcactggacctgaaggtgctcgaccagaacggcaaggccgtgccggtgtggatgggctgctatggcatcggtgtttcccgcgtgctggcctgcatcgccgaaacacaccacgacgaagccggcttggcttggccgtccgtgattgccccggctgccgtgcacgtggtggccaccggcaaggacgccgtggcgtttgaaggtgccgagaagctggtcgccgagcttgaggccaagggccttgaggttatttacgatgaccgcaagaaggtgtctccgggcgtcaagttcaaggatgccgagctgatcggcgtgccgctggtcgccgtggtcggccgcgattacgtcaacgacggcaccatcgaactgcgcgaccgcaacggcgaaaacaaggtcgccgtgcccgccgccgaagccgccgacgcgctcgccgagcgcttcgccgccctcagttgagtcccacttactcagcctcggcgttaatcgcatcaagcgccattctgcccagtcgcagaatggcgctttgttgtggataaccgaaacttatccacattcttaaaatttcaactgcgtcacagtatccacatttgccagttgcccttgtgcgcttcaaacgtcatgcctcacagtggaggtaccgctggggcgtgcaagccggcaatgaagccggagacaggctccggcggtccacatccaaacaacaggccagcaggccgaggaaaggaccgatcatggcaaatcaacaagcagcagtgaccgtcaccggctttgtggccggtgatccgacactaggcggaaccgagagcttccgcgtgctgacattccgtatgggcagcacgcgcagtcgactcaacccgactaccagacaatgggaggattacggaaccgcatgggtgggcgtcaaagcgttccgtgctttggccgtgaacgccgccagttcggttcgccgcggtgaccgcatcattgtggtcggctcactcatcaccgagcagtggaccaatgagcaaggcgaaccgcgcagtagaaccgttctcgaagccaccaacattgggcatgacctgaccttcggcaccacgtcgctgatcaagccacagcgtgccggtaatgggaacggaggcaatggtggcaacggtaacggcaatgccaacggtgccgtcgaaggtatggatggcggaaacgggcaacgagcatcgtcgccgtacgttaggccaacgcaatatggcgcgggcggtgccgcatccggtgtgggtattgacccgtatgcgacctcgtcggaatctggccccgtcgaatttggggtcacctccgattccggccaatcgccgtcgccatcaaccgagtccgcggccgtggccgatgccgtcatgtcgcaaccggacgccgacaccaatcaaccacagcccgtggcccaacaaacctacgtcgacggtttcgccgaatcttccaatcccagtgattccgaattctgagtgccaaccatacatcatgaaaaaccgctgtgttcgcctgtaatcgaggcaaacacagcggttttcctttacataacggggattaccaaatacgcacacggtccttgggcgcgagccacatggcgtcgccttcggtcacgccaaaggcatcgtagaagaggtccacgttgctggcgatgccgttggtgcggaattcggccggagaatgcgggtcgatctgcaggtactgttcggccagctcgtcgcggttcttggtgcgccagatggaggcgtagctcaggaagaagcgctgcaggccggtgaatccgtccatttcgggggcggtatcgagcagtgccttgatggcggcgggggagccgtcttctttggcgtcggacttacctgccgccttgccgagcgcgaatgcatacgccttgagcgcgatgttcacgccgcccaaatcgccgatattctcgccgatggtcagcgcgccgttcacgtgcggtgccttatcaggctcgtcagcgtacttctcggccagctgcagcggcacaaagctgttgtactgggcgatcaatgcgccggtacgggcctcgaagttcttgcgatcctcgtcggtccaccagttgttgagcttgccgtcgccgtcgtactgcgaaccctgatcgtcgaagccatggccgatctcgtggccgatcactgcgccgatgccgccataattcgccgcatcctcggccttcgggtcgaagaacgggggctgcagaatcgcggccgggaacacgatgacgttcatgctcggctcgtagtaggcgttcaccgtctgcggattcatcagccattcgtccttgtcgaccgacttgccgaccttggccagctgatagccggtctcgtacaggttcgcggccttggcgttctcggcgggcagcgcatccgcggaaacactcagcgccgaataatcgcgccagtggttggtgtagccgatcttcggcgtgaacttggagatcttctccagagccttggccttggtgtcctcgcccagccaatcggaattggtgatggacacgcggtaggcgtcaatcagattggcgaccagctcttccatgcggcgcttcgagctttcggggaagtgcaggcgcacgtattcgcggcccacatcttcaccacaaatgccgttgaccaggctcaccgcgcgcttccaacgatcgcgctgcttcttggcaccggagagcaccttgccgtagaagtcaaagttggtggtgtcgaagtcgcgagacagggaggaggcgaagcccagaatcatgtgaacacgggcccacagcttaaggtcggccagatcggcctcggcccagaacgcatcaagaccagtgaggaagctcggctcgtgcacaatgacgcgcgcgaacacagacttgaaatcaatcggctgagccttggcggcttcggtggcgtcataagcggtctgccaagcgtcgatccaagaaccgagatcgaagtttttcagcgtggcggccagatcggcgtaatcggtggggttgtaggtcttcaccgagtcgcgcgtggccacattgtcccaatggttggcggcgatcttggtttccacggcaaggaagtggcgggccatgccgagcgcggcttcgctgggaaccgtggcgggagcgttgctctcgtcatcgccggtgttggacggcagctcatcgccaccgttggattcggcggcgggcgcgtacccggcgttcaccagctgggtggcgaccatcgccacgtatgcttcgcgcacggggacgtagtggtcctcacgatagtaggcttcgtccggcaggcaaaggccggcctgctcaaggtgggcgatattgcggtccgggtcgccggggtcgccgtaaacggccaagccgaacaggtcggggccgccggctgggttgatggtgccgagcacgcgcgtgagagcggccttgtcgatggcggaatcgatgaggtcaagctcgtcgcggattgggtcaagcccggcggcctctatggcgtcggtgttgaggaatgagcggtacagggcctcagacttgacagccgggcagtcgtcggcgtcgaggatgtcgcgtacttggttttcggcgtcttcggcaagcttgtcgaaggagccgtagcgcgaacgatcgtcgggcaatcggtaggtgtcgatccatgggccattcacgtagcggaacaggtcgttggtcggcttgatgacggaggagaacgatgccgggtcgatgcccgacgtcagcgtttcggtttcgttggtcatggccctaagcctaatcgcggcgggggagaagcgttgatggtgcagatattgcgttatgggcattgcgctgtcagtgaactagacagattgcctaattgtggtgatggttcaaattagacaacttgtctatcatagtatgtggaatctgaacatggaccttgagctaaggagttacgatgagcaatccgaacgaggaccagtggaatggccagacgggccagcccaaccagagccagccgaaccagccgaatccggcgggtcaaccgggccaaccgcagtatggtgcgtatgacagcaatcatggcggccaatatcctccgcaaggtgcgccgggagcgcaagacactcagaatcagcatgcgcagaacggccagccacaaggcgaaccgaaccagaacccgtactacggcccgtacgcctacaatccgaactatggcccgaacggccagccggcatgggggccggacggtcggcggtatcaggcggacggccaatcgaatagccaagcggacgggcagccgaatggtccatggggcgatcaaagtcaacccggctggcagcagaccaactggtatgtcggcaatttcagtccattccgcctgatcgaggaatggctgccggaaaaagccaagaccaagattcgcatcatttacggcgtggtgggcgtggccgccatcgccttgggcgctgcgctgttgctggtgccgaacaagacgctggctttggccgcattgttgctcggcgtgtatttcgtgatttccggcgtggtgcgcatcgtcagcgctctcgtggagccgggtctgccgggcggctggcgtgtgctggacgtgttcgtcggcattctgctgacctttggcggcgtggtggttgtgcgcaactacggcatgaccggtcagacgctggcattactcattactttgatggtcggtttcggatggattatggaaggcgtgctgtcgctggttgaatcgtggcgtatcccgcattccggctgggccatcgcctatgccatcatctcgattatcgccggcttcgtggtgctgatgagcccgctgagctccgccgtattcatgattatcttcggcggatgcgccatggtggtgatggggattacttcagtgattcgcgcgttcactttcggcaagcgtcgcaagtaatctcacgcttcatgcaaccagtccccagacaatcaatccaaagcgcccgtgcaggctatgtgctgccgggcgctttttctcggccttggctattaatgggctgcgagtggatttcaggtaggcttctggcggttgacctcgggctggtctagagttgagaacaagtctcaacaaggtagaaagaatctcatgatcgaactgaaaacccctcgtgaaatcgaggaaatgaagccggctggtcgttttgtcggcggcattctgaaggaactgcaggagaccaccaaagttggtaccaacctgctcgaaatcgacgagttcgtccacaagaagatcgtggaccgcaagggcgccgaatcctgctatgttgactacgctcctgacttcggcaccggcccgttcgcccactacatctgcacctccgtcaacgatgccgtgctgcacggcgtgccgtacgactacagcctgaaggacggcgacctcgtctccctcgatctcgccatctctgtggacggctgggtggccgattccgccgtcagcttcgtggtcggcaaagacccggaccccgaagacctgcgcatcatcaagtgcactgaggaagcgctcgccgccgccatcgacgtggccaagcccggcaaccgtctcggcgacatctccaacaccatcggcgacgtcgcgcgcgaatacggctacccgatcaacctcgagttcggcggtcacggcgtgggccacatcatgcacggcgacccgcacgtgccgaacgacggccgcgcccaccacggctacaagctgcgcgaaggcctggtcatcgccatcgaaccgtggttcctcaagaccaccgacgagatcttccaggatccgaaggacggctggaccctgcgtgcctccgacggctcgcgcggcgcccactccgagcacaccatcgccatcaccgagaacggcccgatcgtcttcaccgatcgcaccaacctctgatcggcgtttggcgtatggtaggtgcctgattggcctgtgatgggcgatcagcgtctcattagccgtccgtctgttcgcggttttcccgcgaattcgagacgtaacaagccgaagtgcgtttgctttgatagcatgagcgcacttcggctttcgtgtatcgaccggcattcgccagcggtaacacagaagacatagagtaccgaacactagtgttcgcgaacgcgtgaacgttaatgtttggggtaagtggttcatgaagaggaaggtgcgcgaatggcaacggcacaacttgatgtcgattcgaacaagttcaacctgcccgtggttaaggctagtgcagggccggatggcatcgtcgtttccaaactgcgcaacgatggctgggtaacgcttgatcccggattcctcaccaccgcgcagtgcgaatcgaaaatcacctacatcgacggcaagcattcgattttgcgctactgcggttaccccatcgagcaactgtgcgagaactccgattttctggaggtggcgtggctgctgcgccacggcgagctgccgagcagggctgagtatgagcagttctgtgcggacatcaatcacaagacgatggttggcgaagacttccgtaccttcatgggttcgttcccgcgctccgctcacccgatgagcgtgcttgcctccgccatcaatgcgctggccacgttctacccggacaccaccgatatttctgacaacgaccagcttgatgaggccgccaagatcatcatggccaaggcccgtacgattgtgtcgtacatcttccgccgtcgtcgcgatgagccgatgctgtaccccgattacgcgcgcggctatgtggacgacttcctgcgcatgtgcttcgctgtgccgtacgagccgtttgaatccgacccgctgtatgtgcatgctttgggtcgtttgttgattattcatgccgaccatgagcagaactgctcgacctcggtggtgcgtatcgccggttccgcccacgccaacctgtattcggcggtggccgctggcgtcaatgcgctgtctggtccgttgcatggtggtgcgaatgaggccgtactgcgccaattgaaggcgattcgtgattccggcaagtctgtggccgagttcgtgcgtgatgccaaggagaatggccagaagatttccggccttggccaccgtgtatacaagtcgtatgatccgcgcgcggcgattgccaggaagtatctggaaaagatcatggagcgcgaagatacgcagaagctgccgtctgacgagcgcgcgctgttcgccgtggccaccgagcttgaagatattgcgctgaatgacgaatatttcgtatcgcgcaacctgtatccgaacgtcgacttctacacgggcttgatttatcgggcgatcggcttcgatccggccatgttcaccacgctgttcgcgctgggccgcattcccggttggattgcgcagtaccgtgagatgttggccgacccgaataccaagatcggccgcccacgccaggtctacaccggtccggtcgagcgcgatttcgtgccgatggacgagcggtgattgttggtttgagaaagcgcttcgctggagattccagtgaggcgctttctatatgtacagcgcaaaccagctatgctgcgacggctgcataagaactagcagggctagttctgaaattgaaataatgtgtgcggtatcgaggcgcaccgagggaaggcgtacgaaggtacgtcgaccgaggggcaacgaagataacgctccattatttcaatttcagttcttgtgcagcttggcgttgagctcaattcccaccttgcggtagcgggcttcgatgcggccgttcaccgagttgcggataaacagaatgttgtctttgccggagagctcagcacccttgaccacttccagcggttcgccagcggcggccttggccttgtcccagatggtgatcttagtgccggcggtgatgtacagaccggcttcgacggtgcagttatcgcccagagagatgccgataccggcgttggcgccgagcagcgagtgctcgccgatggaattgcgcagcttgccgccaccggacaaggtgcccatgatggaggcaccgccgccgatgtcggaaccgtcacccacgaccacgccttgcgaaacacggccttcgaccatggagacgccgagcgtgccggcattgaagttcacgaatccggcgtgcatcacggtggtgccggaagacaagtaagcgccgaggcgcacgcggtcggcgtcgccgatacgcacgccggtgggcactacgtaatcgatcatacgcgggaacttatccacaccgaacacgttgacagtggcggcaggagctgcggcagacagtccggcctgggaggcgaaagcgagagcggcttcggtggaggcgcgttcgacgtcggccttgcgcagcgtgaagtcttcaacggcgaaggggccgtagttggtccacaccacattggcgagctgggcgaagatgccgtcgaggttcagcgtgttcggcttggccatgcgcatgctcatcaaatggagcttcaggtaagcgtccgcggcattactgatcggctcgtccaactggctgacgacgaataccggcacgcggcgaatgccacgggcgtcggcctcatcgtgagccaaagtaccgaaattgtggttcgggcgatcggcctcggccggtgcctcaccgagattcagttcggggtaccagacgtccagggtggtgccggcggcgtctacgctggccagaccccagccccatgcggtacgctcttcgctcatagttgctccttattgttgtacgcgctagtgcacgcttgtggacgcgcgatgcgattaatgattcccaccttagccttatgtgcgcctaggtgagggacgatgcccgcgaaatggcttgaaatcgtatttcccggtaaaaaattaccgagtgtgattggcgatgggatgataggttctccggtgaaattcgctggtgaacaactcgacaaggaggtgtgcgatgtgatgttgcatcattcgggagcataggctgtggccatgcgacgcccggcatcatagagtttgcgcttgagcgaatcgggctcaagaatcactacgcggccatcccaggaatactgcaatgcccaccagaacacagcgcgttcgggagcatcgacgatgacttcgaactgtgtgccgtccggcgaatgtttgatttgagggtcgtcgaaccattcgaacacgttgttgagcatggattcgtctcgtacggccatgcggatgcgaatcggggcatcggctacggggtatggacggtggcgcatgaagttcactgcgtcaaaatcagctggtgctggtttttccagtggcactgtgccgttcctgcctttggcgctgacgttggcgattcggttgaccacgaaaatgcggaggttgtcttcgccatgcaggtggcagatgaggtaatagcgtccgttcttgtacaccatctggtacgggtcggcggtgtaggtaattcggcctgcacccgtacggcttttatgtggtatcaaggtgccatccgggccgtaatcacggtattggaaggttacgccgtggccttcttcgatggcttgattcagctggtcgatagtggataggaactcaccgttgatatgcgtgtaggtggccacatggtccaggtagcctactgcctgcccggcggctcctgcgagctcgcggattttaccgatgaggtcgtccatggtgtcgaggctgatgcgagatagggtaagactgtctagcagcagtcgcatttcggcggtggacaggaatgcatcaagataccagccgggttgtggattcttgcattcgatgccggcaagatcactttcggcgagatgcccgatatgtctgccgagaaattccgtggcggtaagctttttgagctgatttcgtatggtcttctcggtcggcagctcgcttggatcttccagctggtgtttacgggcaagttcatcgagtatttgccgcacggtcaggccatgcccaaagtagctgtgacgccacagcacctcgaagatttcgagggtggtgttccctgcataggatttgcgttgcgccggcttgtctgcatccatacattaaggctaccgcgcgcttcgtctaggatggaaacgttgggttgaaatacattcgctggaaaggaggctcgcccatgagcaaagggtatggtgtgtttggccatgttcccgataatgcggatgacgatggcctcctgccttatgaggatgatgattccggcgtttcctggggccatgcgttgcgtcgtcgcaatccttggaaaaggggagacgacgaagatgccgattacgacgacggtcggtatgacatagatgacactgatgacactaatgggggcaggggcatctatgccggtaaaaacggcggagtaggcggcatttctggtgagacgggtggaatacttggtagctcaggcgcggccggcagcagagacgtaacgtttggtggaacggacagtttgtccgccgccgatgcggtgatgccctatcgtttcaggcaaggacgttccgtatggttcgacgatgaggacgaaggccatttcgccgggtctgcgaagcgtgccgaagcccatgccgtccctatccttgcgttacgcaacgatgtggaatcgtcatcgtcgaatgccgtgctcgctcgtgcccgtagcattgcgcgcaaagcggccaccatggttatcaatccggtatacagcgaaaatcatcgaaccgggtatgccgaacttgacggtattctacgtggcaccaccagcccatcaagtaggtatcgcaccagcgtgcaattcgacctcgatacgggggaggaggtcggcggcaagtgctcatgcccggcttacggccgtggctatggcatgtgcaagcacatgattgcgctcgccttcatattctgcgatgatccgcagcgttttgaaggctaccgtgccggggctgtgaggccgtctcggacgctgattgactatatggagcacgccgataggcaagacgctcaagccaaaattcgtcgtcgcaatgcggttatgcgtcggtttgatgccacgcaagggaaaaacggtgcaaatgctcggcgtacaaaaagcggatacggctctcgtgccggcacccgaggcggcgggtatcagggtgacagcgagactgtgggcttggggcaggtgcagcttgtcccgatattgagtttcatcgacggcgtgtggagcgtggagttcaagatcggctcggcttccaatgggtccagctatgtgctgaaatcgattccgcaatttgtgcttgccatggcgaacggcgactatgcggattatgggcagaagcttgcctttactcatacgccggatatgcttgatgatgattcgcgcccactgctggacgtccttgatgatgcgatggccgtgcgtcgtgcggccgagcagcaggacaggtattacgggcatatcgccatcgaccgtcatctgacgctttcagcaccggaagtggtccggttgctgtccgtacgtgagggcagaggcgtacagctcgtgctgaacacatggttctccgggcagcctgcatcggtgccagttgatggtggcgagccagattttctcatgcgcattgcgcggcgtgatttcaatacgtatggtccggatgccggatacctgcttaccggagtgccagcggtggaaaccgtgattgacggcggcaagaatgtatggctgttgctcgcctccactaatccggccggtgcggtatccgccatgatggcgggctctcagcgtaaaagcgcagcaggatgccgattcgtccgttgcccgaaacgattgattccgttgcgaggactattgggagacctgtttgaacccgatggcgaggggcaggtcattgccggcgatgacatcgctctattcgcacgcacgctattgcctcagctggttggtgctggactgttggaggccagtgagattcctcgcgagctggctgaattaagtcctacggaatgcagcctccagttttatctggatcgtgatgagcatggtgtgcaatgcgaggtcaaggcacgctacggcgatgccattgtcccgttgctacccgatggcccgacggtgcatgctgagggcgagcgttccatccccttgtctcggggcgtgattgggcgtgatttcgacgctgagcatcttgcgattgatgtagtgcgtgaattctttaccatgcctgaccagcgcaagcgcgttgcggccgccactcatcagacggtgaatgggttccgaacgccggccgcgcgaaaggccaccaaaaaattcgtgtctgatgcggccactatcgatcgcgatgacaccacgcagatcgttcgtctctttgacgagggattgccggcactaaaggaagtgggggaggtcttcaccacaccggcttttgaccggctgatcgcgcccaagccaccaagcgtcaaagtcggattgtccatcaaaggcaacttggtggagatatcacccctcgctgatgaagtgccgccggacgaagtgggtgccttgctatcttcgtaccgtcggcgtcaacgattccatcagttgaaggacggaacgcttgtcaaactcagcggcgcgaatctcagcacgttggaccgattggccagtgacctcgatctgagcgagcagcagctcaactccggactgatcgagttgccgggcggtcgagcattcctactggatggtgagctgccggatgacggctccgatgtagtcaaggacgcttcgttcaccgaatacatcgacgatctcaagatcatcgaccctaagtcgtatgaagtgccggatagtctcaagcatattctgcgcccttatcaggtcgaaggcttccaatggctgaacacgttgtgtgacaagggttttggcggcattctggccgatgagatgggcttgggtaaatccgtgcagcttatcgcgttgctcctgtctcgatatcagcggaataccggcgagatgggcaacggcagccttggcccatcgctgatcgtgtgcccggcgtccttggtgtacaactggggtgccgaattcaccaagttcgccccgagcttcaatgccgtggtggtggccggtaccaaagccgagcgccgtaccgccatcggccgtgcgttccgggcggatgaacccaccgtgctcatcacctcatacgacctgctgcgccgagatgtcgatgattacaccgccaatgagcaacgtttcaatgtcatggcattggatgaagcccagtacatcaagaatcacaccacgaaaatagccaaagcggtcaaggccgtggccgccgaccatcgtttcgccttgaccggcacgccgatcgaaaaccgactctccgaactttggagcattttcgacttcctgatgccggggctgctcggctcatataagcgattccatgagcgttatgagttgcccatctccaatgcccgggccgcggatggcagcacggctgaaggtcgggccgccgcacaagtcaatcctgaggccgctcgggtatctcgccaattgcagtcgttggtgggcgtgttcatcaagcgcaggctgaagtcccaggtgttgaccgatttgccggacaagctagagaccacgctgaccgtgcggcttgccggcgaacagcgcaaactgtatgcggctcacgagcagcggctcagaatgcagctcgaacacagcgaagaagccgatttcaacacgtcgaagattcgcattctcgccgagttgaccaagttgcgccagatctgctgcgacccgaggctgctgtacgccgatgccaaggatcaatcggccaagcttgccgccatcaccgaactggtggaaacctgtgtgaacgaaggcaagaaggcgctgatcttctcccagttcaccagcttccttgatctgatcgccgaacgtttcgacgcgcaaggcctgcgctactacaccatcaccggctccacgcccaagaagaagcgtctcgaactcgtcgaccagttcaatgcggacgatacgcctgccttcctgatttccctgaaggccggcaacaccggactgaacctgaccggtgccagcgtggtcatccacgccgacccatggtggaacgccgccgcacaggatcaggccaccgaccgagcacatcgtatcggccagaccgaagacgtcaacgtgtatcaggtggtggccaaggacaccatcgaagaacgtatcttggagcttcagcatactaagagcgagctcgcccgccagttcaccgacgcttccttgcttgccgacgaagccggcaccggcgccagcgccctcaccgaagcccccgcctccatcgccaccctcaccaaggacgatctcctcaatctgctgggatgagaagatcctgctcggtgctcttgagcttggggatggaaacagtctgggctttgtggacccgttcgctaagccgagaccggagtcgatagcggtgtggcatggtgcgtgcgtggggagcgtgattcagttgttggctgaggcgattcggacgctgtcgttttgtgctttgttttgccgttgaccaattgaaatgctcgttggtaggagacccccaataaagctccgatttgtcgatacgtgagtccctcgttgcgtagggcccgtgcggcgagtcgggattcggcagccgcttgtgcgttggctttttttgctatttcgcgctgccggaacatttctgttacgtgttgtttggcttgtttcggcaacacaaacgtcaccttgagctccggattgtcgtcgtcgttcgtgacagtgatgagatctttagccattggctcgatatcgtcaagtcctttggcctgggtcgaccgttcgatagctggtacctgaacgtaccaatatcggtcatcgggttgcacaagcacgtcatagttgctcattgccaccacccctttccgagtttctgctcgctctcgttgatgatatccagcgtggttcgttctgagacttcattatggcgggggatgggtatcctcaacccgtccaggcagtaaacctcatgtctgctgccttgccgtaacaaatagaaatcgagccctcgctgctttgccgcttgccgaagtttcttgatgatgagttttcttcgtgtcatcataactctcaatcccgcactagacaaaatgcgtatgtcgaattgccgggtgggagttgtgggtaaacgtagagatgttcattggtccttctttctgttgtctgacgcgtcgttgcgtgcgggtgcatttgacggtatgggatgaggtctctgattggcaagctgaacgggggtatgtggttctagcttccgagttatccacattgataaggtgcttttttaaagtgactttcccgtgttggtcgtggatgctgcgagcaaggcaagaacggttgatcacgtcgcgatgcgtgtgggtgaatggtgaaagtgtttttcgatatttttgtatcgatattcgatatattatgatggtggcatacggtgcagtgcaggttcatccattgatattgatattggattaaggagcatagccatgaacgctggtatcgcattcatttctcgtaaatctcgcaaaacagacgtcgcttggcgctatgccattgccgtggtgcttgtcgtgtgttgtattgggctcgcatatgtggagattgttgtggcgccgtggtttatcaatgaggtggtgtctatgtttccggagaccacgttgcttaaagaaccgtccatgttctgggaatgggcgattctgctcgccgttcaggcgactttgctgtgcacggcggcgctacagcacctgctccatgccgatgtgatatggagtgagtcccatgcgttcgtagaaggcttgggctttggggttgcaggcccagacgttgagcgttacgttgtggcagccggattgacgggcgaagccgagcacgtagcgatacaaggtggagcctacatggtggccgcgggaccgctcgtcaacgcatagatcatcgatgtacagggttttgatatcggtcaggatattgctgttgaggtgctgctggaacacgcagaatgcgtagccaagcacttggtcggtggcgggggagtcggcgttatgttcggcgtcagtgccgtcattggcagatggcgcaaccgccacgaacacaggggtctgatcgttggtcagaatcgccttcaattcctcgtccgtgtatttcttgacaccgcctttgaacagatccggtcggccggcatgatgcacttcgagcacctgccgcagcagttcgtcgatttggggaatatcggccgccgtggccctacgaatcgtcatgtcatccattgaactcagtctaatcgggcagtctcgaccggcagatgatcattgcccgcgataagagacacggatgggcaagatgggtgatcgttcgttcagggtctcattctcgccgcaacgtcacggtagtctggagtgcgtgaatcgcaagaaacagccagtggagaagtatgagcggggtacccgttcgtacacgatgtcgcatattcgtggcaaagacaccaaaattgaggtactggtacgcagctacctgtttcgcaaggggttgcgattccgcaagaacgacaagcgttaccccggacacccggatgtagtactgccgaaataccacgccatcgtgtttgtcaacggctgtttctggcacatgcatgaaggatgttccaaacattcgatgccgaaatcgaacgtggaattctggcaggcgaaactactacgcaatcacaatcgagacatcgcgcagcgagccgaactggaggccgctggctggcgtgtaattaccgtatgggagtgcgaattaacgaaagccgtgcgcgacgaacgcctcgcacggctgtatgagcagattgttgaaggagatgcagattcagcggaataatttcagctcccctctggagggaagctgaaatcaggattcaaacgggaacttcaggccccaacggtcacgaatcgcatccatcagctccatgatgcggatggtgtcggcgtgcggcatcgcctcgcattcgatcttgccgtccagcagcgcgttggccgcatcggccacctcatactcataaccggtcaactgcggcggcaccgcaatgctgcgcacgggcttgtgggcgttgtcatagatgtcgatggactcgggattgttgatattggtgaccaccagataaccctcggtgccccacacatagccgccgcggtcggaggaaaccagcatcgaactggtggaaacggccatcgtgccgtcgctgtaatacaacgtggtggaattctgcgcatccacaccggtttcggcgggcaccatcgacgtatcgaaatgatcaagtgtacggccatggtcggcgccgaccgccatatccaggaagttcagcggatacacgcccacatcgagcagcgcgccaccggcacaggccggatcggtcatacgtgccttgccggacaccggatagcacaggttggcgctcgccgctttcacctcgccgatctcgccggactcgataacttcgttgatgagcttgcggctgggcatgtagcgcgtccagatggcctccgtgcacagcatgccggtttcctcggccacggccagcgcctcacgtgcctgcccggcgttcgcggtgaacgacttctccaccagcacgttcttgccggctttcatacacaggatcgcctgttcggcgtgcagactgtgcggggtggcgatatacaccagatccacatccgggtccgccaccaactcctcatacgatccataagccttgtcaaaatgccattggtcggcaaaagcctgtgcgcgcgtaatatcacgggccgctaccgcatacgggtgaatccatgaggaatacagtgaatcttcagccatctgggtcagggtgccggccatggtgtgagctatgcggcccgcacccagaatcgcgacgttgattttttcgccgctggcctcgaactcggcgcgcttgccattgaatcgactcattattcctccttgaatgcgggttggtgcactcaatcgacctacagtgattatagaagaagaaaccttgtcccgtgaggcggatagaaccgaaatatggaaaacgaagcagcgcagcagcccaaatctccggccgcgtctccagtcatgtcccgccgagcgcgtgaggccaatcccttccgtgccatggtattcggcgaacaagcagacaagatgatcgcccaaggtaccagcgtcatcaaattaagccttggcgagcccgatttcggcgcgccgcccgccgtacgcgacgccatgcgcgaacagtacgacggccgggccctgccgtacaccgccgccatgggcctacctgaactgcgtcaggccatcgccgacttctaccgcgagcgtcatgaccttgacatcgaccccaagcgtatctgcgtgaccgccggcggttcggccgctctgctgttggccaccgcgctgaccgtggaccccggtgacgatgtgattgtggccgacccctcctacccatgcaaccgcgaacttgtgcggtcgtttgaaggccgggtcatcgatgtgccgacctcggccgccacccgcttccacctgaccgccgacctgtgcagccagtactggacgagcaagaccaaggccgtaatgatcacgtcgccgtccaaccccaccggcaccaccatcgacttcaacgtattggacgaggtgtgcaagttggccgccagccgcggcgcatggcgcatcgtggacgaaacctaccttgatttggctgaccgggagccggacggtaccgaagtcaagtccgtactggcctgcgaccccgatgccatcgtatgcaacagcttctccaagttcttcggcatgaccggctggcgcctcggctgggcgattctgccggacgagcccactgtgctggaagcggttgacgatctggccaccaactactacctgtgcgcccacacgcccacgcaacatgcggcgctcgcctgcttcacgccggaaagcttggcggaatgcgaagctcgtcgtcaggaattgctggcccgtcgccgcattgtgattgacgggctcaagcgcatcggtttgccggttgaggtggagccgaatggcgcgttctacgcctacttcgacatctcccgcactggtctggatgcctggacgttctgcgaacgcgcgctggatgaagcccatgtggctctgactcctggccgcgacttcggcgcggccacggcggatacgcatgtgcgcctgagctatgccgcctcacgtgaggccctgaccgaggggctggaacgtctcggaacgttcgtcgaatcgctgtgaacggcgcggcagccggtgtgattgttgtacagtagtcgagtttgtgtgatgttcggctggcctcacggtgttggttgccggccgaacgactcgccatggtggcgcacggctggctgattgcgatggtcggcccgttgttcggccatcacgggttaggtaaggtcaggaataggaatcatggtcaatctgcgttcgcataccacgcgacttggtgtgcttgatatcggttcgaacactatccacatgcttatcgtcgacgccgcccccggcgctcgccctgaccccgaggccagcaccaaatccacagtgcgcctgatgaagtatttaaaggacgacggctcaatcaagaagtccggcatcgaggcgattctggaagccgtgtcccagtgcatgcggctggccgaggaatacgaaatcacccagctgctggttatggccacctccgccctgcgcgaggcgccgaacggcaacaaagtgattcacaagatcgaggaactgattggtcagggcgtcactgtgctgtctggcacggatgaggctcgcctgaccttcctggccgcccgccgttggtatggttgggatgccggccgactgctggtgctggacatcggcggcggttcgctcgaagtggcgatgggctccgacgaagagccgaccgtagcgctttccgccccggctggcgcgggccgcgtcaccactgaatttctgccttccggcatggccacgcccgacgagttggaagacgtgcgtaagaacgtgcgcaagattctggagccgatggtcaaggttttcccgcaatccaagcacccgaatcatgcagttggcacctccaagaccttccgctcgctggctcgcctgtgcggtgcggtgatgcgtgcgccgggccgcgaagattcatggattatgactcgtgagcagttggaagactggattcctcgtttggcggcgatcgcgcctgagcagcgcgtggctttgcccggcatcacgcctgaacgcacgatgcagattgtgggcggcggcgtggtggccgacgagatcatgaaggccctgaatattcaggaagtcgagatctgcccgtgggcgctgcgtgaaggcgcgattttgcgctggctcgaccaattcggccgcacccgcctcggtttctagtcctattgaggggaatcacccaaccgccacggtagccaacaatgccgcatgatcagagccctcgactttgaccaccttgcattgtccggccttcatgccctgatcaagcaccacgtggtcaataccggcgaacattggcacagccgcacggttcgtgggccatgagaacgtaaacccatgtccggattcacgtgcggcatccacgaaccggtcgccaagaaaatcacggaatggcgtgtgatcgtaagtggcgttgaaatcgcccatgaaaatataccgtgtatccgtatgctcgcgcatcagacccaactcatccagcgatcgcttccactgccgccagtagccgggtacgggagcggtggtgtgcacggatacgaatcgaatctgctggccacccatatccaccgtgccgccgggcatgaatgaggcgctggaattcacgtcatcgtcggtcggatcggcaagtggcgtggccgaccagaggccgttaccgaatacgccgtcagacgatgagacctgcgcatacggcagataatgctcaataccagcctcattgagttttttgacgaaatcctcggtggtctcctgcaaagcaagcacttcgacgcgctgatcgcgaaccagctcgacgatggcttgcgggtcggcctgccccttatacacattgaaggtcatgacgcgcgcgtaggcatcgctggtgttgggggaggctgcggccacggcgttctgcgcggcttgggggagtggatcggtcgagtagaagaacggatattgccaatagccattgcatgcgattgcggcgatggcgattagtgcggcaaggatacgccgcgacacgatggccaacagcagggcaatcaagccaagcaacgtgaaccatggcgttgccgataccacaatcggcgcaaatggcagttcctgtaaatcggcaggcagcgcgcgggcggcagcgccggcaagggcaagaagcgcgaacatcgtggcgagaaaaccaagcagacgatgccgtttgtgtggcttcacggcagacttggatactgggcgtgccgtggctctggcagagcgtggcttggcagcggcgcgagctcgtacgcttgcgcctgtggtagtactccgtgcctttgccatgctgccctttcctccggcttgtttactgttactttgcttttcgtgcgatttgccactgtaccgtgtacggcttgtctttcagtgtcttttcgccgtgcgcaagagcagttcgcaccaaactggcacgaaagaccgggccatgacctgatgtcgggttcctccatgtggcttgctcaggttgccggatggcttgcgcaagctgccacgcgaacatgatgcgactgggcgtgtggccgtgtacaatgaaacgtcgttgcccgagtagctcagtggatagagcaccgctctcctaaagcgggtgtcgtcggttcgaatccgatctcgggcacttggcttcggaaacatgacggtatctcagcctctattcatcggtgatgagccatgggcattaggcatgtgtaaacgtataggttccactatccatcatcccgtcgtgtgaaactatgcaaagacatgtggggcttcacggttgtcgtgagggtccatggctatcgaatacacggaagagaagcggtttactgttgagcaggttgaggcgctgttcaagtcggtaggttgggaatcggcgcagtggccggaacggttgttcaaggcattgcagcattcggatacggtgatcagcgcatgggatggcggccatttggtcggcttggttcgcgtgctcgacgataccgaaatggtggcctatatgcattgggtgctggtagatccggcatatcacgggcagcatatcggcagccatctcgttgaactggtcaaggctaagtatcgcgactacttcttgctggaagtcatgcctgaggaaagcaaaaacgcaccgttctaccagaagcatggcttccacctgatggacgatggccgcgccatgcaaatcgtcaatcgcggctgacgggctggcagtgcggacggcgcaagagcggcggcatgcgccaatcgtgggcaacgtacgtagtcgttgacggttatcccgtagcaatgttcacaatacgaccccttgtccatacagtgaaaataacggctgacgttcgacgttgctgcgctatgactagagaccatgagtgaagacaaacagtatgacttctatgtggccggtccgttctttgatcctgaacaaacggcaagtatggaacgtttggaaaagatattggaagaccatggcaaggtactgttcaagccgcggtttgtcagccagatcgaagaagtaggccctgaaggatgctttgcggacgatatccatggcattaatgctgctaaagccgtggtcgccaatcttatggacgaggacccgggcacgatgttcgaaatcggatatgcgcatgcgctgggaatcccggtgtacggctatttcgaaaaccttacgccaatggatcgtgtcaatctgatgattgcgcaagcggtcgaactggtgttcgtcggtcctgatgatgtggcgaaatacttggaaaccggcgagcatacggaagtcgattacatccagttctaaacagctctaacaggttctctgcaagcagggttggcggcgttctcgtacatagtcatgtacgggaacgccgcagtggtatagggatattccaacaagcggcataatggggtcgtgggaaaaccagtcggatacaagtgaagtgtctgaatttcgtaaggagtgccgttatgagtaaccacaatcccatgaatattgccaccgactttgccaaggccacgggaggaaccgctcgcaaagttgttgctttgaccgataaaggtccgttgaatggctttaagaaattcctgtcgcgcggatcgatgattgatatggcggtaggtgtggtgatgggctctgccgttaccgctgtggtcaattccatcgtcgacaatctcatcagtccattaatcggcatgattggcggcgtaccggatctttccggactgctgaccatcacgttcaacaactcgactgtttcatttggtgcgattcttaacgcgctgattaacttcctgcttgttggcgtggcggtgtatttctgcgtgattttgccgattaataagcttcgtgatctcactgctgcccaggatgaggctgacgctgaagaacaggggcctagcgttgaagagcagactctcgccacgctgcaggagattcgcgacgagctgaaaaaggccaataactccgccgagtaatctgctgaatgtacggtgcgacagatttacctggtttgcccgaaataacggattgccggggccatttggtctggacaatccgttgtttcgcgcgtgttttgtagcatccgtggagttacatggggagtatgactgaaaacatcgctgataaggccataaacgatactcgtatcgtcaagcagttcaccaatcccgtcaaggagccgattgacagcgacatcaacctgttcgatctgctcgataaccgcgccaagcgcgatcccgaaggtgccatgatcgaatacaagggcgatgatggcacttggcacccgtacagcgcccaagtattccgtgacatggtcatcgacttggccaagggcctggtcggacttggtgtcaacaagggcgattcagtcgccatcgtctcgcgcacccgctgggaatggaccgcgctggatatggcgatcatgtccatcggcgcgctcaccgtgccggtgtacgagaccaactccgccagccaggtcagctggattttcaacgattccaaagtcacgctcgccatcgccgaagatgacgggcagcgtgacaagatcgaatccgtgcgcgatgaggtgcccaccctgcgcaacgtgttcgtaatcgaggccggcggtctgaacgccatcaagacctacggcgaaagcgtcaccgacgccgaattctgggaatacaaggaagcctcccacggcgacgaccgcgccaccatcgtctacacatccggctctacaggcaccccgaagggcgtggaactgacccaccgcaacttcgccttcctggtgctttccgcgctgcagtacatgcctcgtgccggcgcatggcccaaccgccgtctgctgctgttcctgcccctgagccatgtgttcgcccgattcctggaattcttcagttttggcggcacgatttcgctggccttgagctccaatatgaagacgatggtcaaggacttcgagaccttcgaccccacgctgctgcttgccgtgccgcgtgtgtacgagaaggtctacaatgccgcctcccagcgcgccggcaccggattcgctggcaagatgttcatgcgcgccgccgagaacgcgcgcgaatggtccaaggccgagcagaagggtgagcagctgccgattaccggacgcatcgcccacgccttctacgagcaggtggtgtacaagaagattcgcacgattttcggtccgaacgccgacttcgccatcaccggcggcgctccgatggactccgagctttcccacttcttcaacggcatcggcatgccggtgctggaaggctacggcatgaccgaaacctgcggcccggtgtgtgtgagcttgccagaggacaaccgcatcggcaccatcggcatgccgatgtgcggtatcaccgccggcattgccgaggacggcgagctggtggtcaaaggaccgctggtgtgcaagggctaccacaacaaccctggggtcactgcccagcagatcactgatggctggctgcacaccggcgatctgggcgatatctccgaagatggcttcatctccatcaccggccgtaagaaagacctcatcatcaccgctggtggcaagaatgtgtcgccgggtctgcttgaggcttccgtgatgacctcgcctgtggtcaaccagtgcttggttattggtgataagaagccgttcgtggccgctctggtcacgctggatctggcggatgccaacaattggctggaatcccagggcgccaaaccggaacccgatctggcctcgctggccaagaacgccatcgttcacgctgaggtggagcgtgcggtgaacgccgccaacgagggcgtttcccgcgccgagtcgattcgtaagttcgagattctgccagacgaattcaccgaggccaacggcatgctgaccccgagcctgaagacccgtcgcgcgcaaatcgttgagcactatcgcgagctcattgacgacgtgatctacgtgccgttgaagaagtagctatcaactccctctgatccaaaaaataagctctctctgacgagggaactgtcagccgcaggctgactgggagagaccgcggctagcccgcgaaacaacaaggccgggtgcgacttgcacccggcctcagcttattcagtccaaaatcgccgaaacataatcggcggcggcctgatccagctccgcatcgccgatggtggcggtgccctgcaccaggaacggctcagcatagttcatgccgaccttgtacgccacgacctcaaacgggcttagcagctcctccatggtgtggctgtactcgccgtccttgcggtacttggcggcgtcggaaccagtggtgaccaccagtttgagctccttgcccttcaacgcatgggctccggcgtaggcccagccggcggtgatgacctcgtcttcccattccttgagtagcgcgggggaggagtaccagtagaacgggaactgaaggattacgcggtcggcagcctccagcagctcgtgctctgtgtcggcgttgacggagaagttcgggtattcggcgtattcgtcgcgcacgatgatgtcgtcctcgccctgtgcggtgagttcggcgagcaggcgggcgttcacgcgcgagccgtccttaagatgcggatggaatacaagaatcaacgttgacatgggatttcccttctataaactgctgccaatgtggcctaatcaccactatcgtatgccgggaagcagaactcagtccagtccggactcaggtgcgagccgcgggatgccgcgccgggaggcaactcagtcgaggttggactgcgtgcctgcggtggcttcgttggcggcttgctcggcttgtgcttggtcgagcttggcacggacgtcgttgagcagaccctgggcgcgcttagccaaggcctcgccgatctcccattgacgcatcgactggtcaagattgaggccgccggtttccagtgcctggacagcctgaatcagcttgtcgcgcgcctcctcatatggcatctgggcgatgagctcgcgttccttgtccgtcagggacgtggcgggggtgttcatgtcggtggatgtggcgttttcggtcatgatgttctccttatatatacggtatatatgcgtggctgcgtatggcgtgtcacgcggttgcggatgtggtggttgcggtaatgacacccttcttcaaggtgacggtgatgccatccccagggcttacctgcgaagcatcgtctagtacgtggccatcggcggactgcaccaccgcatagcctcggttcaacgtggattgcgggctgagtgcggtcagtgaggcgtgagctcgctcgacggtgagctgggcatcgtccacgatgcgtcgcagcccgatatcgagccgttgcaacgagtcgtcaattaagcgctgatgaggctcaagcatggtgtgcggctgtgtcaggctcgggcggttcgcatatccctcgataagtcgaatctcgttctccacgcgcgaacggacccgcagtcgcatacggtcgatggcaccttcgatgagctgcgactgctcacgcacatccggcaccacgcgcttggccgcatcggtaggggtggaggcgcgcagatcggcgaccagatccagcaatgtccagtcatcctcatgcccgatggaggagattaatggtgtagtgcaggcatacgccgcacgaaccacacgctcatccgagaaaccgatgagatcctcaaacgagccgccgccacgggccacgatgatcacatccacgctcgggtcggcatcgagttgtgcaatggcctgaaccacctcggccgggcattgctcgccctgaacatgcacatggaccaccttgaaggttacggaaggccaacgaaggttcacattggtgatcacatcgccttccgcacgtgcctgaggtgcgcaaatcaggccaatagtcttcggaaactccgggagaggcagtttgtgatcggcatcgaacaggccctcgcccttaagctgcttgcgcaattcgtcgatcatggccttgaggctgccaccggctccgaccttgagaatcgtgtccccgcgcaacgacagcgaagtgcgcttcatccacaggttcggtttgccgtgaatcaccacgcggtcgccctgaacgaactggctggctgcggccgcgaacctgccgaagccattgacttccatggcgatatcctcgaagtcgtcgcgcagcgtgatgtaggccgagccggcgcgacgggtattgatctgcgtgatctggccggtgacccacgcggacggccatcgttccacggcaccgtagaacttctggctcagcacgcttaccggccacggattttgcgcggtggtttcagcggcgcgtgcaggcagctgatcgatagggcgaggctcattcggcagattgatggcgccccgatcgggcgcgaaagtgccttgacccggctcaaagccagacgaggccagtgaagcggcggtcggtggacggccggtagatgagtagcccattgcagtagtcatgcactccactataagtgcgttggttgatgacggtaaaaatttaccgtcgcctgaaaacggtgtgatgatgaatgcaagaaccgtacgaagcgatgtatcagccgatgatggagatggtctggtgcatcagaagaaaggagtcattatggcgaagaaacgggtgctatgaagaggagtgagatatgcgttgcactgacgattgagagtcgtcagtgagctcgctgtgcgacacgcgagcagaaaacagttacgctaatcacacacttgtagttttggcgaaaaatagccgaaaaaccctataaatagttcgacacaccactgttgagcactagatataggggtggggatgccgtattcttctagaggttcaagaaaacgatatcaatgtaatttcgtgtggcccacgtcgagtgcggccaaaatgcggaactcaggagagtgttcgccttataggaaaggggtgcccgatgggcgcacaggtgctggaggaaaccgtcaccgataacgagaccaaggtggccgccaaggcctccaccgtgctcgttgagaagcgtgatggtcgtgtggtcgacttcgaccccatcaacatcatctctgcggtcaagtctgctttcggcgacctgaacaaggaagtcggccccgaagaagatgccatgatccgtggtttcgccaaccaagtcgaaggcgaaatcaaggggcgttacaccggccccgccaaaatcgaggacatccagaatctcgtggagcacgccctcattgacgcccacctgtacgatgtggctcgcgcctacaccaattaccgtctcgacaaagacattcagcgtgccaaggccactgatgtcaacgaggccgttgctcgcttcattaatcatgacccgaccctgattcacgagaacgcgaacaaggattccaacgtctactccacccagcgtgatctgctggccggtgccgtgtccaaggccgccgcgttcaacatgctgccgccggcggtgtccaacgcccacatgaagggcgacattcacttccacgatgccgactattcgccgttcactgcccagtccaactgctccttgccgaacttctgggacatgttggccaatggcttcactcttggcaacgctccgatggcttccccgaagtccatcgccattgcggccacccagattacccagatcatgaaggacgtggcctccagccagtatggtggccagaccgccaaccgtgccgacgagcatcttgcccagtatgccaagaaggattacgagaagttccttgaggaagctcgtgagaccatccccgacggcatgccggttgaattcgcccgtcgtcaggtcgagagcgccaagaagaacgagcccgccaagctgcatttcggttcccgtgaaccgctgccgatggacaccccgttccacaccgacgttgacgaacttgagcaagagcgtgaaatcctcgccaagattcgtacccgcaaggccatctatgatgccatgcagaccatggaataccagatcaactccaaccgtgtgtccaacggccagaccccgttcgtgactgtcggctttggtctcggcaccgactggttctctcgtgaagtgcagcgcgcaatcctgctgaaccgtattcgcggcctcggcaaggaacaccacaccgccatcttcccgaagctcgtctttactgtgaagcacggcgtgaacgccgacccgggtgacccgaactacgatctgaagcagcttgccctcgagtccgccaccaagcgcatgtacccggatgtggtgttctacgagaacatcgtcaagatcacaggctccttcaaggctccgatgggttgccgctccttcctgcagggttggatcaacccggagaccggcaaggatgaagaagacggccgtatgaacctcggcgtggtcaccgtcaacgtgccgcgtatcgccatcgaatcccacggtgacaaggctcgcttctggaagctgttcgacgagcgtatggaagtcgcccatcaggccctccagttccgcatcatgcgctgcaaggaagccaccccggtcaacgccccgaccctgttccgctttggtgcgtttggtcgtcttggtgccaacgacaacgtggaccagctgttcaagaacgagcgtgccaccgtgtcgctcggctacatcggccttgccgagaccactgcggtcttctatggcaagaactggattcgcgaccacggctgggatccggaaggcaaggagttcgcgctgtccatcgtcaagcgcatgaacgagctgtgcaagcagtggagcaaagcggagggttaccactattccgtgtactccactccggctgaatccctgaccgaccgcttcaaccgcatggaccgtgaaaagttcggccgtatcgaaggcgtgactgatcacgacttctacaccaactccttccactacccggtgtggttgcagcccactccgatggagaagctcagctacgagaaggacttcccgtactacgcttccggcggcttcatcaactactgcgagtacccgtgcctgcaggacaacccgaaggcgctcgaagccgtgtgggattacgcctacaacatcggcatcggctacctgggtaccaacaccccgatcgaccactgcttcgtgtgcggcttccagggcgacttcgagccgaccgaggaaggcttcaagtgcccggagtgcggtaactccaacccggacaagtgcaacgtcaccaagcgcacctgcggctatctcggcagcccggtccagcgtccgatggtgcacggccgtcacgaggaaattgcccaccgagtcaagcacatgagcggcgaaaccggtcgtgtgacgctggatgacggaaccactcgcgagtggttcgaagagaccaagtagggtttatacttgctcccgctgacgggagctgtagagcgtaagcgagactgagggcggtcatcctttatggtgttgaccaccctcagtccgtctgatgacggacagctcccgccagcgggagctaatgctttccgtaaggagggaatcatgccggagctgcatacgaccaagcccgaacccaagcgccatgactttgcggccggcgagaccgggcgtggcccctccgtaccctccaacggtcttgccaacgatccgaaagccggtcaatgggatggccggcgcatgtccaagcggatgatcgccgactacaaaaccttcattgtcaccgacggagaaggcgtgcgcaactccctttacgtctccggttgccccttccactgcgtcgactgcttcaacgcctccatctgggatttccaagccggccacgaatacacgcaaaaacttgaagacaaaatcatcgaagatctgaaagccccatgggtgcaaggcattacgttccttggcggcgagccattcctcaacactcccgtgctggtgccgctcgcacaacgtatccgccaggaattcggtcataccaaagatatctggtcgtggaccggctacacatgggaagaactcatgcgccccggagaaaccccagacaagcttgaattgctacatctcatcgacattctcgtcgacggccgctacctcagagaccagaaggactcgctgctgcaattccgcggctccagaaaccagcgcatcctcgatgtgcccaagtctctggaagccggcgaaccggtcatctgggccaagctccacgatcaagaacgagatatccccgaaatctatttgaaagaccgcgaagccggcgaaggccaacaggcctcgtagtagcagttctggaatgccgcactcagcaatatcgttggaactgttgggaaaaggccttcccgtgagcgaaatcgcctcgcctcgtgccatgttgggcaggtggtcggactaatattccataagaagtagccgggcgaagccgtccgcagggtatctgccagccgtcccgaaacggttcatgatgcctcaaagcgtgcactcccggaagtcggaattaagaggaacacatggttgacatcgccactgacgcgagcgtaaagcccgcttcacacccgaagcccctgcgtgtgggattggacatcggttccaccaccgtcaaggccgtggtgcttgatcagtccgattccctgggagacaccctcttctccgattaccgacgccaccacgccaacgtgcgtgccaccgtggccggcctgttggtcgacatccacaagaagcttgtggacctcggacgcggcgatgaaccgattcgcctgtctatcaccggttccggcggtctggcgcttgctgacaatctgcatgtgcctttcattcaggaggtcatcgccgaaaccgaggcaatcgacaaggaatacccgcaggccgatgtcatcatcgagctcggcggcgaggacgccaaaatcacctacctgaaacccacgcccgaacagcgcatgaacggttcgtgcgcaggtggtaccggcgcgttcattgaccagatgtccacactgctcgacaccgacgccgccggcctcaacgagatggccaagagctacgagaacctgtatccaatcgcctcgcgttgtggtgtgttcgccaaaaccgatttgcagccgctcatcaatgatggtgccgccaagcccgatttggccgcctccatcttcaccgcagtggccacgcagaccatcgccggcctggcttccggacgcccgattcacggcaccgtcatcttcctcggcggcccgttgttcttcatgtccgagctgcgcgccgcattccagcgcgcgcttgagggcaaggtcgacgagttcatcgtgccgaccgacgcccacctgtatgtggcctacggttcggcattgcaggccgacacggattccgacgatcagggccaccatttcgaggcctacacctgcgacgaaatcctgaagcgtttggacgagctgaagaacctgccctccaacacgcccaccatgccgccgctgttccccaccgaggccgatcgcgaggacttcaacaagcgccaccacaaggaacacatccacatcggcacccttgaaggcgcgcacggcccgcacttcctgggcatcgacgctggttccaccaccatcaaggccacgctcgtcaacgacgaccgtgaaatcgtctggtccagctacgccaacaacgaaggcagcccgctgaccgccgccatcaacatcgtcaagaagattcagtctgagctgcccgaaggcgcgtggatcgcacgctcctgcgccaccggatacggcgaaggcctcatcaccaccggactgcacttggacgagggcgtggtggagaccatggcccactatcgtggcgccgaaatggtcagccccggcgtcaccgccgtcatcgacatcggcggccaggatatgaagtacttggccatcaccgatggcgttatcgattcaatcgccgtcaacgaggcctgctcgtccggctgtggttcgttcctgcagaccttcgccatgtccatgggcctgacgattcaggaattcacgcaaaaggctctggcttccacccatccggtggacctcggttcgcgttgcaccgtgttcatgaactcctcggtcaagcaggcgcagaaggaaggcgcctccatcgaggacatcgctgccggcctgtgctactccgtggtgcgcaacgccctgtacaaggtcatcaagctgcgcgattccggcgaactcggcgacactgtggtggtccagggcggtacgttcctcaacgacgccgtgctgcgcgcgttcgaactgctcaccgaacgcgaagtcacccgaccgaacatcgccggcctcatgggcgcgttcggcgcggccctcaccgcccgcatgcactacgaggacatcgcggacgacgacaacgcgcacgtcggcgcggacgggcgttccgtcgacgcggcggcggctgaggagtccgccgccggcgacgagccgaacgccgccgcgcacgccggcgaaatcgtcgtcgacggcgtgcgccacaccgtctcgtcaatcctcaccggcgaagccctcaacgaaatgtcgatgaccaccgaacgcgacgtgtgcaagctgtgccagaaccactgcaagctcaccatcaccacgttctccgatggctcccgcttcgtgaccggcaaccgttgcgaacgcggcggcgatgccaagaagaaacgctccgaccgtccgaacctgtacgactacaagtacaagcgctgcttcgcctaccgccgcctcaccgacaagaacgccacccgaggcgagattggcattccgcgcgcgctcaacatgtacgagaactacccgttctggttcacgctgctcacctcgctcggtttcaaggtgatgatctccggccgttccagccacgaactgttcgaaaccggcatcgaatcgatcgcctccgagaacatctgctacccggccaagctcgtgcacggccacatcaaatggcttctcaacaagggcatgaagacgatcttctacccgtgcgtcagttacgaggacaacctcgtgcccaacacggacaaccactacaactgcccggtcgtcgccaactatccgctcgtcgtcggcgcgaacatgcccgaactgcgtgaccccgacgtgcgctacatgcacccgtacttcaacctcgccaaccacgagctcatggtcgaccgtatcgtcgaggagttcgcatgggcgagcgtcagccgcgaagaggccgaaactgctgtcaaggccgcctacgccgaagacaaggtcttcaaacacgacgtccagcaggaaggcctcaaagccctcgcctacatgaaggagcacgactgccgcggcatcgtgcttgccggacgcccctaccacatcgacccggaaatcaaccacggcatccccgaaaccatctgcgcgctcggcatggtcgtcctctccgaggattcgatctgcgaactgcagccgggggagaagctcgacctgaccgacttcctgtccgaaggcgaagaggacccgcgcaagaagaacgcgaacggattccgccacgtcgacgaccgcaaggtcaccgtcaaccgcatgccgttgcgcgtcaccaaccagtgggcctaccattcgcgcctctacgcggccgcgcacttcgtcgcctcctatccgggcctcgaactcgtgcagctcaactcgttcggctgcggcctcgacgccatcaccaccgaccaggtggccgagatcctcgccgacaaggccgacgtgtacacgctgctcaagatcgacgaggtctccaacctcggcgcggcgaagatccgcctgcgctcgctcaaggccgccgtcgaggaacgcgaagccaacaaggcccgcgaagccgccgcggccaaggccgtgcaaggccccaagtccaccggattccgcaagaccggctccaccgcgccaacccccggccgccagattctgcttgacagcaccatggccgccaacccgaagctcaccaaggccatgcgcgccgcctccaagcgtgccgccgaacgcgacctgcaggccgcagtcgccagcaagaacggcacttcggacggcaccaccggcgtgacgaacgccaagaatgccaagaagtccggccacaacaacgccaccatgtcccgctacgctcatcgcgagaagttcgtcaaggacatgaagaaggactacacgatcgtcgccccgcagatgagcccgatccacttctccctcgtcgaatcggtgatccgctccggcggctacaagttcgacatcctcaagcacgcctcgcgcgaagacgtggagactggcctcaaatacgtgaacaacgacgcctgctatccggccatcatggtcatcggacagctcatcgacgcgattctcgaaggcaaatacgatccagacaaggtgtgtctcgcgattacgcagaccggcggcatgtgccgagccaccaactacttcggcctgatccgcaaggccctgatcgacgcgggttacccgcagatcccggtcatcgcgatctccacgcagggcctggaggacaatccgggcttcaaggtgacgcccgcgctgctgcaccgcaccgtcaaggcgctgatcctcggcgacctgctcatgaagtgcctgtaccgcgtgcgcccgtacgaggtggagaaggtcgcggcgaaccgcctgtacgagcagtgggacgtgatcgtgcgcgaggcgctcgaacaccacggcttctcgaagacggccgcgaagaccccgtggctcaagcgccgctacctgccgtaccccgtgctcgcccgagagatcgtgaagagcttcgacgctctgccgttgaaggacgtgccgcgcaaggtgcgcgtcggcgtggtcggcgagatcctcgtcaaataccagccggatgcgaacaaccatgtcgtcgacgtcatcgaatcgcaggattgcgaggccgtggtgcccggcatcatggagttcatgaccacgcgcccgtacatcaccgactggaacgagaagtatctcggcaccggcggcaacaagacgttgtacgcgctcatgcgttggagcctcgaccgctacaacgcgccgatcaaggcggccatcgccacctctcacggcaagttcaagcaagacgatccgatgcccgaactcgtcgagaaggctgccgaggtcacgtcgatcggcgtgcaggccggcgaaggctggctgctcaccgccgagatcctcgagcttatcgaacagggatgcccgaacgtgatctgcgcgcagccgttcgcctgcctgccgaaccatgtgaccggccgcggcatgttcggcaagatccgccgcctgcacccggaggccaacatcgtgtccatcgactacgatccgggcgcctccgaggcgaaccagctcaaccgcatcaagctgatgatcgcggccgcgaagaaggcgcacaaggcgaagttcgccgacggcgacgagccgcagggcttcactgccgccgactgacctcaaaccgacgtccaaccgacgcccggtcggcaccagaccggcgcagaccgggcaaaccggtctgcggcctacgacaaggcgggtgtcccattccgtatggaacgggacacccgccttattcgttctggtgcttttcggccggcaccggtcacacccgtcctacccgagcctgcctgccgtgaaccggtacagcgcgtcccatggcaggtcggtcacgtcgatcgcttcggcgcgctggctcacgagctcgtcgtaacgttccgaccgcatctgcgccttcacgttgccgcgcacctcgtccagcggagccttcccgtcgacgccgtcctttgtccagtcgtgctcgtcgtagtagcgtcgcacctcgtcgtcggacaggctcatgccggggttcgactcgtcgcccgtataggcgttcttcaacgcggacagttcgtagctcaggtagctgtcgatgtcgaagccggtacggccgtagacgatgccgccgtccgatttcagttccgcgttgccgctgttcacggcctccatgcgcgcgacgatgctcgcataggagtcgtcggccacctgcccgagatccacgccgatgaggtacgcggcgtgccgacgtcgcagttcgtcgatggcacggctcgcgagccaacggcacgggacctcgccgtcgtgcgccttatcccagccgtcctcggccgggtcgacgccgtacgtctgccgaaagtacagccgcgccgcgccgtgttgcgccttgagcgccgcgacgtactccttgcgttcgatgacggtgtcgccgaagacgatggtggggaacatgtcggaatcctcgcttgcattggagccggtatcggagccgatgccggcggatgcgcccgcgcccgcaggcgtgcctgcgggcgcgaaggcgccgtcgccgtgcgtgacgacggcgacggtcaatgtgacgagcaggaccgccgccaccgcgactgcggcgatggcggcggcgaaccggtgcctacgtggcatcggtcacctgcggcgacgggccgcggcggccagtccgatgccggcggccgcggtcagcgcgaccatcgcggccgcgccggccacgtcggcgccggtggcggtcagcttgccgccggtggtcgcgccgtcgctgccggaaccggtggaaccgttgccggaaccggaaccgttgcccgtgccggaaccgttgccggaaccgtcacccggcttggtgtcggggccggggtcggggtccgggtcgggcgtcggatcgggatcggggttcggatccggtttcgggttcgggtccggatcgaccggcttcttctccaatccgtcgatggcgtcacgcagtgcgttctgcgcggtctcgacctgttcggcggtggcggcatcgtcgtccagcacggtctgcgcggcgtcgcgcgcggcgacgagcgcggcccacgactcatccgtgtagtccgactcggccaatcccagagcctcctcgaccgtggccttcagcgtggacttgtccaccggaacgggttcggggcccggcgtggaggcggccatgtaggcgatgaccggggagatgtgcgcggacggcttgttcatgccggacgcggacgtcgcggtgacgcggatccaatcgcccgcctcgaccgcgatctcgcccttgtcggcgacgcagttggcgaactcctcggaacgctgcttggagacggtcaggtcggcgaagcacaccaccttgtcgtcgtgcatgagacgaagcgtcaacgccttgccgttgctgccgtcctggcgcaggtacggctcgtcctcgcggatggacaccttcaccgtgccggccttcggcgccttccacgccatggcggagccaccagcggacgcgggcgaatcgctgatcaggccatggatggcggagcggtcggtgggcaggctgtggttcgcgtagtccacgcccggaccgtagtaggtctcgtacatccagttcggatacgtcgcgtcgaagtcggcgatatccgaccacacgccgtcggcctcggtctgacgctgcccgtaccagatcggaccctgcacgcgcacctggaagtcgttcacccaatcccacgtggtcttcgacttcaccacgtagtcgtcggacacggtggaacctttcgcggagaagcggagcacgtcgttctcggcgagttctgcgccggcctccaaccgcacgccgtcacggtacacgcccttatcggcgccggacggttcggccgtcaccttggcgagcagctgcgcgacggtcatcggactgtcggcggagaacggcgcgtagacgacgttcacaccgtcgacagtcgcggtctccaactcggacgagccgagcgcggcgggcgcggtcacctcgaagcgggcggtggaggagacgctggcgccgtcgtcggcgaacgtcaccgtgacgggcacggtgacggtgccgccgaccctgctgttcagcgtgaccgtgccgttcgccatgtcgacactcgcgccggccggcgcgttcgcgccgagcgcgaacgtcgtgccttccggcacagacgcggccgcgccgtccgccttcagcgtgaacttcggcgtgcgcttcaggtccgtgccggcgtcgccgcgcacggtcgggtacagcacgttgagacgctgcgcgtgcgattgcgcgacacggaacgtgacggtcgtctcgtcgctcgaaccgtccgcgtacgtgacgacgacggtgcgggtgacggtcgcgccgtactgtccggcggcgggcgtgaaggtgacggcgccggtggacgcgtcgatgacgggcgaggcctcgccctcatcgccgccgtccttgaaggcgaacgcgacgccgtccggcgcgtcggcctcgccgccgtccgcggtgaacgcggcggcgacggccgactgcgtgccgacgacggcgtccgtcgcggcgtacgagacgtcgtagcgcacgttctgcttcggcgcggcgggcgccttgtcctcatatgtgatgaccgggctgatgtgcagcgacggcgccttgactccggtctcggcgtcggcgacgatgcggatccagtcgccttcctgcacgtcgatcgaaccgtgctcggcgaggcactgcgcgaactgttcggaggacttctgatagacggacaggtcgtcggccgaacagagcgtctcgtcgttgcgcatcagcgacaatgtgaccttcttgccggcgttgtccgcgttctgacgcaggtacggttcagcgatcttgtcggcgaacgtcttgagcgacagcatgacggtgccggactccggcgccttccacgccatggccgtgggcaggccgtcgccgggcttgtcgatcagcaggccgtgcgtctgcttgcggtcgccggagagttcggcgagggtgccgttgacgccgacaccgtagtactggtcgtacacggtgttcggccacgagccgtcgtatgcggagatggtggtccactcgccgccggcggacgtgcggcgctgcgccttccagtcgaagtcggcgacgccttgctcgtagtccgcgacccaatcccacgtgatgcgctggcggatcgtgtactcgtcggtctcgtccgtgccttcggcggagaagcgcaggatgtcgccatcgcggaccggttcggagtcggcgagcttcgtctcgtcgtccttggcgttccggtcggagcctgggagcagggagagcaggcggtcgagcatgttcggttcggactcggcggacctggcgtcggcggacttgccggacttggcgtcggcgactcggtacacggccttgtccacgcccttgtcggcggacacgttggagagcagttccttgacggtcaccgggttcttgtcggtgaaggtcacgtggatgaccttggtcttgtcaccggtcccggaatcggtttcggttccggtctcgtacttggaggaggccatcgtgacggacaccacgtcgctttccacggcgcccagatcgggcctgcccttgactgcgttgccgaggaagtcgttctccaccgcgtagtcgttgaggtcggagacgaccttgccggcgttgatcgccttcgagcccgcgaccggacggtagccgtcgaacgcggctttctcgccggtgcgcgcatgctcggcgccgctcttgagggcggatgtcggagccgaaccggcgcccgcaagcactgcggacacgtcgtcggcctcgatggcgttggcgtcggaggtgggcttgttcgcgtagttgacgtacatgttgttgtcgtacgtctggccgccgttctggctgccgcggttccaggtctccgtcttcttcgtgttggtcgcgttgatgaagatgttgttctcgaacagggactgcgagttggaacgcttagtcagcacctggctgtcggcgtccacgtagacggtgttgttgtagatgtggttgccggggccgttcgacggcaggtcgaacacgccctgacggtcgttctgcgagatattgtatcggaacgtggtgttaaccgcgtaccagttgcagatcatcagcgaggcgaagctgttgccgtacgagtagttgtactggtacagcgtgccgtcgccgtagtcggcgtcccacgcctggccgtcgccgttgccgtgctcggcgttgaggttgttgtacatctcgttgtactggaacactggatccttgcaacgccacggccagatgccggccgccacgcgtccgccgtaggagccgggctgcgtgtagtcctgcgtgttgatgtgcttcgagacgctgtcgcccacattgtgttcgatgaccgggcggtcgcagtacatcagggtgatggcgtcgccgccggcgcccttgacgtagttgttctcgatgcgcacgttggtggaaccgtacttcgcgatgagggcgtcgtcgatggagccgtcgccgtagttcgcgtcgatgtagttgaggtaggcggtgtagccgacggcgatgccccaacgatccacgtccttgacggtgctgtttctgatggtgacgtggtcgaagcgtgagacgtgctccctgagccagacgtcggtttcggcgctcgtgttctccatggggtagtgggccatgaagtagatgccgccgttggccatgtgcttgttgtagatgttgccgtccacgtcgtggatgtaaaggttgtcgagcgtcacgttgctcatcgtcgcgccgttctcggcgatgccggccacgccggtgcggtccatgcgcgaggcgctgcggtcgagttttgtgccgtcggaatcaggggtgtcggtccacttccacgtgtcgatcggatcgtagacgtccgcgtcgtcgttggtgatctccaggttggagacggtgatgtacgacacgtccttgagtagcagcgtggttgagacggtgcccttgttcttgtggttgccgacgttggcacggtagtcctgctcccactggctgcctttgacgccgttcgacgcgatgaccggcttgccttcgtcggcgtcgccgtaggcggagatcgtgatcggcgcgtcggcgttgccggcggtgtccttgatgtgcaggtactggtcgttgaattcggagccgtattccatcagcaccgaatcgcccggaccgaggtccgaggcgatgtcgttgaccttggtcagggacttccagggcgcgttttcgctggtgcccgcgttggcgtcgtcgccgtgtgccgacgacacgtagtaggtggtgcctgatgacgtggtcgtagcggtctcctttccttgcgttgctgactgcgcgaacgcagcggtcggcaacgccagcgcgacggccacgcccattgcggccgtcgcggctatggcttgtctgccctgacgggatgtcatgccgctttccttcctttcgattgtggcgcaccggcgtgccggtggggtgccgggcgtgtccgatatgtcctcggtccgtttccggtatggccttcggcgtggtttcggtgtggaaccggagcggtcgccggtgcgcttcggtgtgcgttccggtgtgcttccgacgtgcttatggttgccggtgttttgtatgggttgttgctgttttccgtgttctgttgttttctgttgtttttcttttattccggctgttcgccgtgggttgatggtgggttgatggtgtggtccggcctctctgccggacgtttctgtaaacaaggtttacaaatcaatgagtgtatccgacatcgcgcataacggcaaagccgtacggtgtggcgcggcgttgcggaggcgtggcgtgcggtgatgggggcgtggcggcgcggtgtggtgcgacggcgcggtgcggcgttgcggcgtgatatggcggatgtccggcgacgtgccggttatcggaaaaagatatagccgattcgcgggcgcgcggcgacgcgcgtcgcgcgactcgcctacgataccgttcatggtcactcccagaatcagctatgcgcacctgctcgccgagccgaacccgaagcatgtcgagagccttctgaagttcttcgaggcggggcgctccaagcgcggcaccggtggtttaggtgtcgagattgagcatctgccggtgcatgacgccgacgacacggccgtaagctactacgagccgaacggcatcgaagcgttcctcaaacggctcgctccgtattatgacgaaagcaaggaatactgggagaacggccatctggtcggactcgcgcgcgaaggcgttgcggtgtcgctcgaaccgggcggccaggtggaggcttccatcggcgtgcttcatgagccgggcgacctcaacggcctgtacgccgacttccggtgtgaggcggacccgatcctcgaggagctgggcttccgtttcgtcaactacggataccagccgaagtcgagtttcgtcgacgtgccggtcaatccgaaaggccgctatgacgcgatgaccgacttccttggccgcgtcggccagttcggtccgtgcatgatgcgctgctccgcctccacccaggtgagcatcgactatgtcgacgagaaggattcgatcgataagatgcgcgtcggcaccgccatcgggccgattctcgcatggttcttccgcaacaccccctacttcgagggccgtctcaacccgtatccgctgctgcgccagcgcatgtgggactacctcgacttccagcgcaccaacgtgacccccggcctgttcgaccagcgtttcggctgggaggactacgcgcgtgacgtgctgtccacgccgctgatgttcgccgacctgacgcacacgcccgaagcggtggaatcggggctgagccgcaaggagctgcatcgcgccgccttccgtgagaacgctggcgaggtctacccggaccgcgagctcaacgcgtacgaaatcaaccacatcatctccacgcatttcaacgacgtgcgtctcaagaacttcatcgagttccgccactgggattcgctgccgatcgaacgcgtcgaacggctcaccgagatcatcgcgtccctgtactacgtgccgtccaaccgcatccgtctcgaaagctacttcgacgggctcaccgaggaagacgtgttcgaagccaaggcgaacatccaggcgcacggccgcgaatccaacccgtatggccagccgctcgacttctggcgtgagttcctcggcctcgagggcctgctcgacgatattcccggagatccgaagcaccccgacgtgttccagcgctgaccgggttccatgccggccgtgattcgggccggagcgtcctggcgggcgttctggcccttgtcgtaccggccgcggcctgccaggtgccgggtgtgtttggtctaggattacgaaaaccccggtcggtggtcggctggccggggtcgcgccagaactccctgttcaccatcaccgccgacacgcacgaggtgcgccacaaccccgaatactacgtgatgcgccacttctccaagtacgtgcgccccggcgcgaaggtgctcggcaccaccagccacttcaactccatggccatcgccttccgcaacccggacggcaccatcgtggtcgtgacccagaacgcgctggaggacgaacgcccgttcgagttcgccgacccggccgacgcctcccgtggcttcaaggccacgctcgccccgcgctccttcaacaccttcgtcatcgagtgaccgcacggaacccagaaaggcgaacacaaccatgaccgcgaccacaccggaaaccacagtcgaaacgctgccctacaagaaccccgacctgcccgcctccgagcgcatcgccgacctgctctcccgcatgaccctcgaagagaaggtcggccagatgatgcagctcgacgcccgcggtggcgacctcgacgagctcatcgtgaacaagcacgtcggctccatcctgcacaccagccccgaggacctgccgcgcgccgtcgaaaccgtgaacaccaagacccgtctcggcatcccactcgtcatcggcgacgactgcatccacggctactccttctggcccggcgccacgatcttcccctcccagctcggcatggcgttgagctgggacccgaaggccgtcgaagcggccggccgtgccaccgccgaagaagtctcctcgaccggcgtgcactggacgttctccccggtgctgtgcatcgcgcgcgacacccgctggggtcgcgtggacgagaccttcggcgaggaccccatgctcatcggtgagatggcctccgccatggtcaagggctatcagggcggtgcccaggccggcgagacgctgccgaaggacgcgatcctcgcctgcgccaagcacttcgccggatactccgagacccagggcggccgtgacgcctccgaagcggacctgagccaccgcaagcttgaatcctggttcctgccgccgttcgaacgcatcgccaaggagggctgcggcacgttcatgctcggctacgagtccatcgaaggcgtaccggtcacgttcaacaagtggctgctcaccgacaagctgcgcggcgcatggaagtacaacggcaccctcatcaccgactgggacaacgtgggccgttccgtatgggagcagaaggtcaagcccgactacgtgcacgccgccgccgacgcggtcaaggccggcaacgatctggtcatgaccacgccggggttctacgacggcgccatcgaggccgtgcacaccggtctgctcgacgagtcgctcatcgacgaggctgtcgcgcgcatccttgcgctcaagttccgcctcggcctgttcgaggacccgcgtctgccggacgagaagcgcatcaaggccgtcatcggctccgaggatcaccgccgcgtgaacctcgagctcgctcgcgaggccgttgccctgctgcgcaacgacggcggactgccgttcgacgcggcgccggccgaagcgatccccggctccggtgacgcgcccgcgcgcaagcgcatcgccgtggtcggcccgctcgccgacgacgcccagaaccagctcggcgactgggccggcagctccggccaagtcggctggatgcccgacggtcatccgcgcggcatgatcaccaccgtgctcgacggcttccgtgcgctcgccggcgacggatgcgaggttacctacgcccgcggtgccaacgtcatcgacctcgtgcccgacccggagggtgagttctacccggacggccagccgcgcccgaagatcggagtgagcgcgcccgttgaccgggccctgctcgacgaggccgtcgccgccgcgcgcgaggccgacctcatcgtcgccgtcgtgggcgatgtggtgcagctggtcggcgagacctgttccaccgccacgcttgaactgctcggcggccagaacgcgctgctcgacgcactcgccgacgtctcccgcgagaccggcaagccgatggtcaccgtgctggtgagctccaagccacaggtgctgccgcgttccatcgtgggcgattccggcgtgctcgccggccgttgcaacgatccgaagtccggcgccggatccatcctgtgggcgccgaacccgggcatggagggcggacaggccatcgccgagatcatcctcggcgaggtgaacccgtccggcaggctcccgatcaccttcccgtgccacgcgggccagctgccggtctactacaaccagatccgcggccagcacggcaaccgctacgccgaccttacgcaggacccggcgttcgcgttcggcgagggcgaaggctacacgacgttcgcgtacggtgagccgacgatcgtcggcggggcctcgaacgcggacggcacgttcgcgcagaccgacaccgtgcacgccgagatcgccctcaccaacacggggcgccgcgcgggcaccgaggtcgtgcaggcgtacgtgggcgacgtcgtcacctcatacagctgggccgaccgcgaactcaaggcgttccgccgcgtcacgctcgaaccgggcgagaccgcgaccgtcgtgttcgacattccggtctgcgactgcaccatcgccgacgccgatgcgaaccgcatcgtcgaacccggcgagttcgagctgctcatcggccactcgtcgcgccgcgacgacctcaagcgcaccaccttcaccgtcgcgtgaatctgctctgcgtgagatgctctcgcgtgagccggtcccgtgtgaatcggtttcgtgtgggcctcatatgtttccgcccgctccggtcgtatgctggagcgggcggtgtcgtttgtgcggaacggagcaatgatgcggaatactgatgagagggccatgccggaagacgatgggcgaatcaacggagtgaacctcggcggctggctggtattggaacggtggatgacgcccggcctgttccgtgcgagcggcgaggaggacgagatctggctgcaccggtccacggacccggccgaactggagcgcctgctgcgccgtcaccgcgacacgtacatcaccgaggacgacttccgcgccatctccgcgcacgggctgaaccttgtgcgcatccccgtgccgtttttcatcttcggtgacgtgcccgggcatcccggatgcgtcgaatacctcgaccgtgcgttcgactgggcggagagggccgggcttaaggtgctcatcgacctgcacaccgtgcccgggtcgcagaacgggttcgacaatggcggcctgaccggcgtggtccgctggcatacgacgccgcggcaggttgcgttcgcactggacgtgctcgagcgtctcgcgcgacgttaccgcgaccgccctgcgttgtacggcatcgaagtgctcaacgagccggtcgaccgtctcacttatctcatgtcgccgtcgagctcccgggcgaaggatccgggggaggcgcgggggagcggccacgttccgatgcgcttcctcaaacggttctatcgggcggcataccgatggctgcgcccggtgctgggcgacgggccggtcatcgtgttccatgacggattccgcctgaaccgctggcgcggctggttcgtacgtgagggcatgcgcggcgtcatcatcgacacgcacgcgtatctcgtcatgtcggaacggcccgaggtgctgttccgcatactgccggacgcatggcttatgcgctggtaccggctgttcgcggcgtggggcgcgcgccgcatccgccgtgccgcgcgctttacgccggtcatggtgggggagtggtgcgtggcgaacgggcttgcggcgcgcatgggggagtgcggggcgcaaggtgaggtcgcgtccgttgatgcgtctggtggtgcgttcgacggatatggtgcgttcggtgacggcggtgcggatgttggagacggcgcatccggtgacgtcggttcgcgcgcgggcgacgccggggacggcgtcccgtcgcccgccgcgcgccgccgcgccgtctacctccgcgtcgccgccatgcagctcgacgcgtggaacgtctccgccggtcaggtctactggagctatcgactgcgcggcggtcgcggcgagtttgaccgtctcgcgcctcccgcgcccggtatgggtgacggggacgccgccgtgatggacgacacgcgcctcgacccttgggatctgcggcatgtctggcatgcgggatggatggggtgatggttcgggatgacggtgattgatgacgcggtggcggaggtgatgtgcgagacgcgcgatttacggaagggtcagcggtatccgtcccataagggggaggggaacagcacatcctcgcagtcgacccacatggcgttgagatcgcgaccgggagagcgcagccagcgcagctgaatgccgtccatcatcgacaggcccgcctgaagcacgtgctccacgttcgcgccgtcgggtactgaccagttgatgttgagcgcgttcgtcacgctgcggcgctcgcggtccgcgaaatagtcgtgcgccggatgctttgaatcgagggcttcgatcgcgaaaccctcgacatgcccgccaagcagatcgccctgctcgaacaggtcgccgccgcgaaccagaacgtcgtggtcgtgctgtccaacggctccgtcgtctccgtggccccgtgggccaagaacgccaagggcattctcgaatcctgtctgctcggccaggccggcggccctgcgctcgccgatgtgatcttcggccaggtcagcccgtccggcaagctcgcccagtcgattccgctggacatcagcgatgacccgagcacgctgaactggccgggcgaggaaggccacgtcgactacggcgagggcgtgttcgtcggctatcgctactacgacacctacggcaaggttgtggactacccgttcggctacggcctgagctacgccacattcgagatcgatgacgtcgccgccgccaagaccggcgcgaacaccgccaccgtgaccgccaccgtgaccaacacctccgatgtggatgccgccgaaaccgtgcaggtgtacgtggctccgggcaaggccgacgtggcccgcccgaagcacgagctcaagggcttcaccaaggtgttcctcaaggccggcgaatccaagaccgtgaccatcgacctcgacgagcgcgcgttcgcctactggtccgaaaaatacaacgactggcacgtggaggccggcgaatatgccatcgaagtgggcgtgagctcccgcgacattgccgacaccgttgccgtggccctcgatggcgacggcaagacccagccgctcaccgaatggtccacctacggcgagtgggaggccgatccgttcggcgccaagatcgtggccgccgtggccgccgccggcgaggccggcgagctgacgaagctgcccgacaacgccatgatgcgcatgttcctcaaccccatgccgatcaactcgctgcccaccctgctgggcgaaggcggcaagaagatcgcccagttcatggttgacgagtacgccaagctcgcgaagtaagggctgaagcgaggcaatcgcacggcgtaatacagctggcttccctctcctgaggggagccagctttgtttaggctcaacagttgtttggagatactacaacacgccgattgttgtatgtgcaactgttgtatataggtctctttatcatgaattgttgcgtatacaacaatgtggggtgaaggtacaaacgcacacggcccccgcatggtacggaggacaatggatcagcatattctcagcatcgaaatgcgcgcggtaaccaaagccgtcgaccgctatttgggcgagagcatgccgcaaaccgccagggaaaccaccggcggcaacgcgcatatcatcatgttcttggcgcgtaaccgcggccgtgagatataccagcacaccatcgaacagaaattctgcatcacccggtccaccgcctcgcgtgtgctggccctgatggagaagaagggcctgatcgcccgtgaatcggtggagcatgacgcgcgctgcaagcgcatcgtcctgaccgacaaggcggacgcgatcgtcgccgatctcaaggcgaacggcgatcgggtcgaacggttgctggtcggcggcttctccgatggagagaaggccgctctgcgcgactacgtcgcacgcatgcgtgcgaacatcgagcgcgcacaacgcgaatttgaacatcaaacactccctcagtcacctgtggtgatggctcccgatcaagacggagcagaggttgctaacacgaaggaggagaacgaatgagcgataccgcagaggcaatcgcgcaggcgcgcaaagccgtcgaaccggacaagcccaaacatgtactgcgcacgttgggccagtcgattcgtgaatacaagaaagccagcatcctggctccggtgttcgtgacggtcgaaggcatcctggagatcctgatcccgaccatcatggcttcgctgatcgatgagggtatcaccggtggcagcatgccggccaccgtcaagttcggcgtgattctgctggtgtgctcgatggtttcgctgggtgccggcttcctgtccggaaagtacgcggccgtggccggcgcgggcttcgccaagaacctgcgcaaggaccagttcgagaaggtgcagggcttcagcttcaccaatattgaccggttctccaccggttcgatcgtgacccgactgaccaccgacgtgacgaacctgcagaacgcctacatgatgatcattcgtctgggcgtgcgtgccccgattatggtggtcgtatcctggctgttctcgttccgtatctccccgtcgatttccatggtgttcctggcctgcatcccgattctggccatcggcctgtgcggtctggccgtgctcgtgcatccggtgttcgagcgcgtgtttcacacctacgatgcgttgaacaacgtggtcgacgagaacctgcagggcatccgcgtggtcaagtcctataaccgcgaatccttcgaggtctccaagttcggccgcatctcccagcgcatcttcaaggacttcaccaaggctgagcgcatcatgagcttcaacagcccgctgatgatgatctgcatctacggttcgatgatcctcatcgcatggatgggcgcgcagcagatcgtcgcctccggcaacaaccccgccgtgggcctgaccaccggcgacctgaccgcactggtcacctacgccatgcagatccttatggccatgatgatgctgtccatgatcttcgtcatggtgattatttctcaggcttctgccgagcgtatctgccaggtgctgcaggaggaaagcacggtgcagaacccggcacagccggtgactgacatggccgacggctccatcgaattcgaccatgtcaccttccgctactccgacagttccgaaaagcccgtgcttgacgacatcaacctgaagatccgctccggcatgaccgtcggcattgtcggcggtactggttcggcaaagtcgtctctggtacagctcgtgccgcgactgtacgacgtgagctccggttcgctgaaggtcggcggcgtggatgtacgcgactacgatctcgaggcgctgcgcgatcaggtggccatggtgttgcagaagaacgtgctgttctccggcactattgccgaaaacctcaggtggggcaacccgaacgccaccgatgaagagattcgccatgccgcgcagctcgcgcaggccgatggattcgttcaggaattccccgataagtacgacacgtacatcgagcagggcggtaccaatgtgtccggcggacagcgccagcgcctgtgcatcgcccgtgcgctgctgaagaagccgaagattctgattctcgacgattcgaccagcgccgtcgataccaagacggacaagctgatccgttccgcgttccacaacgagattccggacaccacgaagatcatcatcgcccagcgcgtggcctccgtgcaggaatccgacatgattctggtgatggattccggccgcatcatggcgtccggcacacacgacgaactgctcgtcacctgcgatgaataccgttccatctacgaatcccagaccaagaaccaggcccagcccgaagaactggctgctgccgaacaggctgctgagtcatctaccgctgagccgtccgaaaccgtgacggtgacagtgcccatgcccacggccgataccagcgcagctgataccaatgcagccgataccaaggaaggagaagcacgatgagcaacgaccagagtttcaagaaccgcaagcccgccatgggcaaagccgagcctggcaccatcaagcgcatcttcagctacatcttccaatacaagtggcgcgtcatcgccatcgtggtgtgcatcttggtcggtgccgccgcgcaggccggttccgcgctgttcctccagtcgttgattgatacgtatattctgccgatggtgggggagtcgaaccccgactgggccccgctgctgcgggccatcagcctgatggcgggcctgtatgtggccggcatcgtggcgtcctggctgtggcagtggctgatcgtcaccgtcgagcagggcacgctcaagaagattcgtgacgacatgttcgcccaccagcagaagctgccgatccgctacttcgacagccacgagcacggcgacatcatgagccactacaccaacgacaccgatacgctgcgccaggccatctcgcagtcgttcccgcagatgttctcctcgattatctccgcggtcgcggcgctgctgtccatgctgtggctgtccattccgttcaccgcgttcgtaatcgtgttcaccgttctgctctacttcatcgtgcgcaagatcgtgagccgctccggccgctactttgtcaagcagcagcagtggatcggcgacgtgaacgccttcgtggaggaatccgtcaacggccagaaggtcatcaaggtcttcaaccatgaagacgccacccagaataccttcgacgagaagaacgaggaactcttcgaggcgtccgccgaagcgaacacctggggcaacgtcaccatgccggtcgtcggcaacatgggctacctgctctacatcctgcttgccatcgtcggcgccgccgtctcgctggccggcgtcaacgacatcggtctgaccggcgtcaagccgctcaccctcggcacgctcgtctccctgctgaccctatcccgctcgttcatcaacccgatcggccaggtctcccagcagctgaccatggtgatgatggcgctcgccggtgcctcccgtatcttcaagctgatggacgaacccatcgaggaagacaagggcaccgtgacgctcgtgaacgtggaacttggcgaggatggccgcaccatgaccgaagtcgaccacgagaccggccactgggcatggaagcgcgaggtcggcgacgacggtacgaggtctctgaaggccgcagaaaagctcaagggctcggcccgcgaggtggcgatgaaggccaaggagcaggcgatcacctcgcccgacggccgactgaccctgctgcgcggcgacgtgcgcttcaccaacgtgactttcggctacaacccggacaagccggtgctgcacgacatcacctggttcgccaagcccggccagaagatcgcgctcgtcggcgccaccggtgccggcaagaccaccgtgaccaacctcatcaaccggttctacgacatccagcacggccagatcctgtacgacggcatctccgtggccggcatcaagaagcctgacctgcgcaggtctttgggcatcgtgctgcaggacgtgaacctgttcaccggcaccgtgatggacaacatccgttacggccgcctgaacgccaccgatgaggaatgcatcgaggccgcgcgtctggtcaatgcggacagcttcatccgtatgctgcccgagggatacaacacggtgctggaaggcgacggttccggcctgtcccagggccagcgccagctgatctccatcgctcgcgcggcggtggccgatccgcccgcgctgatccttgacgaggccacgtcctccatcgatacccgtaccgaggaggtcgtgcaggccggcatggataacctgatgaagggccgtacggtcttcgtcatcgcccaccgcctgtccaccgtgcgcaattccgatgtgatcatggtgctcgaccacggcaacatcatcgagcgtggttcgcatgacgagctgatcgcgcaaaagggcgagtactaccagctgtacaccggcgcggtggagttggagtagtgctttttggctcccctcagagaggggagctgtcagcgaagctgactgaggggagccgcagactagatgcggttccccttaattgtctgcggtggaaactgccttaagacagatacccgtgccgctactgttcgctgtgatggacgtaggcgtccagcgagagccggtcgataagcgagggtatgacgcctttgcgggtgattgagtatccggcggcataggtggcgatttcgaccgcctgccgtacggtgtatccgtacatcagatacgaggcgagcgcgctgatgaacgcgtcgccggctccggtgctgtctacgggggtgaagtcagcggccggatagtggcactcgacattctggccgcgcaggtagcagccgtgttctccttgggtgacgatgacgcagccagcgccgcgttcgagaagatgcgcggccttatcctccattgtttttccctcagtttcgatgatcgccagttcgtgctcgttcggcacgagaatgtcggcattggcgacgatggagtcgggcagatagtcgcatgacgagggcttgataatggttttggcatggtgccgtcgggcggtgatcgcggtgactttggctgattccaacggtatttcggtctgtatcaggcagtatccggcattgtcgaacaggcgttcgttggaggtgatgtcatccggggtgagcgacgcgttggctccggagagaatcgcgatgaccgattcgccgttgggggcgaggaatatgaacgatgagccggtgtcctctccggcgcagcgtcgcacaccggccgtattgaccccatgctgttccatcgccttgaagatgtaatcggacccattgtcgacgccgacattgccgataagggtaacgcggtgcccgagcttggctgcgccgatcgcctgattgacccctttgcccccggggtagcgcgccgccgatttggtggataccgtacccccgatatgaggtagccgcggcactgacagatagtggtcaatattgatgctgccgacgaccaacacatgtttgatggcggaagtgggcggggctgcgatggtgctggtgttgtcgagatgaaaatcctgtacgaacgagggatgctgctctttgtcgtgctctatctgcgcaatgagcttctcgcagaggtaggcgccgaagtcggagttgcggatggtgtaggtagatatttccgtgttgccgggataggccagcgcttcggcggtgtcgtttttgatggagacaagtgaagcatcctctggaagccggtaatgcagggggctgatcatctgcgtgaactcgagtgctcgccggtaatgcgaggagacaaatccggtgatgtcccggcttccgattttgccgggcagcgagtcgttgaggtcgtagtagaccagatcgtcgctataaggcagctgatgatcgaacaggcaggagcgaaagccttcgagaaaatcctgcgtgcggcgtcccttggtcattaggcaggcgatgtgttggtgccctcgttcgatgagttcgctggtcagtttgtaggccgcttctttataaggcagtagcagtgactggtcgccgccgttgggtcctatggtcagcagtggggtgctttcggggaattgcgaggcataggcgaggctgtccggagtggccggttcccagatgacgccgtcgacgttgcggccgcatatcgctgcgatgtttttgagctcgcgttccggatcggaatagctgttgtaggcatcggttgcgtatccggcgttctgggcggcctggatgatgccgtccagcgtgctatcgaaggagatgggggagcgtagcagcactccgatggtgtagctacgcgtgcgctgtgaggcggaggcatatggcttgtaatgatattccttgacgatcgtcaggaccttcttgcgggtttcctcgctgatgctggaatccttgccgttgacgattttggagaccgtcgaggtggagacgcccgcgatgcgtgcgatgtccctgatgttcatgtctcccctcctgcctgttttcctctgtatcagtgtacaagggcgtagcgttctgttccttgctacgtcgccattgtgggccgttcggtccaggttgcttgaccctcgacccgccgtgttgacactgacgttggcgtcctataatcttatctcaagaaaacattttaggaaaatgatttcctaagattccgcaagacaaacaatgcagattgcacactgcggaaaaccgaggggtggaaaataaaggagggccagcatgacaaggaagctgtcgttctgggaagggatcaaggcacaattctccacaaagtgcctggtgctgattccgatcgcggttggaatcaatctcattggcggaactctgtgctccgcactcaagctgccgctgttcctcgacatgatcggcaccatcgtcgtcgcatgcctgtctggaccatgggtcgcggccctgaccggcctgctgaccaatcttttcctggcactggtagccaacccggtctatcttccctatgcggcggtgtcggtattgtgcggtttggtcgtcggctatatggtcaaggccggactgttccgcaagaagtggggcgtcgtggtcatctggctggtgtgcacgttcgtcaatgcgatctccgcatcgctgatcaccacattcgtatacggcggtgccaccggcgtcaacggtacatcggtgctgacggcaacgctggtcgtggccatgaaagacattctcgcctcggtgatttcctcgtcgctgatcgagaacctcctcgacaagggcatcactgtcgccatcgcgtgggtgatcgtgcagaagattccccgtcgctttctcagccagtatgcggccgactccatgggcggctcggacaatgatgcgctgagtgatgatgacgaagaagaagacgagtgagacatgtcgtcgcatatgccggtcatcaatgacaccgtaattgggaagctgaatccgatcaccaagatagcggccgtgttcgccttgggtctgtccgcattggcatggcctgacttcacgcttggtctgatactcgtggtgttactgcttgtggtctcgttcttggctcatatacagcgtgatttcgccaagataatgttcggtttcggcatccccgtcactgtgatgctcatgttcatccaagggctgtacagtcccaagaaccgtaccgcattactggattttggcttcgcgcaactggggctcgaaggcgtgctgtatgcggccaaagtggtggtgagcttgctggtgtttcttggcagcttctacatcatgaacaaaaccacctatgtcggtgctatggtatccgcgctcacttcggtggggctcagcgccaaggtcggatacctggtgctcgccagcctgaatgtcgtgccgcagatgcaacgacgtatggcggtgattcaggaggcgcaatccgctcgcggactcgatgcatcgggcggggtcatcgcccgcatcaaggcgtatatcccgttgcttggtccggttgtcatgtcatcgctgaccgacgcccaggagcggggtatgaccctggagacccgcggcttcggcattactggagtgaagcagaccagttatgtcaaggtcagctggaatgccgccgacaaggtactcaattggatcttcgtcctgtttctgatcgccgtggtcgccgtttccgtatgcatccgcatcggtgtgattccgtcgccggtctcgtggggaggcaagtgaatgagtccgatagtagaggtcaaggatttctccttcaagtaccgcgacaccaagcgtcgggccgtcaaacacgtggacttccaggtcgaggaaggcagcttcttcaccatcatcggcgcgaatggggcaggcaaatccacgttatgcaatgcgctcgtcggcctgatcccgcactatttcgtgggggcgagggctggacacatcctaattgacgggaccgatgtcgccgattcgaccatcgccgaactgtcgaagaccatcggcctggtgtttcagaacccgttcaaccagctgtcctacaccgccgggaccgtcgccgaagagctggcctacggattaggcaaccacggtgtgcccagagcgcagatgatcgaccgcgtcgaagctgtggcgaaattgatgcgcatcgaccacatcctagacaagaacccgctggaactgtcgggtggacaggtgcagcgtgtggctttcggatccactttcatcatggaaccgcgcattctggtgcttgacgagtgcaccacgcagctcgacccgatgggcagcgaggaaattttcgacatcgtcaaacagctcaatgcggacggcgtcaccgtcatcatggtcgaccatgacatggagcgagtggcacgatacgcggataccgtcatggtgctcgagcgaggcgaagtcgtggcccttggctctccgatggaggtgttctccgatccggcgatcgaagagcatggcgtggaagtgcccgattacgtgaagatcacccgtgcgctcggtggcccgattgccattaccgaggagccggccatccgcatggccaaggaggcgctctcatgaaaatcgagttgcaggcactggagcacgtctatcccggaggggacaaggcccttgacggagtggacttgacgcttgacggcaacgagccggtggcgatcatagggcagaacggtgcagggaagaccacgctggtcaagcatttcaacggcattttgcgccccaccggaggcaaagtgctgattgatggcattgacgtcaatgagcgcagcaccgccgaatggtctcgcagcgtgggctatgtctttcagaatcccgacgatcagctgtttctggaaagcgtccgcaaggaattcgaattcggtccgcgccagatcggcatgagcgatcaggacattgcgcatcgcgtggacagcatcgccgagctggtaggccttaccaaaaagctcgacgtgcacccattcgacctgacgcccaccgagaagaaattctgcacaatcggtgccgtcatcatgatggacccatccgtggtgatcttcgacgagccaacgtgcggccaggatgcgtcgggcaacgcccgccttgcacgcatcatcgaacgtctgaaagcacaaggcagactctgcatcacgatttcgcacgacatgaaattcgtcaccgcgaacttctcccgtgtcatcgtgatgtaccacggccgcgtgctgctcgatggccaggcccgcgaggtgtttgcccagaccgacacacttcggcgttccttcgtgacgccgccgcccgtcacccgagtagctcagggtgcaggcctcaaggagacggtattctccgtccccgcgttcatcaacgccattgctcaggaaaggaaccatcgtggctgatgtcattgctcaaatctatggaataaggaatgtcgaggacgctcgcatggtaatcgacatgggcggcgaacatatcggcgtctcctacggcaaaatcaagcggacgcccggtcagctcgattgcgaacgggccagggaaatcttcgaaggcgtgcaaccacaagccgtgcgcataggcctgaccgtcgccgaagacatcgacgaaatcagcgagaacctgcgcgaagccatgcccgacgtgctgcacctgtccggcgacatcgaaggcatcagtccggccgaagtggcggaacttaagagccggttccccgaactgaagatcatgcaggccatcccggtgctagccggagtgcctctcgacgaacagaaggtcatgcagtatgtgaaggactatgagccggtttccgatttcttcctcatcgacaccaaagcacctgctgccggagacatcggagcgactggcctgacccatgaccgggccatcgaccgggccatcatcgaggccaccgacgtgccgtgcatcatcgccggcggtctggacgcctccaatgtggccgaggcgatctatgccacgcacccgtatggcgtcgactcgttctccctgaccaattacgacgatgatcgcgccgatacggatcggtgcaaggacccggccaaggtcgaggcttttatcaaggcggccaaagatgcctaaggtcgttgtcgtcggcgatgccaatgtggatgtcattgtgccctatccgcgttttctcaacgaggagcgcacgcaggtcgaatatccgcagatcggcatccagggaggaggaacctcggcgaacacggccgtggcgttggcgaagctcggcctggatgtatcgttcgtgggcaccgtgggagatgatcagtacgggcgtttcgtcatgcaggacttcaaggatgcgggcgtggacgtgaccgggctggttgcggattcgaccctgagcacggtcggcgtattcgctttcgtggacgaccgcggagagaggtacctgtggggatggcctcgcgaacggcaatcgttcaaggtgctcgacgaaaaccttgtgccgatgcacatgattcgtgaggcggattgggtccactcctcgggcatgtgcctgacctacgacaccagcgccagggagacgatcatccgcatcttcgaacaggcccacgatgccggagtccctacatctttcgacctgaacctgcgtgtggacgacggcgtgctcgaccccgatttcgcggctgcactcgaacgcattattccgaatgtcgattatctgctgggatcagggccggacgagttcgcctatttaggcgacgacgacatgatgggcaacgccacggcctatgcggtggacggccggaccgtcatcgtccgggacggcgcccgaggatcgatcggtcttacgcaagacggcctgacggaaagcccggcgttccgggtgaacgtcgaagacaccatcggagcgggggacgtctataacgccggtttcatcgctgccagactcgccggagcctccctcgccgaatcattgcgagagggcaatgccgtctccgcatacaaagtggcccgtcgcggggcacgttcctcgccggacgctgcacagctgcacgagttcctcgccgggcaaaccggctgaacgccatgcccgaatatcgaccaatccaaagaacacaaccaacggaggtatccctatggaaaacaagaagaaggtcatccttgactgcgatcccggacacgatgacgcgttcggcatcatgctcgccgtgcagcacctcgacgtgctgggtatcacgaccattggcggcaactgcacactggagaacgtgacccgcaatgccatcaaggtgcttgaggtccttggcgcggcggaccgcatcggcgtatatccggggcacagctgcccgatggtcgcaccgctggtcaccgcaccgcagttccacggcgagactggtctggacggtcccgtgctgccggagccgacgcacgccgcacagaacaagcatgcggtcgacttcatcgtcgacactgtaatgagcacggatgacgtgacgctgatcgccaccggtccgctgaccaacatcgcctccgccatcaaccgtgagccgcgcatcgtggaacgggtcaaggagctgtgcatcatgggcgggtccgtcacctacggcaactggacccctgccgccgaattcaacatcttcgtcgaccccgaggcggcatcgcgcgtgttcaactccggtatgcacgtcaagatgactggcatcaacctgacccgtcaatgcgagctgaccgccaagcacgtagccaagttccgtgagatcggtaccaaggccgcgaacctggccgccgatctgaccgatttcttcatcggcgcatgcgaggaggagtccgagctgacgggcgccaccatgcacgacgcatgcgcggtggcatgggttatcgacccgtcgctgatcactgcggtcccgatgcatatcgatatcgagctgcacggcgcacttacccgcggtatgaccgtgtgcgactaccgtcatctgcgcggtaccgtgcctgccgtggatcttgaacgcacgccgacgatgggctatcgcggcgaagagccgaatgcggaagccgcgctggaactcgacttccccggattcgtcgacctactgaacagcaccctcgaaaactacgactgagtcttgcccctgaacaaccccctccaccgccggccggcgactccaaccccttctggccggccggcggtatctcgcctccaatcatcgaccaccgccatgcgaatgaacgaaaggagaaatccaatggagtaccgatgcctgttatgggatttcgatggcacccttgccgacactggcagcgacgtgtggaattccctgacgtacgccgcgcgtcgtgcgggcggggcgatcgatgacctgtacatgcgcgatgacgccaatctggccgatccgatggatgagatcatgcggcacgtgatcccctatcccggggaggcgtatctggagacatttgatgaggatgtacgcgtacactaccgcacgctcaatgatttttcgcgcaccagactctatccgggcattcagagcatgctgaatgagctgaagggacatagcgtacgcaatatcatcgtcaccaacaagccggagggcgcattgaggcgcatactcggcagcaaaggctgggcgaacctgttcgacgattggatctgccccgattccatacccggccgtgaggcgacgaaggtcgaaatgatagccgaaatcgttcgacggcatggcatcgcgccgagacaatgcctctatgtgggagacaccttcagcgacatcgaagctgcccggaccaacggcatctcctgcatagcggtcacatacggggatggcgacgaaatcgcgttgctcagcagaaaccccgcatatgtggcgcgcgacatcgcggaactcaacgacatcatgacggacaccgtcatacacgcaaggagcatgatatgagggatttcaccatatgcatcggaaccaccttcgttttcgggcgcgacgccgaaaccaaagtgggagacgaactgggcgcaaagggcgtttcccgcgtgctcatccatcatgatggcggagcatatctggaaaccagcggcttgctagatgccgtgcgccgcagccttggacgggccggcatttcctatacggagcttggcggcgtgaagccgaatccccgactgacgctggtgcgtgaaggcatcgccatcgccaaagcccgcaatgtcgacgccgttgtggccatcggcggaggcagcgtcatcgattcggccaaggcaatcgcgctgggagccgccggagagcgtgacgtatgggattatttcaccggcaaagtgccggtagagcgcacccttcccgtcgcggtggtactgacgtgcccggcatcgggcagcgaatccagccaggtcgccgtcatcaacaatgagcatgagcattccaagctcacgctgagcgaaccagtactccggccggcattcgcgttcatgaaccccgaactcagcgtcacggtgccggcgttccccactgcctgcggcattgtggacatgttctcccacatctgcgaacggtatttcagcgccgacaacgagatcggcgtaatcgaccgtatggccgaaggcgcattgcgcaccttggtcgatgtcggcccgaaatcgttggccgaccttgccgattacgacttgcgagcgcaaatcatgtggatttccaccatcgcgcagaacaacaccctcggcgtgggtcgtgaacaggactggtccacccacctgattgccaacgagctgagcgcgctatacgacacccctcacggggccaccctgtcaatcatcatgggatcttggatgcgcgtggccagcgagaaggccccgttccgtttcgcgcgatacgccactgaggtattcgacatcaggcccggctcgatgaacgaaaccgaactggcccggcgtggcatcgccgcaacggaatcgttcttccgctcgctaggcatgcctgtttccttcaaggacttcgatctgccgggcgacggcatcgaacgcatgttggacaacatcgatttctacgggccggacgccaccatcgggtccattgcccgccttgatcgcgacgattgccgtcgcatctacgaactggctgtcaccggtcccgtcatgggaaaggagtcctgatgcgcatactgaatttcggctcgctgaacatcgactatgtgtacggggtggatcattttgcggccaaaggccagaccatcacctcgcatgcgctcgacgtgttccccggaggcaagggactgaatcaatcgatcgcattggctcgtgccggcgccgatgtgcaccatgccggccaggtaggacgggacggcatgttcctgcgcgacctgctcgaatcctgcgcggtgggcgtgacctcggtggtagtgcgcgatgatgtgcgcagcggcaacgccatcatccaaaacgatgccagcggcgacaactgcattgtgctgtaccccggcgcgaaccgtgccatcgaccgtgatttcgtcgatcaggtgcttgacgggtatgggaagggcgattggctgctgctgcagaacgaaatcagcgaactgccctatatcgtgtcccgcgccaaggcccgcggcatgttcatcgtgctcaatccctcgccggctgactcgcggctcgacgaagtcgatcttgatgccatcggctgttttgtactcaatgagggcgaggcggcgatgctcacaggggccgaagaagacggggagacactgatccgtgcgatgcgtgcgcgtttctcccaggcggatatagccctcaccctcggcgagtgcggttcgatgtatttgcgtggggaccacgtcgtcacgcagtccgcttatctcgtcgacacggtcgacaccacggcggccggcgacaccttcactggttatctccttgccgacctgatgtccggcgaacccatcgcccatgcacttgatttcgccgcgaaggcctcggccctcgcggtatccagaaaaggcgcggcgccgtcgattcccatgcgagaggaggtagctgtttttactccttgcgctcgcgcataaggcattccaccaaactcaaaccaatagaaaggaatcaccatggcagaaaccgctgtcaaggagaaggcgaacggtatcccggtgcctgaggagggcaccgaagagtttgcccgtatgaacaagatggcaaagatcgccattccgatcgtactgatcatcttcaccatgggcgtgctgcagcagcaggctttcggcatgatctatgtgaacatcggcgaccagctcggccaggccaacctcgccccgttgatcacctcgattccgggcatcgtgctcggcatcgtgtgcgtgatctacggttctctcggtgacttcgtgtccctgaagaagatgatgattctcggcacgatcgtgttcgtgctcggttcgatcctcggctgcttcggcgacctgagcatctggatcgtcatcgccgcccgtaccgtgcagtccgcaggctggcaggtctccggctccatcttcctggtgctcgtctccaagtacatcgagaagaagaagcgagtcatctggtacggcgtgttcgtcgccgtgttccgtatcgccgcggctctgggcgtcttccttgccggctacatgacccttgtcgattggcgcatcctctttggtatcggcatcatcgcggtgttcttcatcccgatcctggccaagaacctgcctgacgagcatgccaagggcgcgcgcgtcgacgtgatcggcttcacgctcattggcctgttcgccggctcggtgaccatgttcttcaccgacatgaccatcttctggggtatcgcggtgctggtcaccggcgtggccttcgtggtctacatcaacaaggccgcggatccgttcatcaccccggagatgctcaccaacccggccttcgcgatgaccatgatcgtcatctttgtcggctacttcttcagctacaccctgaacgccggctgcaacgccatcggcctgaacgtgtacggcatcgactcctcccaggtctccaacctgctggtgtggtcgatcatcctcgccgccatcatgggcttcgccgctggcccgatcatccagaagatcggccgcaaggcctccatcattctggcgctcgcctgcatgggcggtggcctgatcgccgttgcgttcctgattccgatgggccagatctgggctcttgccgtggcgccgtgcatctactacttcggcacctcgttcttctaccagccgattgtggataccgcaacgctgaccgtggaggccgaggaatccggacgtgcattgggcttcaacgatctgatgcaggccatcaccggttcggtcggtgtcgcgatcttcggccagctcatggccaatggcgcgatgagcggcggctcactgttcggcaccgaatccggtccggcctcgacctatgccaacgtcttcatggtcggcggcatcatcgtcctgggtgcgatggttatcttcatctgctcgatgaagatgatctacagccgctcccgcgtcgccgaagacgagagctgacatcaggtcatatcgtctgctgatgtgacattgatatcgcaaagcccgtgaccggtgtattccggttgcgggctttgcgcgttacgctaagtagtaaagtaatttactgaagtactacgtaatgtttgcattgaggggatgatgtcatggtcacgatgaaggaaatcgcgcagaaatcaggcttctcgcaggccacggtatcccggctgctcaatggggacccgacattgtccgtcaaagaggagacgcgacgtcgcatcatcgaggtcagcgagcagcttggctacgctaccggatcacgccgtatcgcattgccacgccgtgtggccgtactcgacaacgccacccgcgaggaagaactggcggacgcctatttcgatgaactgcggtccgtgctcggcgacaatgccagagcccagcacatggaactcacgtcgttttcccatatcgacgatctgattgccaacgccggtgatttcgacggcttcatttccatcggaccgtccgtactctcttcggataaactgttgaaactccatctggtattgccctatggcgtattcatcgacatcaatcctgcgcccagcctgttcgattcggtacaaccggatttaagccaaaccattttggacgcattggatgtgttggtgtcctcgggcaaacgacgcatcggctatatcggcggtactggcttcacgatgggtttgcacgaatacccggaagacagccgattaaccgcattccgcaattggaccgagcgtttggggctggatgcggaaggcctgatttacgcgcaaggcgcgttcactgtggacaccgggcgcactctaggggagaaagcggctaacgatcatcgagatgacatgccggatgcgttcatcgtggctgcggacacgattgcagtcggcgtactgcaggcgtttattgctgcgggagtgctggtgcctcgcgataccagtgtgatcagtatcaataaccaggccatcgcccagtacacttcgccgacattgaccagttacgatatcgatcagaatgagctggccgatactgcgattacgatgcttgccgaggccatctccagtcggcgcacgctgcaccaccacaccttcatctccaccaccctagtagtgcgtgacagtttcgtaccagcacgataaagaagttccctctgtgcgataaagaagctccctctgtggagggagcttctttatcgctgttagaacagttccagattcacgtcgagcgtgtaggcgcgatcggcgggcagctggtactgctcatggacgggcgcgccccatgaatcgtcgccgcccacgcccatttgcgcggccaacaagcgcaggaacgtgtggcggaccggcggcaactcgttctggtgggtcgcctcttccagcatgagcgagctgtacggcaacaggctcgccgcgaaatgttcgctgccggcctggctgatacgcatgccgtgtccttgggcgtcaagcacttcggcccaacgcacgtcttcatggttgccggtctcctgcggcaccagatacggtgcattgtcttcggccgcggtgcgctcgaaaatgccgagcttgccaccgtgcagacggtcgcgataggtctcctcggggccaaggccgtagaagcgcaggttctcgtactgcttgggaagcgtccattccaatccgaatgccggcagcgtcggcgcatcggtggcaccggcatatcgggcggtcagatgtacacgtccgctggcggcatccacctcatagcgcacggcaacttgggtttcgcccggctcggccagcgtatatgtgtattcggcgatgacaccagtctcggtttgcgagaactgctgattcgccatacgtgcataacggccggcaccgaaccagcgcacgcggtcgaagccgctgccattgccgcgatcgttgtcggtcagcgggcggaagcaggtgatcgccggacggcgcaacatcatttcgcgaccgtcacgcttgaatgacaccatgccgccctgcgtgcgtgaaagcaacgcttcggtacgtccgtcaccgctgaccacgccgatgttccagcggccaaccgttactgtaccggtatcggaagtatcggaatcagccgtggagggaaccgcgccgcacgtggtcgaatcggttccggcggaagccggcgcgactgactgaacggtgtattggccgaacgccagttcatagccggctggtgaccacggtgttgccgttgccagcgactgatcgacctcataggtgatttcgccagcggcgtccaccgacgggaagtcaatcgggaaggtgcgggtctcgccggcgggcacatcaaagcggtagtcggcctgccagatggcattgccgtccgccagcagtttcgccgtgaacgcgaaatcaatggtggagacgaacagattgcggttttcgatggtcacatcgtggtcgcttacggtcagtaccacgggagcgtacagacgcttgacctcttgcagcttcggtgagggagagtggtcggcgaagaccaggccgtcgccggcgaactcatagtcgcagggacgatcgtcccagtcgccaccgtaggtcagacgttcggtgccgtcgtccagctgctgccacagggcctgatcgatgaagtcccagataaagccgccctgataatgcgggtaacgctccagctcggtgtacagatgcatgccgccgaccgaattgcccatggcgtgcatatattcgcaggagatatagggcttcttcggatcattggtcagatattcctcgatttccgcgggcttggcatacatgcgggtctcgatgtcggtcacgtcgtcaaaggggcggtcatgcaccacgccttcgtaatgcacgggtcgcgtggagtcggcggcgtgagcgaagcggtacatcgcgcggaacacctcgcctgcgtacgattcgttacccagagaccagatcagtacgctcggatgattgcggtcgcgcccgatcatgctggcgatacggtccacgcaagggccttcccagatgggattgctgcccggaatggcggtttcaggggtctccacatcaccgggaatggtccagctgccgtgggtctcaaggttcgtctcgtcgatcaggtacaggccgtattcatcgcacagttcgtagaatcgcgtctgattcgggtagtgggaggtgcgaatagcgttgatattgttgcgcttgcaggtgatgatgtcggtgagcatctcctgctcggtgatggcacggcccaaacgcgcgtcgaactcgtggcggttggcgccgcggaagatgatgcgcttgccgttgagtcgcataatgccgtcaacgatttcgaaatggcggaagccgagacgttgcggcaccacttcgatgatgctgttgtctgctgagcgcacggtgagcgtcagcgtgtacaggtagggcttttcggcgctccatggacgaatgttggtcagattcgcgcggaattgcacggcggtgctgtcgatcgcggtgtctgcggtgccgcagcagggtacgccggaggtgtcgacgatgtcggacatggcataggaatcctgccagaccggcgtgccgttggcatccatgagtgcggcgctgagctgcttggcgtcggcgatgttgcggatcacggcatgggcgtcgatggtgccggcatgggtggccgcctcgaaatcggcggtgatgtgcaggtcttcgatgtgcacagtgggttgcgcggtgagttcaacggagcggaataagccgtgcatgcgccagaagtcctgatcttccagccaacttgcggtggcgtattcatagcaggccacggccagtgtattggttccggaaatcagtgcctcggtgacgtcgaattcgctgggtgtgtaggagtcctcggcgtagccgacgaaggaaccgttgagccagacgtagatggcggtggaggcgccgtggaaggtcagcgtgatgcggtgcttgttttcgatggcggcggagacgggggcgcttgtctcgaaagcgcggcggtaaatggctacgtgaccatcagtggggatgttgggggctttgggatcgctgtggccatcccaggggtactgcacgttgacgtacttatggttcagcaagcccttggtttccagtgttgagggaacggcgatgcggctgaaaccggtgtcgtcataatcggttgcggtgaaatccggagattcagcgttgccggaatcgttcatggggaagccgaaaaccggggcggtcgtcacggcgacattccacaagccgtcaaggttttgcttgaggctcatcgtttcgttcggctgcggtacgtgatcgtagaagcgatggtcggaatgggctggttcgcggttgacggcgaatacggtcggatcggtgagccaatcagatgatgcgatggtggtggtggggatgggatgctgcataaccgctttccttgagttgataaccacgttgtcgattcagagggtaaaactctttactgattatggtaaaacctgatggtgcagatcgcaagttgctggaggtattttctgtggcggtgtgtcgcgctgtcgataattcatatggtgatagaagtgtgtattcgttggaattctgcgatttttgcgagtgctgcgacgttggttttgaggttggttctattgacaataattagtgaaaaaatttattaaatcttggtaatgatgtacgctatccaacgaggtcggagaagacctcaccgagaatgactctaaggagaagatgtcaatgtccgtttcgcagtcaccggagagcgaatcccaatcaccgaatccgaccggagatgaatccggccagataaatcgtcctaccaaagcagagactctgaggcgccgtgccgcctatgctttcggtaatctaggccagtcggcgttctataacgcgctgagcacctatttcgtcgtttacgtgaccagcgtgctgttcgtcaatgtcgagaaagccttggccaccaaactcatcgcactgatcacaagccttatcgtgataatccgtatcgcagagatcttccttgacccgttactgggtaacttggtggacaacaccaacacccgcttcggccggttccgcccgtggcagttcatcggcggcttggtctccgccgtgctgctcgtcatggtctacaccggtctgttcgggctggtcaacgtgaaccagacctggttcatcgtgctgttcgtcgtggtgttcatcgtcctcgacgtgttctattcgatgcgtgacatctcctactggggcatgattcccgccatctcctccgactcgcacgaacgcagcgtatatactgcgctcggtacgttcaccggttcgattggctataacggcatcaccatcgtcgtggtgccgatcgtgaccactttcagtttcatgttcactggttctcgcgccgaaagtcagtcgggctggacggcattcggcatcatcaccgcattgctcggcatcctgaccgcatggaccgtggcgttcggcaccaaggaaaacgaaagcgtcctacgttccagggcagatcagagcggcaacccgctgcaggcattcgccgctatcgtaaaaaatgaccagctgctgtgggtggcgttgagctacctgctgtatgcagtggcgaatgtggccaccaacggcgtgatgttctatctgttcaagttcgtgcttaacctgccggatgccttcgccatcaccggcgtgatccccgtgatcgcgggcttggtcatggcgccgctctacccggccctgaaccgccgcataccgcgccgatacctgttctgcggcggcatgatacttatggtaatcggctatgtgctgttcattctcgattcggccagcctgcccgtggtgatcgtggcgttgattctgttctacctgcctggcacgttcatccagatgaccgcgattctctccctgaccgattccatcgaatacggccagctcaagaccggcaagcgcaacgaggccgtaaccctctccgtgcgtccgatgctcgacaagatcgcgggcgcgctgtccaacggcatcgtcggcttcgtggccgtggccgccggtatggttggctccgccaccgccgccgacatgaccgccgccaacgtgcgcaccttcgagaccttcgcgttctacatcccgcttgccttcatcgtgctgagtcttctcgtcttcatgttcacggtgaagatcgacgaaaagatgcacgagcgcattgtcatcgagctggaagagaagctcggtgtggacagcctcgacgattagttgtgaaggtagattggctcggcttctctatgacgaatgccgccaacgggcacaaacctcgttggcggcattcgtctttccaggacaccgcaatcgcggatgcatgccgtttacgcgttgaatacgtattggtcaaggcggcgcatggcttccttgatgcggcttaagggcaacgcaaggttgacacggatgctgtagggagcctggaacatgctgccgtcctgccaatcgacgcccacatcccagccgcgcttctccaattccgccaaagtcaaaccatgagccttacaccactgctcgcagtcgagcagcagcatgtaggtaccctccggcttggccaaactcaccccttggaaatgcttggtgatgtagtcataggcgtagtcgacattgccggtgagcacctctttgagttcgtcgagccactcatgcccctcaggcttgtaggcgccgataagcgcatgcatggaaagcacgttcatctcgttatagtgggacttcgagctcttggccacgatccggtcgcgcagcatggggttatagataatgtggtagctgcccacgagcccggcgaggttgaaggtcttgctgggcgcgtagaacgctgcggttctattgcgtgcgtcctcgctgatcgactgggtggggatgtgctggtgattccccagagtcaaatcggaccaaatctcgtcggaaatgaccacgcaatcgttggccttgtacacttccatggccttctcgatttcccaacgctcccacacgcgcccgcaaggattgtgagggctgcagaacacggccacatggatgtgatgctccttgagcttcttatccatatcctcgtaatccatgcgccatacgccgtgctcgtccaacttgagcgggctgtggacgatgcgatagccgttgttctcgatgcacatggtgaacccgatgtaggtcgggctgtgcaggagcacgctgtcgccaggagcggcgaacgcggtcagcgtactgatcacgccacccaagaccccgttctcatagccgatcgcctcgctggtcaatccggtaaccccattgcgcgtggattgccagtcgataatggagttgtaatagtcgtcggtgggggagaagtacccgtagacggggtgttgcgcgcgttcgataatggcctgcggaaccgtgggcacggtcgggaaattcatgtccgccacccacatcggaatcacgtcaaatccgtccctcggtgggtcgggagcgaaacctaggtcggttcccaacccatcgaccgcaatcgcatccttgccatgcctgtccataatcgacgtgaaatcgtacgtcattcctcaacaatcctttctccggcccatacgggagccgcccctgaaccagatgtgcaatatcgccggtaaaggagcctagcgtgtttgctgacaatggtgcacgcgatgaatacaaaaatgagaaaaaatgatcattcctgatgaacattctcgttgatttgaccgcgtggcgtgttacgatatgcaccgttgtgaggcagtgatccgttatcagcggggagtcttcggaagaacggcggcaatcgcccagtagaaccgacgggatcggcccgagacagccgaacacaagcggtcgcgcaggctcgcggctccgagtgcaacagttcggagcggcgcaaccggtgcgataagcgaggtggtaccgcggtgcggagcgcataccagcgcccgtcatcgtcctcgtaggcaggaacggcaaacatggctgttccgggcggaacacagtcagttccggctgcgaggcgattgacgcaatcggccccacggttcggtacgtgacattcgtgaacccagccggcacacgtcggcgcccggcaatcgccatcaatgacgctcctgtaggaccagtgcacagtactaacaggagatttacggtgagcgaaaacgtatatcccaaggcgaacgagggcggcgagaccgcgcacgtcgcgccgaaccccagcttccccgacatggaggagaccgttctcgactactgggacaaggacgacaccttccagaagtctgttgaacgcaacccttccggcgaccacagccagaacgaattcgtgttcttcgatggcccgccttttgcgaacggtctgccgcactacggccacctgctgaccggctacgccaaggacgtgatcccgcgctaccagaccatgaagggccgcaaggtcaaccgcgtgttcggctgggacacccacggcctgcccgctgagcttgaggcgcagaaggaactcggcatcgactcggtcgaccagatcgagaagatgggtatcgacaagttcaacgacgcctgccgcgcttccgtgctgaagtacaccaacgaatggcagaactacgtgcatcgtcaggcccgttgggtggacttcgagcacggctacaagaccctgaacatcccgtacatggaatccgtgatgtgggccttcaagcagctctacgacaagggtttggcctaccagggctaccgtgtgctgccgtactgcccgaaggaccgcacaccgctgagcgcgcacgagctgcgcatggacgccgacgtgtaccaggaccgccaggacaccaccgtgtccgtggccgtgaagatgcgcgatgaggacgacgcctacgccgtcttctggaccaccaccccgtggaccgtgcccaccaacttcgccatcgtggtcggcgccgacatcgactacgtcgaagttcgtccgaccgaaggcaagttcgctggcaagaagttctacctcggcaaggacctgctgccgcactacgagaaggaactcggcgagaactacgaggtcgtgcgcgaactcaagggctccgagctggaaggccgccgctactacccggtcttcccgtacttcgcgggcgacgaggccgaatccgaaggccatgtgcccggcccgaacggctacacgatcttcaccgccgactacgtcgacaccgtcgaaggtaccggtctggttcaccaggccccctacggtgaagacgatatgaacacgctgaacgccaagggcatcaagagcaccgacgtgctcgacgatggctgccgcttcaccgcgcagtgccccgactacgagggtgatttcgtgttcgacgccaacctgccgatcctgcgcaacctgcgcgccggcgacggcccactcgccgagattccggaagagcgccgcgcgatcctcttccaggagaagagctacgtgcactcctacccgcactgctggcgttgcgccaccccgctgatctacaagccggtctcctcctggttcgtgtccgtgaccaagatcaagccgcgtctgctggaattgaaccagcagattaactggatcccgggcaacgtcaaggacggccagttcggcaagtggctcgccaacgcgcgcgactggtccatctcccgcaaccgcttctggggttccccgattccggtgtgggtgagtgacgatccgaagtacccgcgtgtggacgtttacggttctctcgaagagctcaaggccgacttcggtgactacccgcgcgacaaggacggcaacatcaacatgcaccgtccgtggatcgacaacctggtccgcgtcaacccggacgacccgaccggcaagtcgcacatgcaccgtatttccgatgtactcgactgctggttcgagtccggttccatgtcgttcgcgcagttccactacccgttcgagaacaaggagaagttcgagcagcacttcccggccgactacatcgtggaatacatcggccagacccgcggctggttctacctgctgcacgtcatggcgaccgccctgttcgaccgcccggcgttcaagaacgtgatctgccacggcatcgtgctcggctccgacggccagaagatgtctaagcacttgcgcaactacccggacgtgaacggcgtgtttgacaagtacggttccgacgccatgcgctggttccttatgtcttcgccgattctgcgcggcggcaacctgatcgtcaccgccgatggcatccgcgacaccgtgcgccaggtcatgttgccggtgtggagctcctactacttcttcaccttgtacgccaacgcggccaacggcggggccggattcgacgcccgccagctgcgcgcggacgaggtcgccggtctgccggagatggaccgctacctgctggcccgtacccgtcgtctggtgctggccgccgagaagtcgctgaacgagttcgcaatctccgacgcctgcgatgcggtctccgacttcatcgacgtgctcaccaactggtatatccgcaacacccgtgaccgtttctggaatgaggacgcttccgcgttcaacacgctgtacaccgtgcttgaggcgttcatgcgcgtgcttgcgccgctggccccgatggaagccgagtccgtgtggcgtggtctgaccggcggtgagtccgtgcacctggccgattggccgttcgtggtggacgagaagaccggtgaagacaccgaactcggccgtgtgctggtcgacgatccggctctggtggacgcgatggagaaggtgcgtgaggtcgtctccggcaccctgtccctgcgcaaggccgccaagatccgcgtgcgccagccgctttccaagctcaccgtggtggccgggaacgtggaggccgtcaaggcgtacgacgagttgctgaagtctgaattaaatattaagaacattgagttctcgactctggaagacgccgccgcccacggtctgaagatcgtgcacgagctgcgtgtgaacgcccgtgttgcgggtccgcgcctcggcaagcaggtgcagttcgccatcaaggcctccaagtccggcgactggcatgtcgatgctgcgtccggtgcgccggtggtctccacgccgtccggcgaccttgcgctggtcgaaggcgagtacgagcttatcaaccgtgtggaggaggagaacgccaccgaggccgccgcttcggtctccgcctcgctgccgaccggtggtttcgtgatcctcgacaccgcgctggatgccgatctgctggccgagggctacgcccgcgatgccatccgcgccgtgcaggatgcccgcaaggccgccgatttggacatcgccgatcgtatctccttggtgctgacagttccggccgccgatgtggccaaggtcgagcagttcaaggatctgatcgcccgtgagacgctggccacctccttcgaggtgaaggaaggcgccgagctgggtgtggaggtcgccaaggcgtgatgccgtggcggactgaccgcgcctgatgcgtggtgcacgggcgcgtgaaatgcacgaagtggtcctgccgtttagcggcgggaccactttttgttccgtggtatgccataaagtttacgtcaggtatttgttcaactgttcaatgcggtcggcatgcagattttgaatacgattacgggcgtgctcccagccggacgcttattgtccaccggcttgatggactagacgtgttccgccatgcggcgacgcgaaaatcttaaatggaagccggaaaatagccatggacaaccatgttgattacacccgaacgataggctggttgatagactaaccgaaaagtggtttgcttgagaatccatatgtttgtggggtaagcaatggctgtttccaaagtcgaatctcgtacggtctcggagtgttctctgaacaacatcacgtccatggatccactgaacgaggaatggtacgaaaatctgatcgtcgaacatctaacggagaaactcggatatgagcacctgtacgggcccgatgttcgccgcaccgacgactcgtatcgcgacgtattccttcctgatattctcccggatgcgttgcgacgaatcaacagaaatctgccggaagcagccgtcgaggaggccatccggaagattcagaatgtcgagatcggcagcttggagcagcgcaacgagatattcaatgactacctgcaatcaggagtcgaagtgcacttctttgacggcaaggaagagcgtgatgacatcgtccggctgcttgatttcgacgatcccgagaacaacgatttccatgtcgtgaaccagtggacgttcgtggagtattccgagaaacgtcccgatgtcatcattttcgtgaacggcatgccgttggtgttgttcgagctgaagtccccgtcgagagaggagacggacgcttcacacgcgtacctgcaattgcgccagtacatgaagcagataccgagcatgttcgtgcccaacgtgttctgcgtgatgagcgatatgacccagaccagggtcggcacgatcacatccgacgaggaccgttacgtggcttggaagtcggcggacggcgactattccggaacgaaagccgcggcatggagcaccatgattgacggcatgctcccgaaggaacggctgctcgacatcatccaaaacttcgtatgcttcaacgattcctccgagaaggtcgtgaagatcatcgccgcataccaccagtatttcgcggtgcggaaagccatcgtcagagcggaagaggccgtcaatggggatggcaggatcggcgtgttctggcacacccagggaagcggaaaatcgctttcgatggtgttcttcgcacatctgctgcagcgttatcttgaaagcccgaccatcgtggtcatcaccgaccgcaacgatctcgacgaccagcttttcggacaattcagccgctgcgccaggttcctgcgccagaaggcggtccaggccgagagccgcaggaatcttcaggaactgcttgagggtcgtgaggcgaacggcatcatcttcacgaccatgcagaagttctcggacggcgacgagccgttgtgcgaccggagcaacgttgtggtgatggtggacgaggctcaccgcggccagtacggcctgaccgaacggatcaacgcggacggtcatgtgtcggtcggcgcggcccgtgtcgtgcgcaaggcactgccgaacgcgtcctatatcggtttcaccggaacgccgatctccacggatgaccgcaacacccgcgagatcttcggcgactacattgacgtgtacgacatgacccagtccgtcgaggacgagtccaccaagccggtctactacgaaagccgtgtggtctcgctccatcttgacgagaacgcgctgggccgcatcgacgcggtctacaaggagttcgcggaccaggccgacgaggcgagcgtggagaagtccaagcatgacctcggcggcctcgatgccatcttcgacactcctgaaaccatcgacgcattgtgccgcgacatcgtggaccattacgagaacaaccgcgccgacgtcctggccggcaaggccctgatcgtggcgtacagccggccgattgcgatgaagatctactacaggatcatggagctgcgccccgaatggaaagacaaggtcggcgtggtgatgaccatgtcgaaccaggatccggaggaatggttcgacgtgtgcggcggcaccacgcacaagaaggagatggaacgcaggttcaaggacgattccgattccctcaagatcgccatcgtcgtggacatgtggctcaccggcttcgacgtgcccagcctgtccaccatgtacgtgttcaagccgatgaagggccataacctcatgcaggccatcgcccgcgtcaaccgcgtgtgcaagggcaaggagggcggtctggtcgtggattacatcggcatcgcaggcgcgctcaagcgggcgatgaaggactataccagccgtgaccagcacaattacggcgacatgaacatcgccgagaccgcctatccgaaattcctcgaaaagctcgacgtgtgccgtgatctcatgtacggcttcaactaccgcaaactcatcttccagaacagcagggaggcgcttgccgacgccatcgcggagggaaccgactggctgctcgatctggaacggcacgaagacacggaatcgttcctcaagcaatgccagctcatgaaccaggcgctgagcctgtgcaaaagcatggtaagcgaagaggacgcgcatgaggcggcttacctatccgtattgcgcgtgcaggtccttcgcctgaccggacgtggctccggcgggggcagcggcatgacgtacacggagttcaacaagcaggtgagcgagatcctccagcagagcgtgcatgcggacggcgtgctcaacctgttcgagaaggacagcgtggagatctccctgttcgatgaggcgttcctccaggaggtcgccggcatgaaggagaagaacatcgcgatcgagagcctgaaacgcctcatcaaggagaaagtgcgggcgtacgggcgcaccagcgtggtcaaatcccagaagttcagcgagatgctccagaacacgttgaacgcgtatctcaacggcatgctcactaacgcgcaggtcatcgaagagctcgtcaacatggccaaggagatcatgaaggaccgcgacgacgcgcagaagctcggcttgagcgacgaggagatggcgttctacgacgcaatcacccagccgcaggcggtcaaggacttctacgacaacgaccagcttgtctcgatagcccgcgagctgaccgatgcgatgcggagcaacgccacgatcgactggcagaagaaggaaagcgccagggccggcatgcggcgtgccatcaaacgtttgctgcgcaaatacaagtatccgcccgaaggcgtcgaggacgccatgaagaccgtcatggaacagtgcgagctgtgggccgacaccaagatcagcgaataggatgagcaggaggataatacaagacatggcaaagaagaaggacaataccgccgagatcggcttcgaggaacagatctggagcgccgccgacaagctgcgcggcaacatcgacgcttccgaatacaagaacgtcgtgctcggcctcatcttcctgaagtacatctccgacaagttcgaccagaaataccaggaactcgttgaggagggagagggcttcgaggaggaccgcgacgaatacgcgagcgagaacatcttcttcgttcccgagaacgcccgctggaagaccatcgcagcggccgcgcacacgcccgagatcggcaaggccatcgacgaggccatgcgccagatcgaagccgagaacaacaagctcaagggcatcctgccgaagaacttcgcacgccaggagctcgacaagcgacgtctgggcgaggtcgtggacctgttcgccaacgtgaagatggccgaaaagggcgatagccgcgacatcctcggacgcacctacgaatactgcctggccaagttcgccgaagcggagggcaagaacgccggcgagttctacacacccgcgtgcgtcgtgaagacgctggtcgaagtcatcgaaccctaccacgggcgagtgtacgatccgtgctgcggcagcggcggcatgttcgtacagtccgcggacttcgtcaaacgccatcagggcaacatcaacgacatctccgtgtacggccaggagtccaatccgaccacgtggaaaatggcgaccatgaacctcgcgatccgcggcatcgacgcggatctgggcgatcataatgccgacacattcttcgaggacctgcacaagaccgagaaattcgatttcatcctcgctaacccgcccttcaacctgaaggactggggagggaagaaactcgagaacgacgtacgctggcagtacggcaccccaccggagggcaacgccaacttcgcatgggtccagcacatgatccaccacctcaaccgtttaggccgcatgggcatggttctggcgaacggcgcgttgtccagtcagacgaacaacgagggcgagatccgcgccaagatcgtggatgccgatctggtcgaaggcatcatcgcaatgccggacaagcttttctacagcaccggtatacctgtgagcctgtggatcatcaccaagaacaagaagcagtccggcaagacgttgttcatcgacgcgcgcgatatgggaaccatggtgtcccgcaggctccgcgagttcaccgatgaggacatcgccaaggtatcgactgcgttcgacgcgttccgtgacggcactctggaaacggagaagggcttctccgccatcgccacgacggaagatatcaaggcgcaagattacatcctgactccaggccgttacgtcggtgtcgccgaagtggaagaagacgatgagccattcgaggagaagatgacccgtctgaccggcgagatcgccaaatgcttcgaggaatccaaccgtctgcaagagcagatcaagaagaatctggaggccatcggctatggcatgtgagcagctgacgcgtctaggtgatgttatcgagcttgaagatgtcaagagagagccgatatcttctagggacagaaaggacagaaaaggttcctatccttattacggagctcaagaggtattgtcgattatctagatgattacacctatgagggagattacctactggttgctgaagatggggaaaatcttaggagtcgcaagaatcctattgcgaatgcggcttctggaaaattcagagtgaataatcatgcgcatgttattgctgagtccgaaaagtgtaatctcgtttttctgagacatcttcttaatatgactgatatttctgcctacgtaacaggatctacgcagccaaagctgagccagagtaatctttgtgccatgaaattgcctcttccttcgatggcggaacaaaatgctattgcaaatgttcttagtttgtttgataggaaaatcgagcttaacaaccagctaaatgattatttgttagctgcgtgaggtcaaccttcgaaacgtcgatttcgccggacatgagcttgggaaggagcgtatcgcgcagtgcttggagctttactgtctctgaatcgttatcagatctttgctttattgcggaatctaataggatcaaatctttcgtactgcatgaactggcaaccttgaactccatcatttgttttttatcaccacggggcatctttgttcccttcgcaccttgcatgacgtagtcaaagaatgagtcttgccgtaggcatgcatgcagatacggcgcgttgctgggatcattcgctctaaaaacgatgacgtcacccgaacatgtaccttcaaacggggcgtaccatatctttttaaaatagggacgaatattagaaatcagagtgtcgccggctttataccgtgtaatcttgcccgttgttgggagcgaagacgccagttgccgtcctcccttgttctgcattagtgactcagtcgaaacgtaagtctcctgattcgcgttgtcataatcgacgtggtcagcaacctgatagcagatatctcgaagacgtgaatttctgtcattacagtatctactggcaatcgtttcacacaagttggctaaataatcatttagccgattattaagggcaattttgtcgacaatggaatcaagcacttctacgattgcatcttgtgttgccttgtcaggtatcttgacagggcagagattcacgtgatttcgattgacgcctggcacagcactagctgttgtgtatccttgccacgggattgtctgcaaaagataatagacaaatcgaggattgttgccgttgaactcggtggaatacaaggctgtgttgagaggccaacatggaccacccgaaaagaaaacttctccgatagtgccgtatcgccctgtgattacacagggcccctctactgctgcagtactattagatccggtaattcccgatgatgaataaaccggcacatccccttgcaaacgctggcttttcggcaaatcaaatcctctttttaagtcggtaatctcaccaagggtcgtctctcgccagctcattccaaataccttctgtgtgaagctttcacgttgttctggttgaccatgacgtagtgcatggtcgtgtctattctcgcatgcccgagcagtttttgcacctgttcgatcggcatgcccttgtcgatggcgtgcgtggccagagtacgacggaacttatgtggatggactcgattgatgccggcgtctttgccgagccgcctgaggcggctttcgatgccgccgatgctgatacggtcgccatcgccattcaaagcgacgaatagcgccggattgctgtcgttacgcgattgcaggtatgcggtgagatggagcttcgttctggcgtcgaaatagacgggacgctgcttgtttcccttgcctgtaaccaagcattcccgctcctgaagatttacgtcggctatgttcaaaccgaccaattcgcccactcgcatgcctgtggatgcgagaatgtccacgatggcaagatcccgcaaggtgccgcatcggtcccgcagagtttccaggttttcgtcgctcaggacttccttagctattacggcggtcttcacacggtggatgcgtcttacgggacttttgacgatataatcctcgtcttcaagccacgcgaagaagcttgacatgatacgccgaatgttgtcgatagtgactttgcccgcatgacgttcgttctcgtatctgttgaggtacccgcgcaagtcatcgctgcttatccgcgtgtagggcttagcaagggccttagtcatgtgctggagcgtgctttcatagtaagcgatggttttcggcgagcagccttcgacctcttttgccgtgaggaatagcgtcagcagattctgcggcgctgatgtttcctgagctggcagcagcgtgactctgagtacttcggccagatgtttgagctgtgacggatcaagcatgttctgcatctgcgacagaacactattaatgatggtttccataggggttccttccaataacagttaggaacattgtgcccacgcgctggcaaatgattatttgttagctgcgtgaggtcaaccttcgaaacgtcgatttcgccggacatgagtttgggaagaagataactccttaggttatttaatttccgtgtttcgttttcattactcctaattagtgcatctatcggtgccgcaaatgactcgaattgcatcacttcgttatgagatggaagcgcaacttctaagcttttgagagccttaccgttgattgagccgaatacagtaccctctccgttgtaagcctcaagttgaggcttaaggaatcgcattaagtacagagcaaatgacggggtttcgctatggatagctgccagaccacgtccgatacagcaattttcaaaggcaacgttgaggtccccgacaggcgcacgaacgctcattaggacgtcaccctcgcaggctaaacgttttggctcagtggtatagagacgacgctttgggaaacgccatccaaattcaccccttccttgatagaagattatgccagcaccttcttcgttatacgaacttcctgctggtgattgccccatcgttatttcggcaacatcagagagcgtagcgttgaaattaagaccaccaaacaactcttgaaacttaccgtctacaagctgctctaaataatcatttagccggacggatgcattggagcaatgtgatcagagtaagagctattcacgctgtgcacagtcagcaaagccagattcctgcttacgaatctgtgcctaaagtgtcccattctccatgtcgcaccgccttgacgctcggcggaatcgcgccgctgttgagctggctgtcggtgagtcagttcacggcacagtcgttcgcgatgctcgttgtattctgtcaagttgtcttgtgcggtgtgagctctgagctctcatgaagcactgggtcgtttgcgccgcagattatggttttgggggacggtgtgtgttcttcttgttgtttgataactcaagagtgagtgatttgctggcatgtcgcttcagcggttgcgtatcggggaagatacggatggattgtaccgtgcaatcgatgccgtgggacgggcggagtattcgtattttgggacatggagtccattcttgcgtcgcaccccgcacggggtgcgacgcaagaatgcgccaacgtctactgcgcgccgatcgcggccttgagctcctcgaccttgtcggtcttctcccacgggaactcaacgtccgtgcggccgaagtgaccatacgcggcggtcttcagataaatcggacgtttcagatccagctcgtcgataatcgcagcggggcgcaggtcgaagaccttgcgcacggcggcggcaatctggcctcgcgtcacaccctgctcggtgccgaaagtctccacattaatggacaccgggtcggcaacaccaatggcataggcgacctgaatctcgaccttgtgtgccaagccggcagcaacgatgttcttcgcaacccaacgagtcgcatacgcggcggaacggtcgaccttggacgggtccttgccggagaacgcgccaccgccgtggtgggcggcgccaccgtaggtgtcgacgatgatcttgcggccggtcagaccggcgtcggccgccgggccgcccaggatgaacgaaccggtcgggttgaccagctggcggtagttgtcatgcggcaccttggaacccagcacctcatcaagcaccgggtcaatcacgtgcttcttcagctcaacagcaagccaatcctgcgtaacctcaggatcatgctgggtggagatcagcacggtgtccagacgaacgggcttatcgttatcgtcatactcaatggttacctgggtcttgccgtccgggcgcaggtgcggcacttcaccggacttgcggacctcggtcagacggaaggcgaggcgatgtgccaaatagatcggaagcggcatcagcgtcggggtctcgtcggtggcgtagccgaacatcacgccctgatcgccggcaccctgtgcttcgtaacgctcttcgcggctggcggcggtctcctgatcgccagtcagacgggcaacgccctggttgatttcggcgctttgctcggtgatggccaccacaacgccgcaggaatcggcgtcaaggccgacttcggaggaggtgtagccgatgttgcgcagggtttcgcggaccttggactgcacgtcgcagtaccccttggacgtgacttcgccgaagatcaggaacacgccagtggcggcggaggtctccacggccacatggctggacgaatcctgggccagcaaatcatcaagaatggcgtcggagatttgatcgcagaccttgtcagggtggccttcggtcacggattcggcggaaataagccgatgttcttctgtcatatcatccctttcttcaggacttatcgccccgcgggatgcgaggcacaatgatacggtgtcaatttttacttgtcactgtggaagcgggcataaataaaggctcgtgccaaccagcgcggtggcgcgagccttgcgtcttattcgctcccgatgttgagttatagccgattgcgataactcaggcaagcgtgtcgctcaaaatcagttgtgagagaactctcacaccatcattcggcgacgaactgtccaaacaatccaaacgaattgtcggaatcgatcagttgccctcgttggcgtcgtcctcgcccaaggtctcctcaagcaggccctcgtcgatttcgcggaaggcgatggacaggggcttctcgttgttctggtattcgaccagcgggccgatgttctgcagcaggccctcgttgagctgcgtgaagtaggagttgatctggcgtgcgcgcttggcggcgaaaatggccagcgcgtacttggaatcggcgtgcttcattaggtcgtcgatcggcgggttcgcaagaccgtcgggtgtcgggtcagtaccaaaagccattgttcttatctccagacattggaaaatctatctcaaccgaagcaagtgtagccgtttggggggacttctgccggacctccgccagacttccagtggaggaatgtattccaaaaatatgtgtgagaaacgttacgcttttgcaaattccattattcgactcttgacaagtggcgtgtccctcacaagggcttgaatagaaccatgactgaaatgcgatctgcaaaaattatgtcagggcgcgtctttgcaggcgcccgagccctctaccgtgctgcgggcgtcaacggagacgacatgggcaagaagcccatcatcgccatcgccaactcgttcgatgagttcctgcccggccacgtccacctcaacaaggtcggccgcatcgtttccgaggccatccgggaagccggcggcatcccgcgcgagttcaacacgatggccgtggacgacggcatcgccatgggtcacaccggcatgctctactccctgccctcccgcgacatcatcgccgacaccgtcgaataccagtgcaacgcacactgtgccgacgcactcatctgcatcccgaactgcgacaaggtcgtgccgggcatgctgatggccgccctgcgcctcaacatcccgaccgtgttcgtctccggtggcccgatggaggccggcaccacggtgctcgccgacggcaccgtcaagagcaccgaccttatcgacgtgatgtacgccaccgccgacgacagcgtctccgatgaggaactgctcaactatgagaagaccgtctgcccgacctgcggctcctgcgccggcatgttcaccgccaactcgatgaactgcctgaccgaggccatcggcctggccctgcccggcaacggcaccatcctcgcctcccactcctaccgcaaggacctgttcgagcgtgccgccaagcaggtcgtcaagatcgcccaccagtactacgacgattccgacgattccgtgctgccgcgctccatcgccaccaaggaagccttcgagaacgccatgaccatggatgtggccatgggcggttccaccaacaccgtgctgcacatcctcgccatggcccagtccgccgacgtggacttcaccctggacgacatcgagcgtatttcccacaccgtgccgtgcatctgcaaggcctcgccgtccggcaagtgggagatttccgacgtgcaccgcgccggcggcatcaccggcatcctcggcgagctcgaccgcgccggcaagctgcacaccaacgtgcactccatcgactatccgacgctggaagccaagctggccgattgggacatcatgcgcgcgacctgcaccgaggaagcccagcagatgtacaaggccgctcctggccacatcatctccccggagccgtggacgcacaccaccctgttcgactcgctcgaccgcgaccgcaccaacggcgccatccacgacatcaaccacccggagatccacgaaggcggcctcgccgtgctgcgcggcaacctggcccccgacggctgcgtggtcaagaccgccggtgttccgccggagatctggaagttccgtggaccggctctggtggtcgactcccaggagcaggccatcgaggtcattctgaacgacaccctgaagcctggcatggcgcttgtgattcgttacgagggtccgaagggcggcccgggtatgcaggaaatgctgtacccgacctccttcgtcaagggcaagggcatcggcaaacaggtcgccatgctcaccgacggtcgctactccggcggttcctccggtctggccatcggccacatggcgcctgaggctgccaacaagggcccggtggcgctcatcaagaacggcgacatcatcgatatcgatatcgaagcccgttccgtgaacgtcgaactgactgacgagcagctggacgagcgtcgtcgcgagcttgaggctggcgacggctacgtggctcaccgcaaccgccacgtctcccaggcgctgaaggcgtacgccgccttcgcccgctcggccgacaagggtgcgacgcgtgacccggagctgatcaacaagctctccggtctcgactgatcgccgattgcatagctgaaaagcccggtatcttcctcgcgaagatgccgggctttttgctgtgcttccgggcgggagcgatattgcttgttatcgcacgcaggcggcgggggagaggcgtgcgcctcgggcccagtcggcggcgcgcatggccttcttgccttgcgccttgacttgggtgagttccagcggcgtgctgccggtaccaacccacacgttcttcttgcccaccttcagctcgccgggctgaagctcggccggagtgttgggattggactggtcggccggttgtgcggcgagaatatgcagggtgaggggtctggcggccggctcgtcattatcggcgattggcccttccgcaaacagttcggtccatgccccgggatgtggcgtgcaggcgcgaatctgacggtcgatggcctcggcctcgtccgtccaactgatgcgggcgtccttcaccgtgatcttgtgcgcgtattccaggctctcggccggctgcgcggtgaatgtggcggtgccttcacctacggcggccagcgcatccacatacatgggcgcgccttcctcggccagacggtcaagcagttcgccggaagtctcacggccggtcagttcgatggtcagggaagcgacgatcgggccatcatccaaaccctcgcccaccttgaacacgtcggcgccggtggtcgggtcgcccgcccaaatcgcacgctgggcgggagcggcgccacgccacttcggcaggttggagaaatgcaggttgtaccagcccatgggcaccgcatcaagcacgttcttgggcaggatattgccataggcgatgacagcggcgatatccgcatgcaggtcgttcaacgcctccatgaattcgggggagcggggtttgagatcgatgacgggcaacccgagctccagagccgtcgccttgaccgggctgggcgtgagcttgcggccgcgaccggtaggcgcatcggggcgggtaatgacgccgaccacatcaaaacgtggatcggtggcaaaggccttgagcgagggcaccgccacgtcgggggtgccggcgaacacgagtttgagcatggtcctccttgaaatgtcgatgctcactgcacggccggaatgttcacgccattggcgatgagcagttcacgcagcttgaccggatcctggaaacgtacgccacggatgccggccgcattcgaaccgacgatgttcatggccttgtcgtcgatgaacaacgcgccatcggccttgatgccgaactggttcaacgcggcctcgtagatttccttgtgcggcttgcgcagcttgacaaaaccggagacgagcttgccatcaagctgctgcaaaatatcgcactgttcctcggccacgtggaacagactggattcccagttgctcaggccccacacgccaataccggcggccttcaggtcattgaccagcacgcgcgcgcccggcacgatgccggtcagggagtcgcggaagttcttgatgtagtagtcgaggatgtccgcccacttatcgcccctgtcacggcgcatgatggcgatggcctcgtcggtgctggtgccgccgtccatcaggtcgttgacatcgtagaagccggagatgtcgttgtcgaggaattcgtcgatggtcttctggctgtagcgggggatgagcacggccgctggatcccagtaaatcagcacgttgccgaaatcgaagatcacgtcggtgatcggcttgccggcgttcgcagcggcctcgccatccgcgaccagcacgtcgtaatccatatccggctctccaggccaacccttcatagtgtcctccttctagcgatgttcattctgtaatcatcgtttcacgtgttgaagacgattagatcagatctttgggatctactcggaagcgaagctcgccgggttcgcgggacgccacatgacgagcggtttcccggtgcagtcgggccgccagctcggctcgccgactctgcggcacacggattactgccttcacccggtcggccgtggcttcgagctccctggcatcaactgtgtccggttgcgcgatcggcaccgggcccaacatgccgggcagctcgccgcaggccgtccaatcgccgcccagcgcgccgatacgctgcatcagcgtcatcaccgcatcacggcgtccccatacgcaggcggcggccacggccggcggcataccggtctccacacgctcctcaagatccttggctgcaagaatcctcgaatcccagagcatcagcgattgggcgatggccgggtcggtttcgccgagaatcaacgcctggccgccacgggaacgcggcgcgcacaacgacaccgcacgcatccacgcggtcaatgtatccaagcgagcatccacgcccaacgcatacaagctggtccaagcgtcgagcacggccacggcacgatactcatggccagccgatccctgctcggcactgaccggacgcacgcgcggttcgaaaccgggagtggcgatgacaatcatcggctgacaagccacatcgcgcaccaggccctgcgtcttgctggacaaaactactggcacgccgcggaacaacccggccagttcagccgcagtgcctgcagcacccacgcgcaccacacgcatacgttcatgcccacagcccgggcacttccaattgatggcagcagccccacaccagcggcatcgcggtgtggaatcccggcggtcggccggtagttgcaacggtccagaacacttggcacaacgcgcctgacgatggcatttcgcacaactcagagtctcactgacgctgtcttgcggaatggacagcagcacggggccgctctccaaagccttagatagcacgcggacggccgtatgcggcacgcgcgccccgatggacgggtcagcgagacgcgcaagctcatcgcgattgagccaacgcacccaaggcgtcgcatccttcagcggcgaggcgagcggatgaatcgcggtggaatagccgctcaccggagtttccaccgtacctggaccggtgttttcccactgactttgcggagtgcgcgcattggccatggccacgaacacgccgccatgggacttggcgcgcaaccgcatcacgccgcgagcctgtggatacggcatcataccgtccatgttctgataggcggcatcctccagaatggcgaacagtgccgggccttcaaccggcgcatacatcaccgcgcgggtgccgatcaccaccttcacctggcccaacgccacagccagatacgtgcggtaccggtcggccgcaggcatggtctccgcattgagcacggcgacatcgcccatccatccgccggttggagccggggcaaatggtttgagtccataattgcgtagcatatgcatcaggtcttcgacctcgcgcatggtgggcaattcaactacggcagccttaccggcactcaacgcagtggccaccatccatgccatgtttcgttgccactcctgtgcaccgggcaacgaatcaaacacaaaagattggaaacgttgaccggtaagcgcgtcatgaagcacattgacatcggcgtaattggcggtcagacgacgatacccctgcgcagctccctccgaaacggtgctagcaacggcaaaggtagagccagcaagtttggtcccatcgggattggtgccacgcccggcaaaaccgccttgcgtattatccggcaatgagccgccgaccggccgacggaacgacgcggccaaccgctgctcggtctccaccttggccacgcgcggtggcacggcgaaacgcagaatattggcccgtgtgccgccataggctttggcaaccagaccgatatcctcgcgcatcgaagcgggaaccagtacatcggggcttagcactcgctcgatatagcgaatcgaagagcgcggcgtatcactggtatcggtgcgtgcccaaatcacaccgctgaccctctgaccgccaaaccgcacgcgcaccagcacacccggttgtgcggcctcgctgtctttttcatcaatgaagtaatcgaatgtctgaccgaggtggagcgcctgcacatccagcacgacttgcgctatgggatgctgctcggccggcgtatgctccgcaggcgcacgtttacgacgcttgcggggagccagccccgcaagcgtcaactgttctgcgcctgaagtagtcatggctcaactataagtgccggagccgaggtcggtaaaattttaccggcgcaggtaatcgagtacgtgggttaggtcgcggtcgttgatggctttgtcggcggcgagctgggtctttggcttggcacagaacgcgagacccaaaccggcggcctgaatcatcggaatatcgttggcgccatcgcccacagccacggtctggctcatcggaatacccaaacggtccgcccacgcttgcaaggcgtgcagcttcacggtcttgcatacgatctcaccaagcactttgccggtcagatgaccgtcctcaacctcaagccggttggcaatccaatagtcgatatggctctcggccgccaacatgtcaaccacttcatggaagcctccggacaccacgccgatcttccaaccgtgttcatgcagcgtgtcgataagctccagtgcacccttggtgaaatgcagcttgtcatgcaccgtgtcgaacacggagatcggcaggccctccaacagggccactcgtgcgcgcagcgcatcgcagaactccagttcgccgcgcatggcgcgtgcggtcactccggcaatctcctcaccgcagccagccaccacgcccaactcgtcgataacctcttcgtcaatgagcgtggagtccacatccataaccagcaggccgggcttgctcagcgtcggcacagaaaccgcagaatcagccgggctcccaacttcgctctcggcggacttgtcaacaaaatgcacatcttcttgcgtcatgcttctgattctgggaaaaccttgggacaatgccctctatgagtttttccatggcagccgccactattcttgcaaccgaccccacacccatctgcaccaccaccgaacccggcctgatcggcaccatcaccgactggctgatcatgctgatggaaaccatcggcggtatcggcgtggccttggccatcgccctcgaatccatcttcccgcccatcccgtccgaagtcatccttccgctctccggcttcaccgccgcacgcggcaccctgagtctgccgggcgcaatcatctgggccaccatcggctccgtactgggtgcctggaccttgtacggcatctcccgctgggtgggcctgcatcgcatcaatctcgcggcagacaaaatccccggcgtcagccgcaaagacgtgagcaaagccaacgactggttcaccaaatacggcacatggtcggtgctcatcggccgcgtgattcccgtggtacgctcgctgatttcgattcccgccggattcaaccgcatgaacttcctgcacttcaccggctggaccctgctcggctcggccgtgtggaacaccatcctcgtttccgccggttacctactcggcgaccagtggtgctcgattcaaggcgcgctcggcgtgttcgaggacgtggtcatcgcggccgtgattgtggtcatcgtatggttcgtggtgcgaaaagtgcgtactgttatacgtaacaggaaatccgccgacggcaacgaatagggtctgccgactgccataagttgccgaaaatcccggatagaagggaagcgaagaacccgcatgagcgacaccgaagatctcgccgcgctgaacgatcgcctgatggccaagaaccatgcgctcgccgaagcgctgagccgcgccggcaaggaactgaccaaggcgaagtcacagctcgcccagctcgctcagccgccgctcaccttcgccaccatggtcaaggtcgattccacccgcaccgatgaagacggcatccagcacgcgtcggccgaagtcatttccggcacccgccgcatggtggtgcctgtggcctccaacgtcaacgccgcccgcctgaccgccggggccaccgtgatgctcaacgagaagctcgtgctggtcgagcagcgcgatgctgacaccgtgggccagattcgcagtgtcaagcaggtacttgacgacggtcgactgatcgttaccgacgcctccggcaatcccgtgctcatccgccgttccggcgcgctcgcgtatgcgggcatcaatcagggcgaccgtattatcgtcgatccgtccgtccgcctcgccatcgaagcgctgcccgccgagggcgacaaggatctggtgctggaggagaccccggatgtcacgttcgccgacatcggcggcctggatagtgagatcggtcgtatcagggacgccgtccaactgccgttccagcatcgtgcgctgtttgagcgctacgatttgaagccgccaaagggcgtgctgctgtacggtccgcccggcaacggcaagacgatgattgccaaggccgtggcgaacgccctatgcgagggtggttacgattcgaatggcgacggcgcaatcagtccggccgaaacccatgtcaagggcgtgttcctgtccgtcaagggcccggaactgctcaacaaatacgtcggtgaatccgaacgactgattcgcctgatcttccagcgcgcccgtgaacgcgccgcggacggcaatccggtggtcgtgttcatcgatgagatggattcgctgctacgcacccgcggctccggcgtctcctccgatgtggagaccacgattgtgccccagttcctctccgaactcgacggcgtggaatcactcgacaatgtgatggtaatcggtgcctccaaccgcgtggacatgatcgatccggctgtgttgcgaccggggcgtctcgacgtcaagattcgcgtcggccggcccaaaaccaatcaggccatcgccatcgtggaccattacctcaccgacgacctgcctctggaagatggcgtcgacgcgcacgccttgtccgccgtgctggtgcatgacatctacggaacctccgaacgccgccatctatgcgacgtgcaggaggagaacggccagtggcatgcgttgttcctggccgacgtggtctccggcgcgatgctcaagaacatcgtggaccgggccaagacccgagcggtcaaggaatccatcgaaaccggcttggacgtggcactcaccgtgccgctgctcgctgccgccgtggaagacgaataccgcgagacccgcgattccatggccgacgtggaccccgaacaatggtcgcgcatcaacggcatggacccgatccgccgcatccgcaccgccgaatagctcaagctcaaggagcactacatgaccgttaaacgagtgatgggcaccgaaaccgaatacgcggtatccctgaacaccccggaccgctacaatccggtgcaactgtccttcgacgtggtgaacggcgccgcggacagccacagcaaatccatccgctgggactaccggcaggaggacccggtcaacgacgcgcgcggcacccgtctcgaacgcgccgccgcccgcccggacatgctcaccgacgccccgcagctcaacatcaccaacgtgatcgcccccaacggcggccgcgtctatgtggaccacgcccaccccgaatactcggcgccggaaaccaccgacccgttcgaagcggtccgatacgaccacgccggagacctcatcatgcaggccgccaccgaacgcgcccgcaaacagactggcactcccattgccctgcatcgcaacaatgtggatggcaagggctcctgctggggcacgcacgagaactatatgatggcccgcgcggtgccattcgacttggtcacacgcctgatgaccctccacttcgtcacccgccagatctacgccggctccggccgcgtagggattggcgagaacagcgagatcccgggctaccagctcagccagcgcgccgactacatccacgccaaagtcggcctgcaaaccaccttcgaacgcccgatcatcaatacgcgcgacgaatcccactccaccgatgcataccgccgtctgcacgtcatcgtcggcgacgccaatcgcatggaggtgccgcaggcactgaaactcggcaccacgagcatgctgctgtggctgctcgaacatgcggacgaggccggattcgacctgaacgccttcctcgacgaactcgaactgtctgacccagtcgaggccatacacaccgtttcccgcgacctgacgctgggggcaatcttgccgctggccaacggcggcgaaaccaacgcatggcttatccagctcaaactgcgccaagccgtctaccaggttgccgcactggtcgaaggtaccgacaccgccggcgaacccgcctggccggacaaatccaccacatccattatggcgatgtggcagcaggcgctcatcgactgcgcctccatccgccatgccgccgacgatgacgaacgtctggccatgaccggcgaggccagccgcatcgaatggctgctcaaatggcagctgctcgaaaaactgcgccgcaaaatcaccacaacgtccgcacccggcgtggccaacggatggaatgatccgcgactgaaggtcatcgacctgaaatgggcggcgctcgaccccgcggacagcatcttcaccaaactcgaaccccgcaccgaacgggtggtgagcgccgccgacatcgcacgcgccaccaccgaaccgccggaagacacccgcgcctggctcagggcaaaactcgtggcgcaattcggcgatgaggtggccgccgccagctggtcccgactcactgttcgcgacccgcgcgccgcagacgagggcgaggcggtcgaattctacggcaatgccggccatatggccgctaccgaccatcacctgttctccctcgacatctccgatccgctcgccttcaccaaggcgcactgcgaaaccgaactcaattcggccgaacacgccatcgatctgctgaagtcgctggccatcaacgccgaacgatagacttggtagctatggaagaaacacgcgaagagaccccacaggacctgcgcaaccttgcgctcaaagtcgccggcctgctcgaagaagccggccagcatgccctccacgaccaactcaatccgcgtaacctcgcccagccgagcaccgagaacgcggaccgtggcccccgctacaagcttgaagtggacaacaagatcatgcgcttcatgagcgccagaatcgccgacatcgcccacttcgacggcttctggaccacccgccccgccgaaagccgccctggccagcgttactggtacatcggcaagatcgacggtgtgatcaactacgtacgtcgcatgagcgaatggacggtgaccgccgccctgttcgaattcggcccggacaacgagcccaagccgatcatcggcatcgtgcacgccccggccctcggcctgacctacctggccgccaggggagcgggtgccgtgcgcatccacaaaaccgcggtcggcgagaagcgcgacaaggtcgtgccgtcgatgacctcctcgctggatggttctgtgctgagctacggcatgtccttcatccccagcgaatcgcagcgtgcgctcgacgtggcctcctcgctcgccggacgcccggccgacatcaagcgcgtgggccccgtctcgctcgacctgtgcaaagtggccgacggcacctatgacgcctacttcgagccgatgctgcacgtgtgggatatcgcgggcatcgccgccggcaccgtagtggtctgggaggcacagggcacgctgagccgttgggacggcgaacgcatccactggcgtcacgataacgatgtagtggcctccaatggactcatcatccgcgaactgcagcattacctgcagcagtatccgtggctcgactccatcaaccagcgataattttttgactcctccggctcccctcgggtgaggggagccgtcggccgaaggctgactgaggggagtttgacagcccaaaaagaagacaacatgccacaacaattcgaacaacctcaagcacagcaggccgcgacccaggaagacgacgccctcgccaccacgcaggccgccgcccaaaccgagtccaccgaccaagccgacgtgttggacgacatcctcgacgacatcgaatccgccttggaaaccaacgccgaggaatacgtcaacagcttcgtgcaaaaaggcggcgagtgatgccccaactgcgtgacagcggcacccgctccctgcacgccacggaacccgtaccatccgccgagatggacgggttctgccgtattttcggcgtcgaaaccgaatacggcgtggcggtcaccggtgccgaacgccccgtggacgccggccaggtggcgatgaccatgttccagcccatcgtctcccgttcccgctccaccaacacgtatctggccaatggctcacgtctgtatctggacgtcggatcccaccccgaatacgccaccgccgaagcgcgcgacccgcgcgaggccctggcccaggacctcgccggcgaacacgtgatgcgcaacctagccctgaaggcccagcgcaagctgcgcgaatcctacggcgcacacgccacgatccatgtgttcaaaaacaacgtcgactccgccggccacgccttcggctgccacgaaaactacctggtccgccgcttcgtgccgttggagaccatcgaacaccagctgctgccgttcctcatcacccgccagctgtacaccggtgccggccgcatgaccccggacggcttccagatcacccagcgcgcggacttcctggacgaggccgtctcctcggccaccacccgctcccgcccgatggtcaacacgcgcgacgaaccgcacgccgaccccgactccttccgccggctgcatgtgatcatcggcgactcgaaccgttcgcaatggtccacatggatgaagcttgccgtcacgcaccttgtgctgtgcgcgatcgaagacgccttccgccatggcgttccgtccggattcgagcagtatgcctttgctgatccggctgccgccaatcgcacggtcagtcgattccttgacaatccgcgcgccgaactgacgctcgaatcaggcgaatccgtgtccgcactgggtctgcagcgccggtattatgcggcggtcaaggccttcatcgaaacccatggcgatgcgctggcaagttcgctgccggccaccacgatcgacacgattatgggggagtggagccgcgttctggacgcgctggagcgtggtgcatacgatgcgctcgccgaccgcgtggactgggccgccaagaagcgtctgttcgacgcgctcaaacgccgtcgcccggacgtcaccttcgcccagatggaacagcttgagctcgactaccacgacatcgccaacggtcgcctgtacggttcgctcgtagcccgcaaccagatgcgtgagctgctgacaggagacaacgtggaatacgccgtgcacaatccgccgaccgacacccgtgccgccctgcgtggccggttcgtggacgcggccctgaacgtcggagcccagttctccgccgactggacccacctgaccctgaccgcccccgaacgccgggaagccatactcctcgatcccttcgaggccgagcccaccctgggattcgagcagcttatggaagcgctgaactagtccggaataatacggttggacaacacgtcacagcaccacaacaaaaagaccccgaccatctcggtcggggtctttgtcgtcagtaatgctcgaagtaatcgctacgagcagaaggtcactcggtgacggccttcttcagcagggagccagcggagatacgaacgccgtaggaagccggaatgtcaatctgctcgccagtgcgcgggttgcggccggtgcgagcggcgcgcttgacgcgctcagcggagaacaggccggtgagcttcaggccttcgccggacttcatggcctcgacgaacacatcctggaaggcgttaacagcagcctcggcctgagccttggtcaggttggacttctgggcgatcttcgaaacgaggtcagacttgttgtatgccataaagcatccttcttgggtcaggggacaagcacttttgcttagtccatgttgtcatcaatgatactagcgcatgtttctgcgaaaacccgcgttttataagggttttcacatctatttccccgaagggggtatgaaaatagacgaatcagacaagattatgcttgtcaagccacttcatggccgccgcgcccagcggaatgcgcagccagtagaacaccacgcggtgcagcaaagtggcggaaagcgccacgccctgcggcactccgaccgccacgaacgcgaatgtcagcgccgcttccacaccgcccagaccgcctggagtgggcactgcggaacccaatgcataggccagcaggaagacgaacgtcgtttcgatcggattcgatgaatggccgaacgcttgcagggccgcccagaaagcgagcccagtggtcgcgttctggaacagcgcgcccaggcagctgactgtgagctgtcggggctgggaaagcacgtccagcagctggttgatatacgtcttggccagcggcataagacgacgggtcacccagtggcgcaacggtggaatcatcatcgcaatggacagcaccacgaccacaacgcccagcacgataaccaacgtgtttgtcgggattgcgccggagaacatgttgcggccggtgaacaggccgatgatgaccagcatggagaagtacacggcgtaatacaccacgagcgcggcgctcataattgcggtcgcctgggtgttgcgatagccggatttgcgcaggaactgcaggttgacgaacgaggggcccacgccggctggcatggatacggtggcgaagccgcctgccacctggctcatgaagacgcccgtgttatctcgtctgttgcgatccatgagagcgccgagcgaaatcgacgagccgatccagccgcaggcaccgaacgcgagcgtcaccaccgccatcaacgggttggcgttggtcagcgcggtgatgatttcctcgggcttcagctgggtgaagaccacgaccacagccacgatgaccagcagcatggtgatcatcgaacgccaggagaagcgggccagcgtcaccggctcggcggattcggcggtctcctcatcgattatggtgttgatgtggtctcgcagttccttgagcagctgcttgtcccacgtgcccaatgcgcgtgtgggggaggggaccgcgactttctgaatgaacggggccaacgtggtcaacgtcgtgtctccccaagcttcgcgggcggccgcgactgccggtttcacgccgatcagtgcggcgaacaacgcgagtagctgaaccttgtcaagtgcggtattggccgggccggaagcgctgtcgccattcagccagccggcgataaccgcagtgccatcttcgagccgggcgagcgtatcaggcgtgatgcgtcggtgcgtatatccacggcgattcgccacggacagatatcgcatatacgctacggcgtccgcctgggtaagcgtgttcaggttggcgggcaactcgatggtgtgcgcatccagcaccagaatcgcggactcgtccgtatcggcgatgccgtagggggcgggcgcgggcagtttgatattgtgcaggccgagcagcatggcaaagtgatgctgaacggcgtcgcgcacggaacgatcgcgtcgaatggacacgctggtaaaacgcacccaatcccagagttgcttcagatagccgacggtatgggtttgcgcgtcgatgacggaaacgataaaacgacggttattcgcggtcttcacatcgtagatgcgcgaaccttccgccaaatcgtcatccaacgtggcagacaatgagccatggctgattccgggctcctgatgccggatgagtgaggtggtttccaatccgatgcttgagagcactgcgacgagatctttgccccacacgcctttattctgcgtgccgaccacgaatcggataagcatgcccaccgtgcgaccggcggccatcgaaaccagcatgccggtaaccgaatgccacgaaagcaccaccatcaccgcggcgatggcatacaggatattccaactccatttgaccgtggagcgggtacggcgtggcccggcggcggtcaggaaggacgccatgccggcgtagatgtcgggcaacagcccggagccgtatgaggtggcggctgagaccagtgccattggcagggtgaaatcgttcagactgctgattgccgtcgatatgacccacacaatgccgtatccggcaaacatggccagcgcggacaccgcagcttgcagccattcgcgggccaagagcaactgagcgagcacgataactacgatgaccgtggtggccagctgcgtcagtacggtggaggggaaagcagccagccagttgatggcttgggcggcggtatgcgcgtcggattcgacgccgcgcgtcatgccgcccagatacacggcgaacaccatgaccacggcggccatcaatagcgacagaccggctcgggtcaggtcgccgaagtcgcgcgtgcggcgcggagcgatgtcgtcgatgtatggtccggaatcgttgctgtcgtcggttgccgggctgtccggtccgctgacagcaaaactggccgaccggccgtcaccagaggcgatcggccggtcggtagtggaggaggtcgccttgttcgggcgatcttccgtagtggactgatcctgttcagtagtcatgaaatggtcacctgacgcctgtccttgttcggttcagtttgcggttcggtttgtgactcagcgcagtagtgtggtggatgcgaaggattcgagggactcgagggactcgagagactcgcatcgcgcctatctcagcggccgaaagcgacgagctggctggccacaccggtgtaggtggcgggggtcagagccttcaagcgagcggcggtttccgggtcgaaggactgctggtcgatgaactgctcgacctgttccttgttgatggtgtggccgcgcataagctccttgaccttctcgtacggcttatccatgcccggcaggcccttgagctcgcaggcgcgcatggcggtctggatcggctcgccaagcacctcccagttctcatccagctcacgctcgatgacgtgggtgttcgggtggatggactcaaggccacccatgaggttggtcagggcgagcaaggagtagccgagcgcggaaccgatgttgcgctgggtggtcgaatcggtcagatcgcgctgccaacgggattccaccagcgtggcggagagggtgtcgagcagcgagcagctgatctcgaagttggcttcggcgttctcgaaacgaatcgggttgaccttgtgcggcatggtggaggaaccagtggcacccttgaccggcacctgggcgaacacgccgcgggagatgtacatccacacgtccacgcacaggttgtgcatgatgcggttggcgtgggagacggtggagtacagctcggcctgccagtcgtggctttcgatctgcgtggtcagcgggttccaggtcaggcccatgcggttcgtgacgaactcgcgggagacagcgatccagtcgacatccgggcatgcggccaagtgggcaccgaacgtgccggtcgcgccgttgatcttgcccaggtactcctggttttcgatgtgcttgagctgacggttcagacggtagacgtagacggcgagctccttgccgagtgtggtcggcgtggccggctggccgtgggtgagagagagcagcggcatatccttgaattcctcggccttgccggcgaggtggtcgatgatgcgcttgaactccggggtccacacgttttccatcgcgttcttgacgcaacgggcgatggagaggttgttgatgtcttcggacgtgcaggcgaagtgcacgagggtcttcagctcgtcgttgatgttggtcagctcggccggagccttgtcgatctgatcatcgatgtagtactccacggccttcacatcgtggtgggtgatggcctcatgagcggcgtgctgcttgatgccttcggcgccgaagtcctcgggaatggcgcgcaggaaggcctgctcttcggcagtgaacggcttgacgccgtcaacgatcggctggttgccgttgccctcaaagccgttggccagaagaatcatccattcgacttcgacacgcatgcgttcgcggttcagggcaggttcgctcatgtattcgacgagcggggcggtggccttgtgataacggccgtcgagtggggtcaatgcgattgcgggggaaatatcggtaagcttcataacctccaagggtacttccagccgtgaaccgagcggctatactgtggtgcggcgttcccgcccgagccgcacaggtcaaggaacgcccgtggttcgattactgtgtgcggcctttaaggctaggagatcaccgtgcctgcaaccaccattcatactcttccgaaacgtccgattgccgtatcgtcactgaaatggcagccgttggatatcgcggtcggtgccacgctgggtgcggcctgcggcgtgatcttctggggattcaacttcgcgtacatgccgatctcttcggtattcggcgcgattctgcccggtttcgccagcatcgtgcacgccgtctggtacttctccggtacgctggcggtgctgattctgcgcaaacccggagcggcgctgtacgtgaaccttatcggcacgctggtcgaaacggtgattggtagccagttcgatttgggcttcgtgattatctcggcgctgttgcaaggtgttttcgctgagattccgttcgccttgacccgttaccgcatgttcaatctgccgatttccattgcatccggtgcgttggtcgccttggaatacggcacatatctgatgctgtttcgctacgtgggtgtgtcattcgtcagcccgcgtggcattgtgcacatgatttccgaggtcaccggcggcgtgcttatcagcggcgtgatggcctggtgtctgatgctggccatcgccaaaaccggtgtgctcgaccgcctcgcatccggccgcgcactcatcgagcgacgcgcctgacactctttgcgcgccactttcccgggaatgttgcgctgatagagggggtttcgggcatgctagcgcaacaatcccgggaaagtggcgctagccgcgtctctgcggtgattgcattgtggggtagccgattgatgctaagcattgacaagttgatgtgcccgttgccgtgagaccccgagtatatcgcctatttgctgtagggcgagacccatgccatgtagttcttgtgctgcggcgcgagtttcccgcgctgcgttcaatctgcattccgcttcttccttgcgcagtcgccgagcttcatcaagatgctcctgcacggattgcggcagctttgtctctacggtgagtgcgaaatcagcatcttgtgtcatgacggtgataaggtcgcgtgccatactttcaatctctgctgttgttcttgcctgcgtgaaaccgataccgggaatctcaagaatccagtatttttcgccaggacgaacgatgacctgatatgttttcactgctgataccagcctttcccgagtttggcttctgcttctttgcaaataatgtccgcgaggttgttgtcgatttcgttatgacgtgggatggggaatcataagtccatcgagttggaatatctcatgactccctccttgcctgatactttcaaacgtgacattcttgcgttctgccgcttgcttcatcagtttgatgagccatctcctactcgtcattatattgttaactcctttcttgacaactctgtcaagtgtggtatttacttttaaccgccgaacgtgctgaactcggtggttcgctcgctaggggcaatggtcgcggactgggtcatgcggccttggtagtagcgggtttccttgagctctccgttgataacttcctggaaatgggcttcgtggcgttgcacggcgggggagccgaggtcggtggcgttctgataggcggcctgatggtatttgatccagtgcgacaactccctgccgttggtcgaaccagccacgggtgcggcgtcatatggggtcagaccggtgatgggcgttgcgccgggagtgcatgagccgtccgaatgcactgtggatggtgttgccgcgggcgcgggcgatacatgcccttgtacggtgagccagttatcggtgaccgggttggcggcaccatccagtgcggcgaccagttcatcttcgatttccacgctggtgacccacgtgcgttgcggaatcggatgattggccaccggcgatccggctgtcaccacatgctcgatggtatattcctccgcccaatccgaggcaagcgtggcggcaacgataccaccctgggaatggccgatcagcgccacgggctcatccttgccgatgcctgcctgacgcatcgcctcggcaaccatgcgagcgctgtccgctttcctgcggcgctcctgatcggcgctcatcagttccacgttctgcgcccagccaaatggtgagtcaggctgtccatcggtacccgggatggtgaccagccaggagttggttccatcagatcgttcatagcgttgaatggcgatggtcccatattcgagtccgctgttcagctcgattttgccgagccgctcttcggcgagcctgcgcagattctccattgactcggccaccgatccgcttgcgcggacaacgtcggcattcgcctgcacctcgcgcacgtccagatgattgccttggacgacgtctttcgccgggccggagaaattggcgattttccccgcagccttgttgacctcatcggtgtgcgcaatgctcttgccgataggtacgccgccaatgattccgcccgcgccgctaagcactccttcctggaacggataggtgaacgtggacatccatgccgggttcggtttgccgtcaatagtccagccggccagaaagccgcccgccgccacagcggcaacacccgccgcggcatatcccggtttggcctgtgtgccggcctgcaataattcggtaaacatgcgccgagccgtcatctccgcctgagaatacagagagtgtgcgcgaatcagcagatcggccgcgccacgcagatcatcgctcaaccgctgacatgccgttgcatggtcataacaccgattgcccagcgcggcatatggtgcagtgacatggccgggaacaacggcgctcggatcgcccgactgcaaggtgacgcacatcggcgcactatgccgatgtgactgcaactgtaatgcggccgattcccaagccgtggctatggccgcaaatcctgccgcctcgtcatcgagagccttggctatggcggcatattcttcaagagtggctggcgcatatcccactccgccgtaaacggacgattccacttgccagtaatcgtgctcgctcatgacgacccccaagccaatcggtgggtggtctccatgtcttgcgcgagactggccgaatactgtgcggtgcgactgagccgcgatcggaatagatcggcggctttaccggtccacacgatgttgctggagcggttcacggccaccgccgtctggtccgattgcgccagtgtggccgcacgctggacggacacgaggtcgcgactacgctgtaccgccgcatggcaagggcaagtgccgtaatcgaacggcgtcaccgtattgccggcaaagccgccggtgggatcgatgggtgctgggttgctggtgtaggtattcatatatccagctaaaaggacaagactcatgcttgtccagccggaacgaccaatgtggttctagcttgccgattttgggtgaagttatccccaagtgttgtgcatagtcgtaacgattatccacaaatagcctgtttggacataccttggatcagccatggcctatcgaaaattggataaatgccaaagccgacagccgaaaccgggaaacagccgcgataaagccatgacccgtgagggtgtgagaaaaaagaacaactgtgaacgactacttaccacggcttggtagccccggtacccttgttctgcgtcgctttctgctcggattgggtggtgttcgactgggtatcggtggattgctgattggccttcatcagctcctcgacctgcttcttctgttcgtcggtcaacgcgccgccctttttggcattggatgaagaattctcggattgctgtgccgactgggcttgcccggaatcggaacctctgttctgcgcctcggcctgtttcaaggtgatctttgtcagctcggaagaaatcgaagcattggtgtcgatggcgtccttgacttgcggcaacagaagcgtgcgcattcgcccggcctcggcgaattgcgcatcggtctgctgctgttgcgccttgagcgtggtgatatccgcggactcgtcctgagccgctttgatattggcgttcaatgatgcggtggcctgattgaacgtaatcgaagcggacaggtttactgccgccacgccggcaaccagcaacagcaatacggcgccacaagccaggacgatacgtgcccaaagcgggcacttcgcccgcatccgagtattcgccgagccatcgttctcgtggatttcgttactgtttctcacagcagtctccttgaggttgcgatccatgcaccgacttccatggcaagcaatatcgccaacgcaatggccagcggccataccaccggcgtggtgcgtgtgcgctccttgaccgtggtggtcatgcgccactgcttcgatgacttggccgaaaccgaatccgccaaagtctgtgaagcgttcacggccacatacgtgccactgatctcgtcggcaatgtctttaaggttcttctcatccatcttggagatgccgggttcgccggtatccgggtcgaccacccagtggtccgtggtgttggaatcgccggcactgacgccatcggcgatgacgggaatcttgccgccctcggtcgagccgacgcccacggtaaacccatcattgagatactggcgcagtgacgagaacgtacgacgcgtcacattcgaggtctgttcgccgtcagtgatgaggtacagcacaatcgcatcatccgggtgcgcttcacgaatcgacttcgcggtcagcagcaattgatcgatcggagcatccagactggagcccgccgacacggatgtggcttccaccgccaacgtgttggcccaattatcgatggccggcgcatccggggtcagcggcacatcaagcgttcccgaagcaccgaaccgtaacgccgcgaaactggcgtccggataagcggcggtcacatcatgcacggcctgacgtgcggcaccgatgcgggtaatggtcttctcggacccgtatgtggcatcggccaccgccatcgacccggtggtatccaccgccacgatgacgtcggtggcattgatggcctgtgaggtggtagacgataccacgctgggagtcagtaccatcaccgcgacgatgagcagcattagcgtacgtcgtatgcaagcccacgcggtctcgtcactggaagcacggcgacgaacaaacaatacgatttcgagaatggccagtacggcgagcccggccgccagcagtccgccggcgacccagcccaaggcgggggagaaggtgaatccgttcatcgcctcaacctccatgcacatacgatccagataatgagtatcacggccagagcaagcgtccacagaccgggagcgtccaccattgaggatttcgccttgttctccacatccgtatctctacgtgactgaatatcccgtaccagctcatctatcgacgtgccattcgattgggtgaggaagatgcctccatgcgactcgatcgcggacttcatatccgttgtggtttggtccgattcactggctttcggcccggaatacaggccgtccacggtgattttggtctgctgggtcaagtccaacgcttcggtcagcgaataggtgggcttgcccgacacgacgttgtcggtggccagcacgatggatgccgcacgctgacggtcggcatccgcatgattggcttcgccataagcgaaaccggggagcatcgccgcgcaagacaccacgccgtcgccaatcaaggaggtggcgtccttgcggttctgcgtgccttcgagccaattggcgatgtcctgatattcggcatcggacatcttatcgatgtcatcctgcgactcgacgccttttagcgccttgctggcggaggtcaactgtttggtgaccagttcgtagtcgtcggtcagcgggaacaccgtgcgtgaggtcgagttgaagatactcaaaccgatacgttccccctcgaaatgcttgaccagttccaaataggtatcgatgacctcgcgatcataggggagcgtggaccccgacacatccagacacaggacgatatctcggctggaagcgcgttcgtcaccggcgtccacttggctggggcgagccaccagcacaatggccagcgccagcgcaagcaccagcacgctgatggcgagacggcccaaagcgcgccattgacggaacaggcgggaagcgtgctcggtattgagatcgtcatccatcgagaatacaggggtgtcgtcggcggcgttacggcgggcgaacacgacaatcagcacgataatcgccagcgtcgccaagacgccggccagagcggcccaaggccaatgccatgccagcatcatgaacgccacctttccaccagattcgccacccactcggcggcctgctgcacgctggtcgtctgggcgattcggttgcgggcatcatcggcaaattccggtggatacaacgcgccaatggtctgcttcaatgcgtccaatccttggcgattcgcgggcgtgcgattcaggtacgccaaatcggtcagcgtactggaactaagctccttgcctgatgcggcaccggcgaaatcacgggcgatgacggccaattcgacgaaagcctcatgccggggcagtgctccggattcatgacgggccaccacatcgtcgatgcgggaacgccactcggccttggagctggcattgctatgagcgccacgcgcacggtcgctgttccgaggtttgcgtgcggggcgagacagcatgatgatcaacgcgatcagacctaccgccagcaacaggcatgcgacgatggccaccaccaggggagtggtcaaggccaacgactccacgggcctgagatcgccgggatcagtggcgagcgggatgatggggaacatgctgtgcatcatagatcaccagccaaagtcagtccgaccagttcgggtgcagtacccagtctattgcgtgtggtgcgggccaatgcccgggacaccagggcgacgaaacgatcgaacatggattcgctggatgcggatcgaatgatatgggaaccggcacgggtgagctcctgttccaaagccgcggccatatacgcgcgatgagtatcgatctcggccgctgccttggcgttgcgcaggaatgccggcacacgccgtgcactcaagccgtcggtgggagcgtggcgggatgagacggccttgaacggattcatcgtcgccacatcgatcagcaccatcggatgggtgcgggtaatacgacggatcgtggtgatatgccgctcctccatcgcatgctcatcggtggccaatacgatcaatgcctcgcgatccttgatacggcgcgcatattccagcagcgcgtcgatattacggtgatgattccaatcacggtcaagcgccttgtccagcgtgcgttcgaactgcgcgaacccaccgttgaacggcacgcgggtgatactggactcatcgccgaacaccagcgaaatatcgtccgaccggcgcaacgacagtgcggcgaacatacgcagcgcattggcggcaacctgccatgcgcgttctccggaagggcatacgccagtcatctccaggcccacgtccatcagcaaccagacccgtgacgtcgacaggcgctcgcgctcgaccaccatggggcggccttggcgggcgctggtcttccaatcgataagacgggattcgtcgcctggctcataggcatgcacatccatcgcatcgccgctgccgccgcgacgcccggatgcgtgttcgccctccagcgcgcccaaagccttccttacggtaggcaggctcagctgagtgccaagggcctcgatcttcttgcgaacggaatcggaactcacggaacaggaaccgtttcgacgatcttgtcgacgatctgatcgctgaccacgccatcggccagtgcctcgaacgtcagcataatacggtggcgcagcacctcatgagcgaacgccttgaggtcctcgggtaccacatagtcgcgcccggacagcaacgccttcgcctggccgatacgggtcaaggcgatggtggcgcgcggcgaggcgcccaaacgcaccaaggacgacagtcccttgatggggcgggagccggcacctcgtgacgtggcggtgatatcgaccgcataacgcatgatcgcgtcggaaacatgcacgcggcgtgccgccttgcgcaaaaaatcaacgtcggacacggaaatgcgtccgccggtgatggtgtcgggaccgatcatatcggagccgcggcgggtgagcatggccagcatccgagcctcttcgtcgggcgaaggataggtcatgacggccttcatcatgaaacgatccatctgggcttcgggcaggttgaacgtgccctcctcctcgatcggattctcggtggcgatcaccatgaacggcttgggcaaggcgatacgctgcccgccgatggtcgtggcaccctcggccatggcctcaagcatggcggactgggttttggcattcgaacggttgatctcgtccagcagtacgaaattggcgtgaatcggaccgatctgcgtggtgaacttctgcgacgcaaaatcgaagacctgcgtgcccaccagatcagatggcatgagatcaggagtgcactgcacgcgcttgaacgagccggatacgcaggtggcgagcgtctgggcggccgtggtcttggccaagcccggcacggattcgataagaatatgcccgccggccaccaaggtcacgataagcgattcgcgtagattatcctgacccaccagtgtctgggcgaacctcgcccgaatggcgtcggccaggatacgtgcgcgtttggcgtcatcggcacccagcggagccgacacgccgggcgcgggaacggcgaccggtcgtgcggcggtggtcggcgaaggtatgttcggttgcgtggggaacaaagtcatgccccccactgtaactactcacaatgactgttggcctgcctaaagagtccaatccaccgggtcggcacccatggtgactagggcttgattggctctggagaatggtttggagccgaagaatccgcgggaagcggacagcggactcggatgaggcgatttgataatgaaggcattggtcagcaatggctcgaggctttgcgcattacgcccccagagaatcgccaccagcggctggggcttgccgtcggcgtccgtgcgcgcgttcaacgcacgaatcgcggcctcggtgacttcctcccagcctttgccctgatgcgaatttggccgcccgacgccgacagtcagacatctgttgagcaacatcaccccacgttccgtccacggtgtcagatcgccgttggtgggcatgggcaccccaaggtcgtcaaccaattccttataaatattgaccaggcttttcggcagcgggtgaacatttggcgccacgcagaagctcaaacccaccgggtgacccggggtcgggtaggggtcctggccgacaatcagcaccttgatggaatcgaacgggatggtgaacgcgcgcagaatattgtggcttgccggcagccacgggcgcccggcggcgttttccgcacgaagaaaatcgcccatatggtggatggtgggctccacgtcggccaaggcatgggcccaccctggctctaccagttcgctcaatggtttgatcatgactcaccactgtagtcaaacgtgcatatccggtgcatggggcgtggtgtggtggactgatgagttgtttgccgattacactcatgggtagttttgataggaagaaagggcgattatggcacgcgacacgatgacctacgaatcctatgaaccggattccttcgacaatcctccgaagggaccggtgggagttcaccgtggcgctcgttcggtaatggcccgcctctgcccgttcatcgtcgttattctggtggccgcgctgtgcggtgtcggggcctgggcatggatttccggagaatacaagaatgtagtgggaggatcgtcccagacggcgaccacgtccaagtccgattcgtccagcaaggctgagaccaagaacagcaccaaggatgattcctcgtccacttcgaccgattcgtccaaggactcgacttcggattcggcaaagtccgataccgacagtgacacgacatcctcgaatgagaatcaaaactccgatcagcagtctcagcagtccgaagccatcgcgactgtgaataaggccacgcaggtgcgtgtggtcaacgccacaggaatccaaggatatgcgggtcagcaggccgatgtgctgcagaccgccggttacaccagtgtcgaggcgaccaatccgagcggcacattgccggcttcttccgtggtgtggtatcagaatgagaccgataaggccaccgctgaggatgtggcgaccacgcttggcatttcggctgtggagcaggtgcaaggactcgccgttcccattacggtggtgttgctcaactagcgttgttgatgcgcccctgatatcggcgagaaatacatcgaaaactgtgagcgttctcacgcctatggaataattcgtaccgaaaatgtgccactgcggttgagattgttccctcgtcactgtacaatcatcatctagtcgcgaggtagggggagcgcgatgcggttctttctacgttccctataggttttgtgtcgcgacgcccaagggaacaaaggaaagaccagatatggcacaaggcaccgtgaagttcttccttgccaagaaggggttcgggtttatccagccggacgacggcggcgaggacgttttcgtgcactacgcggaaatcaaggacgacggcagcaccaataagttcaagatgctgtacgaaggcgatcgcgtggagtatacgcccgcttcgtccggcaaaggcacgcaggcaaaggatgttgtcaagctgtcttcgggtgaagcccgctccgagtgagcaacacgcacgcaaggatgtgctttgaaggccctgaccgtttcgacggttggggctttttcatgcccaaagcgcaatcgccgccgatggtgttggcactcggcgggcgcgagtgctaatgtctgggttagcactcggaggtcgagagtgataatcggcagctgacggctggtcgtcacgactcgacgcttgcgagtgataaccggtatacctagccatttggaggaatacgcaaccatggcaaagatcatctcttatgatgaggaagcccgtcagggcatgctggagggccttgacaagctcgccaacaccgtcaaggtcactctgggcccgaagggccgcaacgtcgtgctcgacaagacctacggcgctccgaccatcaccaacgatggcgtgtccatcgccaaggaaatcgaccttgaagacccgtacgagcgcatcggcgccgagctggtcaaggaagtcgccaagaagaccgacgacgtcgccggtgacggcaccaccactgcaaccgtgctcgctcagtccctggttcacgagggtctgaagaacgtggtcgccggctccaacccgatcgccctgcgtcgcggcatcgagaaggccaccgaggtcatcgtcaaggaactcgtcgctgccgccaaggacgtcgagaccaaggaccagatcgctgctaccgccaccatctccgccgctgaccctgaggtcggcgagaagatcgctgaggctctggacaaggtcggccaggacggcgttgtgaccgttgaagacaacaaccgcttcggcctggacctcgacttcaccgagggcatgcgtttcgacaagggctacatcgccccgtacttcgtcaccaacgctgacgaccagaccgcagtgctcgaagacccgtacattttgctgacctccggcaaggtctcctcccagcaggacatcgtgcacgtggccgagctggtcatgaagaccggcaagccgctgctgatcatcgctgaggacgtcgacggcgaagcactgccgaccttgatcctgaacaacatccgtggcaccttcaagtcctgcgccgtcaaggccccgggctttggcgaccgtcgcaaggccatgctgcaggatatggccatcctgaccggtgctcaggttgtctccgacgaactgggcctgaagctcgagtccgtcgacacctccgtgctcggccacgccaagaaggtcatcgtctccaaggacgagaccaccatcgttcagggcgctggctccaaggaagacatcgacgctcgcgtggcccagatccgcgctgagatcgagaacaccgactctgattacgaccgtgagaagctgcaggagcgtctggccaagctggctggcggcgtggctgtcatcaaggtcggcgctgccaccgaggtcgaggccaaggagcgcaagcaccgcatcgaagatgccgtgcgtaacgccaaggccgccatcgaggaaggcctgctgcctggcggtggcgtggccctcgttcaggctgctgccaaggccgagaagaccgaggccgtcacctccctgaccggcgaagaggctaccggtgccgccatcgtgttccgcgccatcgaggccccgatcaagcagatcgccgagaacgccggcgtgtccggtgacgtggtcatcaacaccgtccgctccctgcctgatggcgaaggcttcaacgccgccaccgacacctacgaagacctgctggccgccggtgtgaccgacccggtcaaggtgacccgctccgctctgcagaacgccgcctccatcgctggtctgttcctgaccaccgaggccgtcgttgccaacaagccggagccgaagtctgctgccccggccgccggtgccgacatgggctactgatccgcaaacgatcgctagctgattgagctgaaaggggactccttcgggagtccccttttttgtattccagccccctcagggaggagagccaagaaactagctggcaaacaggcgcgaagcttggatttcggcgtcagcgtacacggtggaggcttgcgtcagcgagcgttggatggactcgagtgaggcctccatctgctgttgggccgcacgccactgttcggctaccgcggtgaactgggtggccgccgaacctcgccatgcgtcctgcaaggcattgagattggtgtacatgccgcccacggcctgcctgatttgcgagatcgaagtggccactgcggccgaggatgattggattcgctcggaatctacctgatattggggcatcgttgctccttttctagagggttaatggtatgtatggcggccgattgccaataccggccgttaaggtggaggatatgtcaacaacgaatcgggaagacggaaaaacaactattgtggtcctagcttcggagccgtcctattcggccttcgggaatatggtccgaaaatggcttgtttgcgccatttgcgcccttgctgcagtagcgatgaacgcaatgtggataaccgcaaatgcctatggggataactcgagcgacagctctgacagctccagcagcagcaccgacagcggcgtgaccatcaccgagaacatcacggatacggaaaatctcctgggctcccatgcggccgaagtcacggatgccatcgccaaaaccgagaaggaaaccggtgtacacgtgcatctgctgtatctttccagtttcaatagtcaacagaaaccgggagactgggcggcaaccgtgatggagtccatgaatcccaagccgaacacagtgatgcttgccgtggcctcgaatgacggcaacctggtggtcgtcgtgtccaagaactccgataagtggcttctcgataacaaaaccgtcgataagctatccgaagccgcacagcagccgttactggaaaacccgccgagctggtctggcgcggcaacggcaatgatggatcaaatcgtgaaatccaaaaaagcctccacctcatcgtccacggtgatcgtaggcataatcatcatgggtgtggtattggtggcgctggtcatcatcatcgtggtcatggtggtgattcatcggcgcaaggagatcaagaaggattccaaggccgaactccaagatgacattcaggaaacgcccagaagagcgcgacactctaggaagcatgagtaagcctattgaagcatcgattgttgttgtcgacgacgagccgtccatccgagaactgctggtcgcttccctgcacttcgccggattcgaggtaaacaccgccgcttccggttctgaagccattgaggttatcgaaaaagtgcagcctgacctcatcgtgttggacgtcatgctgcctgacatcgatggattcaccgtcacccgtcgcatccgccaggaaggcattaacgcccctgtgctgtttctcaccgctcgtgacgacacccaagacaagatcatgggcctgaccgtcggcggtgacgattacgtcaccaagccgttcagcctcgaggaagtcgtggctcgcatccgcgccattctgcgccgtacccgcgaacaggtggaagacgatccgattattcgcgtcgccgacttggaaatcaacgaggactcccacgacgtgacccgtgcagggcagccggttgacctgagccctaccgaatacaagctgctgcgctacctgatggacaacgagggccgagtactgtccaaggcacagattctcgaccatgtctggcaatacgactggggcggcgacgcagccatcgtcgaatcgtacatctcctacctgcgcaagaaagtcgacggcatcgaggtcgacgacggcgaaggcggcaagcgcaaggtgactccgctgatcgaaaccaagcgcggcatcggatacatgattcgcgaaccgaagaactaatcgcctccatccataacgtatcgcaatctcatgagtatccccgataagcagtcaggcggcgtaccgccgagcagcacgccgaacgccgccccgaacacgaatcccatgcctgcaatgtcgccgttcgccgcccatttccaagagcagcgcgagcgtaagaaaaacatgctgatgcggcatatcgaccgtatctcgttgagcagcaagctggtggcctgcaccatcgccgtgctgctcatcggcgtgtcggtgatttccttctccatccgcgcgttggtgaacaactacatgctgcagaaaaccgacacccagttaagctcgcaaagccaactggtggtcaacaatatcgatctgctgtcaaaaaatgactcatcggggccgaactcgtactttctgcagattcaatacaccgacggaaccaaagacaaagaaggcaatcctctggtcgtgaccccgctgatgccgcagatgcaggacggtatagtatcggtgccgattctgcctacctatggcgataccaatggcatcacgctcggtcaggcattcactacgcaggcggtggccaagcagatcatcacggtgcagtccgacagtgcggacagccagaacgatccggccaacggaaactccaattcctctgacaccatcaccaaggtactggccaaccccactgccaatgccaaccatgccgccatcgtcacggcgagggcaccatggcgtattctgccggtgaccttccagcaaaacggcaaggaccgtgccgtggtgtacatcggcttgtcgctggccgaccaaatcgacaccgtcaacacactcacccgatactgcattgtggtcggcatcgccgtggtgctgctcggcggctccctgtccacgctgatcatccagcacacgatgacgccgctgaagcgcatcgagaagaccgccgcgaaaattgcagccggcgacctgagccaacgtattccttccgcgccggaaaacaccgaggtcggctctctggccgcctcgctgaattccatgctcacccgaatagaatccagtttccatgagcaggaggagaccaccgacaagatgaaacggttcgtctccgacgccagccatgagctgcgcaccccgttggccgccatccatggctatgcggagctgtataagatgcagcgcgatatgcctggtgccttggagcgtgcggacgagtccatcgaacatatcgaacggtccagccagcgcatgactgttcttgttgaggatctgctgtctttggcccgtctcgatgaggggcgcggcatcgatatgaccggcacggtgaaactctcgtcgctggtcaccgacgccgtcgacgatttgcatgcgctcgacccggaccgtgccgttcgccgcatgcagattttcctcgaaccggcgcgcgatttgaaccatcccgccgaattcagccttgccgaaggcgattggcctgaggtcgtactgcccggtgatgcctctcgactgcgccaggtggtgaccaacatcgtgggcaacatccaccgctacacgcctgccgattcgcccgctgaagccgcgctcggtgtgatgccggccgccatcgatccaagacagctcgcccgcatgcccgccagcgacgcgtcaatgcggcggttcatcgacgctgccgaagtaggtgcctcgatgcagaccggctatcgatacgccgtattgcgtttcgtggaccatggccccggcgtgccgtctgaatcgcgctcgaagattttcgaacgcttctacaccgcggacccatcccgtgcccgcgaaaagggcggtactggtttgggcatggccatcgcgcaatccgtggtcaaagcacatcacggctttatctgcgccaccggcaccgatgggggaggcctgaccttcaccgtggtgctgccgattgagcagatcgccgctcctgagcccaagcagtccaccggcaaaaccaaggacgccaaacagaagacttcttggttcagctctgagcgtaagactcaggcgactcagcccaaagcgtgaggtcaagccctgtgaggtaaactgtaccttcggtttactatttccattgaggattaaggaaggttcgcaatgcccaccggtcgagttcgttggtttgacgcagccaagggttatggcttcatcaccagtgaggaaggcaaggacgtgttcctgccggctcaggccctacccactggcgccaccacgttgcgcaagggggccaaggtggagtattccgtggtggacggccgtcgtgggccgcaggccatggatgttcgcctgatcgcctccgctcccagcttggtcaaggccacccgcccgaaggcggatgacatggccgccatctgcgaggacctcatcaagatgcttgatgcggccggcaatacgttgcgccgtcaccgttacccatctgctgccgacagcaaaaagctggccacgttgctgcgtgcggtggcggatcaattcgatgtacaggactgatctgatctatgactgataccaccgaaaccatcgtgacaccggaccctcacgccatcgcgcgcgccgtgctgctcgaagtggccgacgagagcgatcaggtgggggatttcgttacctcatatgatcttgaggatcacgtcactgacttccgcttcgccgcgaatatccgtggctacgaaggatggcaatggtcggtgacgctgtatcacgacgaggagatcgactcctggaccgtcaacgaatcctccttgatccccactgagggcgcgttgatgccgcccaagtggattccttggaaggatcgccttgagcccacggatctggctcccaccgattcgatcggtaccgatccggatgacgagcgcatcgaggaaggcgaagtcgaggaatcctcgctgcaggatgtcaacgacgccgtcgagaccttccgactgacccgccgtcacgtgctgacctcgctgggccgcgcgcaggctgccaagcgctggtatgaaggtccgcgaggccccaaagcgttgagcaccaaaaccgccgaaggcaacctgtgctccacctgtggtttcttcgtgccgctcgcgggcgaactcgaccgtatgttcggcgtgtgcgccaacaagtggagtccggatgacggccgcgtggtttccttggaccacggctgcggtgagcattccgaaattgaacctcccgagccaagccagctgtgggtgcagtccaagcctgctttcgacgatctgcatatcgacgtggtggccaaccgtccgcgcaagcaggagccggctgcccaggacgaggccgaaggcgaaaccgacaagacaggcgagcctgccggtgatgatatcgaagcacagaagactgttgacgggaacgccgtcgatactgagcccgctgaggaggcggcaggcgacgggacctcgcaatcccagtctgccggtgatgagtccgttgcacagaacgcatccgattccgttgtggatgttgatgcagctgattccagcgacgagtccaagtctgatgctgacgacgaggccaccgaagaggatatcctcaacaacaccgttgccgatgatgatgaggatgatgagatggacgacgaagaggataacgttcgtcatacagacgatgtgactcctgaactcgaaaccgtcatcgatctcatcgagcagctgcgccagaacagggcggacgaagaataaactccgaattccgcgaaaagtagatggtggtggggttgcaggaataaagaactcctccctgcaagcccatcaccgaggcgtgcgttagcactccatgccgatttcggtgaatcagtgcaccacggtcaccgtgcactcggcgaagttcacgatctggcgggacaccgatcccaggaagtgtgcgtccagcccggacaggccacgcgagccgaccaccagatggctggcgtaccgcgaggccgcgatcagacctttggatgcgggaatatggaaggcgtttgtgctgaccttgacgccatcgggaatccgggccttggccatcagctcagagagaatctcctcggcgcggcgctgaccgaccttcaccggtgccacggcgttctcatagcccggaataacgcccaaatccttgagctgccagcagaacatcacatgcagcggcgcgtcgtgcagtcgtgcttcttccagtgcgaaatcgaacgcacggcgggaagtctcggaaccatccacaccaaccaccaccgggcggcgagcctcctcaaccaccggctgaggctgcgtgtagtgaacgggcttgtctcccggagtcagggcgttggcaatggcctcggtcacggtctcatcctcgctgccggcgatgcgcaccacggtcaccggcacttcggcggcctcggccagcgaagcggacagggaccccatgaaccagcgggccatacggctcagcgagcggcggccgaccacgatctgctgcgaatcatggccgatctgcagcagggccgaagtaccggaggccttcaccgaggtgagcttcagattcgccggatcgaagtcgatgcctgcagcggccttgtcgacccacacacgcagctcgttggcaatatcgtggcggaccttggcccaggcctcgtcgctgtccggttcggaccccatatcccaggaatgcgtccagccaaacacggcgttgacgctctgaccggttaacgaggcctcctcaagcgcccacttcagcgcggcaaaggattcatcggaaccatccacaccgacaacgatgtcgggcttggttgcagcttcactcatttcgagcctccttgtaatcgactacgggtgaatctagaaccagcatatcgttttcttctcctctcacggcgcaattcgtggaatctcatgaataaacgtcatcgtgaatcggtagagtaggacggaatgtcaattgaggaaggacaagcatgttcgaacggtttaccgaccgtgcacggcgcgtgatcgtgttggcgcaggaagaggcgagggcccttcagcacaactacatcggcaccgaacacctgctgctcggcctgatccgtgaaggtgagggtgtagccgccaaggcactcgcctcgaagggcgtggagctggatgccacccgcaagcaggttgaagaaatgatcggcaagggcaacgcggctccgaacgggcacatcccctttactccgcacgccaagcaggtgttggagttttcgctgcgtgaagccctgcagctgggccacagctacatcggcaccgagcacatcctgctcggcctgattcgcgaaggcgaaggcgtgggcacccaggtgctcatcaagatggacgtcgatctgggcgagttgcgtagcgcgaccatcgatatgattcgcggcaactccggcaccggcaccggtgacggcaagggtgatttggccaacgcaggtggcgtgacggacaagcagaacaagtccggttccgccatcctcgatcagttcggccgcaacctgaccgccgaagccgctgaaggcaagctggacccggtcatcggccgtaccaacgagattgagcgtgttatggtcgtgctctcccgccgcaccaagaacaacccggtgctgatcggcgagcccggcgtgggcaagaccgctgtggtcgaaggcttggcccagaagatccaagccggcgacgtgccggaaaccctgaagggcaagcaggtctactcgctggacctcggttccatggtggccggctcccgctaccgtggtgatttcgaggagcgcctgaagaaggtgctgaaggaaatcaagactcgtggcgacatcgtgctgttcatcgacgagatccacaccatcgtgggcgccggctccgccgacggcgcgctgggtgcctctgacatgttgaagccgatgctggctcgtggcgagctccagaccatcggtgccaccaccaccgacgagtaccgcaagtacatcgagaaggacgcggctctggaacgccgtttccagccgattcaggtgcacgagccgaccatcgccgagaccatcgagatcctgaagggcctgcgttcccgttacgagaaccaccaccacgtgaccatcaccgatggcgcgctgcagtctgccgcagagctgtccagccggtacatccaggaccgtaacctgcctgacaaggccatcgacctgatcgatgaggccggtgcacgcctgcgcatcaagcgcctgaccgccccgcctgagctcaaggaactcgacgagaagatcgccaagatcgccgccgacaaggacgaggccatcaagggccaggacttcgagaaggccgccgaactgcgcgacaagcaggagaagctggaagccgatcgcaagcagaaggaagactcctggcgcgaaggcgagtccgacgtcaagatggtcgtggacgaggacgtgatcgccgaggtcatcagctccaccaccggtatcccggtgttcaagctgactcaggccgagtccaagaaactgctcaacatggaagccgaactgcacaagcgcatcatcggccaggacgaggcggtttccgccctgtcccgctctatccgccgtactcgcgtgggtctgaaggacccgaagcgcccgtccggttcgttcatcttcgccggccccaccggcgtcggcaagaccgagctggccaagacgctcgccgaattcctgttcgacgatgaggacgcgctgattcgcgtggatatgtccgagttctccgagaagtacgcggcttcgcgactcttcggtgcgcctccgggatacgtcggctacgaggaaggcggcgagctcaccgaaaaggtgcgccgcaagccgttctccgtggtgctgttcgacgagatcgaaaaggctcatccggacatcttcaacacgttgctgcaggtgctcgatgacggccacctgaccgacggtcagggccgcaaggtggactttaagaacaccatcatcatcctgaccaccaacctcggtacgcgagacatcgccaaggccgccaacacgggcttcaacctaggtgccaacaacgagtccagctaccagcgcatgaaggaccaggtcagctccgaattgaagcagcagttccgcccggagttcctgaaccgtctggacgacatcatcgtcttcaagcagctcaccgagccgcaggtgcgccagatcgtggatctggacgtcaagcagctcaacgaccgcctgttcgaccgtcatatgtcgctcgaactcaccgacgccgccaaggacctgctcgcgcagaagggcttcgacccgctgctcggtgcccgtccgctgcgccgcgtgattcagcgcgacatcgaggacgccatctccgagaagatcctgatgggcgatctcgaagacggtcagcgcgtgattgtggatgcggaaggcgagggtatcctcggcgaattcaccttcaagggtgaggagttcgaggagccggccgccgccgataagcccgccgaagacggtgccgccactgatggcgagactccagccgacgccactccggccactgagccggccgaatccgctcccgccgattccggtgacgctccgcaggagtagtccgtttcgatagcgtagctagcgcataccagcaaagctccccttgacaggggagctgtcagcgaagctgactgaggggtagacctgcgcacacatgatgtgcacgtttgtggtctacccctcagttgcctctggcgacagctcccctgtcaaggggagctactgtttgtgtcggattattacagcagggcgagtccggtgtcgatggtctcctcgcgggtaaacagcgtgcggccggcgcgcaccgaacgcaataccgagcagcgctcatacacggcgttgaacacgctatcggcgtccagcacaatgaagtttgctggcttgcccgtttccaagccgtacatatcgcgcaggcccaacgtagtggcaccgttgacggtcaggaacttcaacgcatcgtcgatttcttcaaagctcatcatctgtgccaaatgcagcacataatcaagaatgagcatcatattgccattgcccaacgggtaccacgggtcctgcattgaatcctggcccaatgacacattgacacccgcctcagtgagctccttgactcgcgtgatgccacggcgcttggggaaggtatcctgacggccctgcaaatacaggttctcggtgggggcgcaggcgaagttgatatgcgccgccttaagcagcttggtcaggtggaagaagtaggcgttgtccgccgatcccagcgaacaggtgtggctggcggtgaccttcgggccaatgccagccttatatgccagcgccgaaagcagctccacgtaacgggaattcggatcatccgtctcatcgcaatgcacgtcgatgagcttgtcgtatttcgaagccaactcaactaccgtgtgcatggaatgctcgccaaactcacggcactgttcgaaatgggggatgccgcccacgcagtcggcacccatcttgagtccttcctccaccagctcggcacccgattcgccatgcgggccctcgtaggagtacatgccctcctgcgggaagctgacgatctggagagtgaccgtatccttcaattcctccttaagctccagcagcgcctttaacgaggtcaggttcgggtcggtcacatcggcatgggatcgaatgagctgcacgccatgcagcatttctttcttaatgccgattttcgcgcgctgcttgatctcgtcgaccgtcaagtcggacttggtctcactccatcgctggatgccctcaaacaaggttccgctttcattcaccgcaccgggcttgcgggccgtgaatacgtaatcaaggtgcagatgcgtatcgcagaacggtgggcagacaagtttgccgcccagatcgaccacctcaatggccgccagatcaccaccctgagcctcatattgttgcgcgagtccggggccgaatgcggtgaacacaccatccgtgacgagaatgtcctgcaatggcagggtgcttgcagccgtgcttccgggttctccggtggcgatatgtgcgttggtgaacagtgtggtagtcatcgtcgctccttcaactggtgtgttgccgaacggttacgtgaaccgactgcccgcgtaaccaactgaggttattgtcaacagcacgctttgcggtgaggttaaccggaacgaccggtgttccgcgggggaatggacagattgtatgactgtatcgattcgcagtgtgcttcataacacgcagttcaaacgagccgatcctgtggtggaggtcgaaggcaaagacctcgatacgccagtgcgatgggtgttcaccaacgagcgagaggatgtctccagcttcctttcgggcggtgagatgctgattatcgagggcaacgctctgctcgccgccgattggcacggcacgctaggacaatatgtagcaagcctggcacaggctggtgtcgccgctctggtggtcgaactggtggagggtgtggtgcggatgccggacgaactggtgtctgcgaccaggctgcatgggttgacgttgatcggtctgaaatctcgcgtaccttttgtcgacatctgtcagagcgtcaataccgctatcgtgcacgaacagatgcacttgcaattggaggtggacacaatgtccacttcattacgtgagggattgtcccgtaccggcaatatcgaggctgtggccgaaaccattgcgtcgctgttcggcgaaagcgtcgccattttcgatggtgacggtctgttggccgctcgagcgggtcgtgcgttcgatgccggcaacgaatcgagcgccgtcatcgcccttgaaagtcgctcccggccggtgggagcattggagatcacgcaacgcaccatgacttccgacgccacgatgcgtcgggccatcgccaccatcgtgtctccggtggccgccctttatattgacggcggtgcgcgcatgggcatgatgcatcatctgagtatgggtccggccgacggcgtgcacgtcaatacatttgaggcgcaggaagcgcatgcgatgctcgaagcgctgggttttgccggatcatgcatctatatgccattcgcttttcggttcagatcggtggtggaaggcatcaaccatgtatcgacgatggtcgaacggttcgaagaactgtcgggatgcgccgtctcctgcatgctggaaggtgacttgatggtcggatggtgctccaccaccgattcctcagacggtgcggccgcattcggacgccattgcatggatgcgcttgccgtactggaaggcgacggtatatacgtggtgcatggccgagtggcattggacacggtgacgctggtcgacgggttcgcggtattgcgtgacatcgccaatcatgaaccggcatacgggcgagtcgtaagtaccatgtccgcactcatcgaccgtttcgtcgcatcctctgatatggacaaggcgatgcgcatgctcgtggtgcagaccatcggattcgaggtcgccgcctccccgctgttgctggacacactgtgcgcctgcttcgacaacctcgacagcaaaaccggcgcgtgcgagcaattgggtatcagacggcaaaccctgtacaaccgactggacaaagtgacacaaatggtcggcgtcgactataacgacaaaccgaactgggtgatgctgctattcgccgccaaactcacgaaatcatggcaagaacagcatggtgaataatacggcagtgccactgggcaacctgtccacttctacgccgaactggttaatcgacgattcacgtttcagcaaatactcaagggcatagtcgaggctatcgcggcgctggtcgacctgctgcgaaacgaattcccacttgaatcccattcagtcacacgaacagcacattcttgaaaggacggtgacatcatgagttccgcaacgattactacatctgcacgactgatgaattccacccctcaaactgaagaacaggccatggtcaggaaagtcgcggtatcctccttcctcggcaacttcatcgagtggttcgactacgcctcctattcgtacttcgccaccaccatcgccctggtgttcttcccaaccgacaatcacaccgtcgccatgctgcagaccttcggcgtgttcgcgctatccttcatcctgcgtccaatcggcgcactgttctggggtagctatggagataagaaaggccgtaaagccgcactggcccactcgattatgttcatgtccggtgcgagcttcctgatcggctgcctgccgtcttactcggtgattggcgtcggcgcgccgattctgcttctactgctgcgcatggtgcagggcttctccgcctccggtgaatatgccggtgcggccacgttcctcggcgaatatgcgcccacttcaaagcgcggcatctactgctcgctgattccggcttccaccgctgtcggtctgctcgccgggtctactctggccacgctgatggccaccaacatgaactctagcgcgatggtcggttggggatggcgtgtgccgttcctgctggccggcccgctcggtctgattgtgctgtacatccgcgccaagctcgccgattcccccgtctaccagtcgatgaacgatgcgcttgagtccaagagcgccgcctccgctggcggtcaaatcgctgccaagagcggcatgttcgccccgctcgccgaactgttccacaaccatctcaagtccctgatcatcagcttcggagcctgcgtgctgaacgcggtcggcttctacaccgtgctcacctacctgccgacctatctgtctgacaccgtcggcatggacgccccccccagtccggcaccatcaccaccatctgcctggtcgcctacgtgttcatggtgttcggcatgggccacatctccgacaaattcggccgcaagaaggtgctcatcggcgcttgcgtggcgttcatcgtcctcaccgttcctgccttcctcatcctcaacaccttccagttctggcccgtgctgctggttgagctggcaatgtgcgccaccctgaccgccaacgacggtaccctgtccagctacctgaccgagacgttccccacctccgtgcgcttcaccggattcgcgttcagcttcaatctggccaacgccatcttcggtggtacggcctcgttcatcgccactggcctggttgccctggccggttcgtccatcgccccggcctggtacatggtgggcgttgcggccatcgccttggtcgcgatgatcctctcccacgaaaacaccgacaaggatctgaatcacatctgatctcctcagctccggctccttccccgagggagccgggcgtattcatcgaccatccaatccaccaccaacctaaaggagtactgcaatgggtagcaaccgccgtatggaccacatgacctggccggaattcaaggaggcgaagactcgtcccgtcatcgtgccgatcggttcgaccgaacagcacggccagcatctgcccatcggcaccgacgcggtactcgccacgcgggtcgccgaagatctggcggaacgcatcgacggcaccgtgctgcccaccctgagctacggatacaagtccaagccgctctccggtggcgggccgctgttcccgggcactatcgacatgaacggcgtgacagtgatcaaccaaatgcacgacgtgctgagcgaactcatcgccgatggcttcaccaagatcgtcgtcatgaacgcgcattttgaaaacgaggcgttcatcgtcgaggccatcgacctggtcacccgcgaaaccgggggagtggccaccatcgtggaaaccaattggtgggacccggttccgcagtcggttatcgacaaggtattcgatggattggtgttccccggctgggcattggagcatgcggccgtcaccgaaacttcgttgatgctccactatgcgccggaactggtgcacatggatcgtatggtcgaggaagccggtgccacggcgaaatcctatgtccgctaccctgtgcgccaaggtgacgttcccgctcacggcggactcgccaatccggccggctcaagcgccgaacgcggccgtctgattgccgaggcgtgcgtggatgcggtagctgagatctgcgccgaggaatttggcgagtaatctccccttgctgacgcattcgtagtgactcgggttgcaaaggcctgaccctgatagtacggggtcaggcctttcccatcccaagacgccgctaagaattcacctgagagtcgcctttctaggcatggccgttcaatcgacgattctagcgtgactggtgtgagcaggaatatgaagaaccggcggtggaccggcaagcgatcgtggatcgtttttggtgcagtagcgcttatccttacggctctggtggttccttatgcttgtgctggaaccacgggagccgttcctttttccggtgataatccatcttccggcactcgtacggtgaccattgccgacatcactgattttcacgggcatatcgaacgtggtgcggacaacgccaccgccttcaccgtggccgacagccataatcccggcaatatgattccggtatcgaccggcgatttggtgggaggctccccgtatgagtcggcggtggagaaggaccaacccacgctggatatggccaaagcgtggggattgacgatttcggcggtaggcaaccatgagttcgaccgcggtgtcgccgatttcaacaatcgcatcgctgatcccagcaacggcatcgactggctgtgcgccaacacgtctgccgccaataagtcgtctgacggactgctgagccacgtacgtgactctacgattcgaacggtgaacggcaagcgaataggtttcgtgggcacccttactgatgcgctcggctcggtagccactccgcagatcactcgtgatgccgaccttgacgaacgggcggtggacgcaatcaatcgtgtggcccgtgaactcaagcgctccggaaaggtggatgcggtggtggccttgctgcatgacgatgcctcagccgccgccgatattgggcgagatgttgatgtggtatacaccggtcacagtcacgcgatcaagcacggtacgactgcgggtggcgcgcctatttacgaggcaggcagcttcgggcggaacatggccgtgcaggatttgatcatcaccggtgccgggcgtcgcgccacggtgcgagtggccgatgtggacctcggcaatggcaccagccatacggcggttgacggcgtgctgggcgtggaagggcttaatgcgcatccggcgcaagccgcttggatgtctgccggtgctgaggagaacgatgaggtatcgcgcgctcagcatatttaccaggcggcggcaacatattcgaatcatgccggcagcgcggtgattggcaccttggcctccggcgtgaatttcgacaaacaaggttcggacaagcacgggaatacggtcggtgtgctggtggcggacgcgaaccgagagtcaatcatgaagcatgtgtatgccgggaatcgcttgccggtaatcggattttcgaataatggcagtctgcggactccacggcttgatatgaatggcgatggcaaagtcaccgtgcgcgaggtggatagtctcatggccttgcagttcaaggccgcgcatgagacgctcaccgggcgcgatgtgaagagagtgctcgccgagcaatttcgccgtgacgatgggcgactggagcggcgctggctcggcatctcctcgaacgtgacgtatcggtatgccgaatgcggtacggctggtgagagcggcaatgccgatgccggcgttgatactgattccggcgctgataccaacgctgacgctaacgagtgtgctgccgacgaacatgcggcggttcgtatcgcgaacctcgccgttgacggccgaccgattgcggacgatgacctggtgattatcgcgtccaattcatatctgcttcagggcggcgacagttaccccgccttccgtgccggaaccaattacggcgagctggatatgccatacagccagccgttgcatgaatatctggccgcacatcaagggctcacggcagttgttgcagtaccggtagggactcaggcgtaagacaccaattgctgggtgactgaggaactatggggtgaagttatgagtatagggcaggagaaaacggcataaatatgacgaagctcccctcgctgaggggagctgtcgccgtaggcgactgaggggagcttgcggtataaccgtaaactcccctcagtcagccttgctgccggcttccctctgaggggcacctggcgagacccttacttgatggcgttcagccactgctccttggtggccttctcggcttcgagcttggccttcttcttcgggtcggattcggccgcgatcttggcgtcgagctcggcgagctgggcgttgagctgctcctcgaagctggacttgcgggcgtcggcctccggatcggtctgcttccaagcggcatcctcgatggccttgatctgcttgtcaacggcgtcgagacggttctcgatgcggcgcatatcgtcacgcggcacgtaaccgatctgatcccactcttcctgaatcttggccagctcctggcgggccttcttggcctcggcgtcggtcttcaccggcaccagagcctcggccttgaccagcagagcctccttggcagccagattctccttctcggaggagttgatctgatcgcgatcggcctgacgagcgttgaagaaggtgtcggcggcttcgcggaacttggcccacagctcgtcgtcctcgttacggccagcgcggccggccttcttccaacggtccatcagatcgttgaacttgcgggaagtctcaccccaagcggtggaatccttgagctcattggcctcggcgataatcgcttccttggcttccttggcggctgtacgctcgttgtcgcgagcctgagcccacttgcggcgagcctggttgaaggtggtacgggcgacggagaagcgcttccacagcgcctcggcctccggcttgtcgatgcgcacggtggtgcgctggtggttctgccactcgtcgaacaggttacggaacttgtcggcggtggagcgccagttggtgttgtcgcccagagaagcggccagtgcttcagccttctcgacaatggcggtgcgctcggcaacggccttggcctgagcggccttgcgtgcctcggcgatctcggccttcttggcctcgccggcggccttcagttccgcgtaacgggccttgagggccgcgaggtcgcccaccaccgccggctcggaggtttcttcacccaagagcttcacggattcgtcgatttcacgggccttgatgttcggggaagccaggcgggtggccagcagatcgagcttggccttgagatccaggaaacgacgggcgtacagtgccaacgcctcttccttggagacatccgggaactggcccacctcgcgctcggcgtcgccatccttgacgaagacggtgccgttgtcatccacgcggccgaaggcctcggcggccttgacatcagcctcggaataggcggcggtggcggcggccggggcggcagcgcgcggcttggccgccggagtcttcttggcgaaggcggcgggggagggcgcgtgcggtttcggcatggaagcgggggacggagtcggcgccggcgtggccgcgctggcctcgggtgcgggtgtcgttgcctgctcttcgggcgcagcggtgtttacgggttcggtgacagtttcgtcggccatggccagctccttaaagcgtagaatgcataagcgggagtgtctcccatcccgggcgaaccaggaagttttgacgcaaccctcacctattatattgatttcgtggctaaaggtgcatcaatatcaggattcccggagtggctcccctccgaacgtgttgtggagcagcgtgttatcgatacgcttcgtaaggtttttgagctcaacggcttcatcggcattgagacgcgagcggtggaaaccggcgcttctttgctgaaaaaaggcgagaccagcaaggagatttacctgctgagccgtttgcaggaggtcggtcatgaatccgacactccgattgaagagcgtttgggcctgcatttcgatctgaccgtgccgctgagccggtatgtggtcgagcactcgggtgcgttggcgttcccgttcaagcgctggcagattcagaaggtgtggcgtggcgagcgtccgcaggaaggccgcttccgcgagttcgtacaggccgacatcgacgtgatcggcgccggcgacctgcccgaccactatgaagtggaactgccgctggtcatggtctccgcactggaagagctgcgcgcgtatggcctccccaaggccaccgtgcacgccaataaccgcaagttgtctgaggggttctaccgtggccttggcctgacggacgtcgaaggcgtgctgcgcgagatcgacaagctcgacaagatcggtgccgatgaggtggcccgactgctcaccgagacctgcggcgccaccgaagcacaggcgcgcgcctgcctcgaattggccgagctcaccgcctccgatggtgccgagcttgccgccaagttcgatgcgctgtgcgaggctcacggcatcgtcaaggattccgagtcctacacgctggctcgtcagggactcgataccctggccatgatcgtcgacgaagccgccgccatccgccccggttccgtcatcgccgacctgaagatcgcccgcggtctcgactactacaccggttccgtctacgagaccttcctcgacggtgccgcatcactcggctccatctgctccggtggccgttacgacaatctcgcctcccagggcaaccgcaagtacccgggcgtgggcctgtccatcggcctgagccgactggtcagctacatgctgcacaccgccggcgctcacgccagccgtgtcagcccggccgccgtgctggtcgctgtgtggaatgaagaggaccgcccggccgccaatcgtattgcgaaccaactgcgtgcgcgcggcatcgctactgacgtggcacccaccgcggccaagctcggcaagcagatcaagtacgcggacaaactcggcattccgtacgtgtggttcccggccaccgctgccgaaagtgcggaaggcgcagagcccgctggcgacgaggtcaagaacatcgtcacgggcgagcaggttgccgccgattgcacgtcgtgggagccggatactgtggttgcccagcaaaccgtcgaaatctgacgtattcgcgcgaaaaatcgaggagaaacaagacaatgagccagacggcttacagaacacatcatgccactgaagtgaccgaggccctggtcggccagaaggtcaccctcgccggttgggttgaccgacgccgtgatcacggtggcgtggccttcatcgaccttcgtgattcgaccggcctcgtgcaggtcgtcatttacgacgaggatatggcccgcccgctgcgcagcgaattcgtgattcagattaccggcgaagtgcgcctgcgcccggatggcaacgagaacacccatctggccaccggcaagatcgaggttgtggccgagaccatcgagatcctcgccaagtccgacgccctgccgttccaggtttccaccgctcttgagaatgagtccgagaacaagctgcctggcgaggacgtgcgtctgaagtaccgttacctcgacctgcgccgcccgtccatgcagtacaatctgaagctgcgttccgacatggctaaggccgcccgccacgcgctggaagacatggacttcaccgaggtcgagaccccgaccttcattaagtccaccccggaaggcgcccgcgacttcgtggtgccggcccgtctggtgcccggttcctggtacgccctgccgcagtccccgcagctcctcaagcagctgctcatggtctccggcgtcgagcgttactaccagctcgcccgctgctaccgtgacgaggacttccgcgccgaccgtcagcccgagttcacccagctcgatatggagatggcctacgtggaccaggaagatgtgatggccatgactgagaaggtcatcgccgccatctggaagtccgccggctatgaggtccagctgccgctgccgcgcatcacctggaaggatgcgatggacaagtacggctccgacaagccggacctgcgcttcggcaacccgctggtggagctgaccgagtacttcaagaacacgccgttccgcgtgttccaggccccgtacgtgggtgccgtggtcttcaagggcggtgccgccacgccgcgtcgtcagttcgacgcttggcaggattgggctcgtcagcgtggagccaagggccttgcctacgtggtcttcggcgaaaacggcgagctcaagggccccgtcgccaagaacctatccgatgaggagcgcaacggcctacgcgaggccgtcggtgccgaggaaggcgacgccgtgttcttcgccgccggttcccgcgagtcagcccagctgctgctgggtgccgtgcgtgtggagctcgcctcccgcgaaggcctgctggatccgaagaagttcgctttcacttgggttgtggacttcccgctgttcaagcccaccgacgatccggatgatgacgatgtggctgtcggccactccaagtggacctccatgcaccacccgttcaccatgccttccaaggattggatcgacaagttcgacaaggatcccgagcacgccatgtccgactcctacgacatcgtctgcaacggtgaggagatgggcggcggttccgtacgtatccaccgcgacgacatccaagcccgtgtgctcgatgtgctgggcatcaccaaggaagaggccgacgagaagttcggcttcctgcttgaggcattcaagtacggcgctccgcctcacgcgggtctggccctcggttgggaccgcaccgtgtccatcctggccggtgcagactccatccgcgacgtcatcgccttcccgaaggccggcggcggccgcgacccgctgaccggtgctccggccccgatttccgacgagcagcgcgccgagactggcgtcgactacgacccggacgccgacgaaaactaatctacggagcgtataccgcctttcctcagcactcgacgtacttcagtgcgccttcggcttcggacggcggtctccgcacgcgtagattaattttcgaggagtaatgctccggtgctattagccgcaaatggcccttggaataattccaagggccatttgctttttgcgggtggggcccaatgtgccaaatacctgccaaggggtgccaaatactccgcccgatggcacctccgccatgcggcaaacctcgcaccatgcggtgtcccccttggcgtttgccgattatccttccatggggcggtaacttcctcatggggcggtaaacaacccatggggcggtgaaaaccccatggggcggtaggtcaaaatggcttaattccgcggtttcacaatttcttcaaaccgccccatgggcaaattaccgccccatgaggagcgatcgcaactccgtatttgatcaatgttgtgatgctttgttgtgttttgcttgtttccgcctcctgtattcccctttgcgcgcattgatggtaaggctgccgtctattaatacccggcatgaaggttgaggacggccaggaagcggtatttgcatcgcggtggcaacctcttgtgcgaaggcacgttgtttggcggtgttccacaggtcatcggcgaacacctcgatgacggtccagcccaattgccgcagacgtcgacgtttttgctggtcccgcacatattgtttgcggaagcgacggtgatgatcgccatcatattcaatagcgactttgtattgtggataagccatgtcaacggtgtaggtgtatccgttctctgaatcggtaatgccatattgtgtttgcggtatgggcaggccgaaaagcataagcgccaagcgtgtacgagtttcctgaacggaatccgatggttttacgagcttcagcgccgcctcacaacgcgcacggccaataacgcggtgaaaggccgttagtcgttgagtgaattgttcaatggcatatccataacgtctgatgagcgcttcagccagcaccactaattcagtgaggttgagatattgggcaaactgtatccacgcatccatgggatgcatgcaggttacgccgtttgagaaagcgatactgttgaactttgcattccatatgcgatagtcgacattgtccaatgaagagcgggtccccttgctcctcaccgtcacataaaaatccttctgcggcaacgtgctgtgcctcggcaactccacgccgcataattccaatgcggtatacagcgagaaacacaacgtgcgtttcgtgcgcactttgcccagcagattccaacaggccgtgttcttggccgtggctttggcgtcaagatctttgcgcagatagttgttgatttcgccattgtgcggcacttcgctgtatccgttcatgcgccgagcgtagcgcattccacggtggcacaggggcaaaaccgaaaaatggggataacttaagcggcgcgaactggttatccaccggcatatcgtgtgccgcgcccggttatccaccgcgcttcgggagtgtcgtccaccgtataacagcactcatcgtgtgcgaacagctagccacgctcaaaatgcctagcgcatttatacgaatacgacatgggaaacggcgagaccagccccacacaatacaaagtgaccgccagccatgcgcccgactgcggcatacacggcagcaacgccaacgacaccaaggccaaacatggaatcagcagataggacaacacgtgcccgctttgccgtcgcagcaacgtctcagccaccacgcagcaggcaatcagcgcacagcagacgccgagcgatgcgcgactcagcgagaatgtatgccgatgcccaatgccgccatcacgatgtctgatgcggaaatgagacatcgactgagcaactgtgtggacatactgtgaacacgttggaaacgtcggtgtgctatcctcccactcatgtctgaaacgaacaatgaaacagcagtgcgttcgcgcgcgacaagcacaacatcgccaagcaaggccaaattgaccccgctggttcccggcaaagaggacccgaaccgtccgctagtcgaactgacccacgtcgaaaagcacttcggtgctttgcacgtcctcaaggacatcaacctgaccgtcgccaagggtgaggtgctggtggtcgtgggcccgtccggctcaggcaagtccacgatgtgccgcaccatcaatcgcctcgagaccatcgattccggcgacatccgcatcgacggcaagcccctgccacaggaaggcaaggagctcgcgaacctcagggccgaagttggcatggtgttccagtcgttcaacctgttcgccaacaaaaccattcttgaaaacgtgacgctggccctcatcaaggtgcgtcacatggacaagaaggaagccgagcaactggccatggacctgctcgcccgcgtgggcgtcgactcccaggccagcaagatgccctcccagctctccggtggccagcagcagcgtgtggccatcgcccgcgcgctcgccatgcgccccaaggtcatgctgttcgacgagcccacttccgcactcgacccggaaatggtcaacgaagtgctcgacgtgatggtcgaactcgcgcatgaaggcatgacgatgatctgcgtgacccacgagatgggtttcgcgcgcaaggccgccgaccgcatcgtcttcatgtcggacggccagattctcgaagagaacacgcccgacgagttcttcgagcatccgcagaccgaccgtgccaaggacttcctctcgaagatcctcacccactgacgaacccactgaaagacgggtacgcaatccaatgacattcaccaatacgttcaaacggaaggcttgccgcgtgatcgccgcgctcgccgccgtggcctgcacaatgtcgctggccgcctgcggcgcggacgaaaccggcaagatccgcatcggcatcaaattcgaccagcctggcctgggcttcaagaagtccggcacctacgtgggcttcgacgtggacgtggccaaatacgtcgccaagaaactcggctattccgaagaccagatcatatggaaggaagccccctccaagcagcgtgaggccatgattcagaacggcgacgtggacatgatcctcgccacctactccatcaccgacgagcgcaagaaggccgtctccttcgctggcccgtacttcgtggccggacaggatctgctcgtgcgcaaggacgacaactccatcaacggccccgaagacctgaacggcaagcgcctatgctccgtcaccggttcgacctcggccgccaccgtcaaggagaagttcgcctccgaagtccagctcatggaacagcccggttacgccgaatgcgccaccgccctgttctccggcatcgtggacgcggtaaccaccgatgacatcatcctggccggcctggcctccgcctcgcgcggcaagctcaaggtggttggcaaaccgttcacgcaggaatactacggcgtgggcatcaagaagggcgatacgcagctggccaccaaaatcaacaacgccatcgtggacatgattcaggacggctcgtgggagaacgccatcagcgataacaccaagggcaccaactacacgcccgacgtacgctacaacccgcccatcccggacgaaggagaggaggcctgatgagcggattcctggaactcttcagccagtatgacgtgctcggcgcgtttctggtcaatatcgaactgaccttgtggtccgccctgttctccctgatcctcggcgtgatccttgtggtgatgcgcatctcgccgatttcctcactcagggccgtggccggtgcgtatgtggaactgttcaagaacctgccgctgaccatcatcatggtgttcatggtgctgggtgcctacgcgcagctgaagctcagcttctccgacaccttcaccacgaacttcttctggctcgcggtcaccggcctgagcctgtacacggcggcgttcgtgtgcgaatctctgcgttcgggcatcaacaccgtgccgattggccaggccgaggccgcacgagcgctgggcttgggcttcatgcagtccgccaccgagatcattctgccgcaggccttccgaggctccgtggcaccgctcggcaacacgctgatcgccctgctcaagaactccaccgtggccgccgccgcatccgtggccaccgaaacatcctcgctgatgagcgagatgatcgaattccgtcccgacgtgatcatccaaatcttcctgatcttcgcgctcggctacgtgatcctgatcatccccatcggcatgctcaccacgtacctgtccaacaaactcgccgtaaggaggtgacggatatggccgatacttcgaattccgtgctgttcgacgcgcccggtcccaagggccggcgcaccattcgcatcgtcaactggatcgcgggcattctgttcgcggtggtgctcgtgcttatcctcatgcgcctgcacaacccgccggacggcgagaaccagctcagctgggagctgtggaagcccgccgtcgaacgagaggcgtggaccgacttctacctgcccggactgtggatgaccatcaaggccaccatcgtggccgtggtgggtgccgtggtgttcggcctggtgttcggcgtgggccgactgctgccgaacccgttggtacgtggcgtctccgccgtgatcgtcgagttctgccgtgcggttcccgtgctgctgctcatgatcttcttctggcgatggttcgcgttcgcgggcctgcccagcccgtcctattgggccgtggtgctggccttggtgctgtacaacggttcggtggtcgccgaactggtgcgctccggcgtcggcaatctgccgggcggccagcgtgaggcctcgctcgctttgggcctgaccgaaacgcagtcgctgatggagatcgaggtgccgcaggccgtctacgccatgctgccggccgccgtcacccagctggtcgtggtgttgaaggataccgccctaggctcgatcatcatgtataccgacctgctgcaggaatcgcgccgactcggctcgatgtacttcaacatcctgcagacgctggtcatggccgcggtgatttacttcatcgcctgctggctgttgtcgaggctcgccgaatggctgccctcgcgcatgcagcagcgtacggccgcacccgccgaacccgagccgctggcgccgatcgccgccggcgacccgtccaatgtcaaccagatcgctgtggccaaggaggtcgaagagctgccgctgggcggtacgccgcgcaaataccatgtgcatcaccgtggcaccaacgcctcgattcgcaactggcggcgcacccgctacgaacagggatatgacgccacccagcccgagtcacaggttgacccggaaaccggcgaattccaggagtctcaaaagcctgaggacaagccagaggcctgacagtcagctcaatcgccgctaagccggcacgaagaatttactgagtgtttgactgggctccggctacgtagccttcacggaggataggttggaacatatgaagatgttccggcacctatcctccgtttttgctattgcgaccattgcgccgctggcgttggcggccacgctagccgtgacgcctgcaatcgcacaggccgaccagctgcccaacccggattgggtggcattgctctccgactacgaaaagaactattggcaggcccccaccgatgccgaacacggtggcaaggtgctcgacgccgatacaatgaaactcgacgaagatttggccgtggccattaaccacaaagccgccgaaaatctcgataaggatggcctgaacgcccaacgcaagcgtgcgctcgtcgactccgatctgcaagccgaggaagccatgccggacgcgctcggtccggtgcttggcaaatatatgagcgaagggctcaaatccgggaaactcaacgccgtcgccgatatcttctcctttaacgtggtctccacctacgcctcaaaacgtgcggccatgcatccgcgcccctatctgaaccgtgcggaaagcagctacggcggcactaacgatctcgccggactgcccgccacgcttgacatcaagcaatcaccctcatggctcgaacacgtgcccggctactcgaacttgcagaaaaacagttcctacccctccggccacactaccggcgcctattcgtggggtatcgcgctggccggcatgattcccgaactcgcgccgcaaatcatggcccgcacttcggaggccggcaacaaccgcatcgtgctcggcgtgcattatccgcttgacatcatgggcgggcgcattggcgcatccgcccagaacgggcagtactggcataacgaattcgcttcgtccatcgtgcccgcgtcccggcagctgcgcgactatctggtgtcccgctgcgccgcggacggccacggcactaccctcgtcgtctgcatcgccaacaccaaggcctccggttcgggcggctacaccaacgattttctggacccagtggccaccgagccggtcgtggaccaagcctcggccgtgcgcgtctacaccgcacgcctgacctacaccttcccgaaagacaccgcccagtccggcgctgatttcgtggccccgcgcggggcagcggacgtgctgcgactggcctatcccgaactgcacgccgatcagcgcaacgcgattttgaaagccactgccttggattccggataccccctatggcaatcgagcgacggctggcagcgtatcaactgggccaaagccctgtgcgcccgcgtcaccttggataagcacggcgatgtggccaaggtcgagaccgccgaccaagtggcgcttaccggcccgagtgtggtcaatgcccagtacaccgacgcgggcaatcacccggcgtcggatagctcggcgggtgaaaacagtgccattgcggccggaccggatctcgccaccctccatgccgcgcaacgaccggcgttgatcagcgtagctatcggtaccgctgtaatcgcgattgtcggcggaatacggacggttcgacgcaaatccaagaaccagcttcagcagtaattcagccaaagttcagtcgcgctgctcaccgctgcggtgacactgagcagcatcgccctgatcggcgtgcccgctgcgactgcggacgagcagcagaccactgccgaacagaacacggctgccaaaccatccgtaatcatcaacgaggtctatgccggcaatacgaaagctgccggagacccggatagcaagcgttgcgattgggccgagctcaagaacaccggctccacagacgttgacgtgaagggctggggcatctacgacagcggcaagaaagccaagaagcactacaccatcggcgccagcgaagtaacgaatacggacaccgtcatcaaagccggcggatatctggtggcatacatcgaccccgacaaggcaaagcctgccaaaacctgcgatgccgctcccgatatgaaagtctcctcgatcaagagcgacaatctgatagtcacgattctggccacttcgaattgtgatgataagaacgcatccacgaaattcaatgattcggccacccgactcacgttgcaggacagcgacgataatgtcgtggccgatgccgtgttcgatttttcgggtctattccacgtataccgcgcagttgtccagcaagcgcaagggcatggaagctgaaggcaagacctggaactaggggctgcggacattttcttggagataatcacgcagccattccttggctttgacggtattgtaccgggctcatccaaccaagcgactgtttgatgcgctcgtggttgtaccagcgtatgtactcatctatacaggcggcggcaccgatgcctatcacatcaccgggaaacgatgacgacaccggggaaaaccatcagcccacactacggaaaaacactgccgaacctgtcgaacaaacattgaagcaaaacacgtttcctgctacgcggtcattttgacgcttacgctctaatgcctccaccgcttgtcgcgggcggggtagacgatccaggcggatgcgtagcttgcgataaggcagacaatgacgcagacgatgcttgtctggaacccgaatgagtcattgataacgccccagattacgcttgcgaagccaatgccgatgtcattggcgagcaggaacagggcgtttgcggcgccccagcgctctggcggggtgttctttaccgctacgctttgattaagtggcaggcttatgccagtggcgagaccatagaagattccgggcgccaggaagacaggttccccgtacggtgcggcaagtagcataaggcagcagaggatgccgcacgcgacggctccggtcattgttttgattgcaggtacggtgtccatgaaatgctttgaaatcatgcgaatgataatcatgcttaccgcgctgatggtgtagaagagaccggcgtgggtatagccgagagtagtaccgtacagaccggcaaagaagacgccaaagccaaaagtggggcacatgatcatctgtgggatggcgccaggcaatgcgcgcggctcgaagatgttgaatgagtcacgcagggttctcttggacacctggtcgccttcaggatacttttcactgttaattgtttcggatgtagttactgtggtggagctgggtgcctgcccgtcttttgagtcgagttcgagccgggtttccattttgattcggtatgcgctggagcttggcagagtttgccatttactttcatagcgtgcgttgagggcgattacaagccctgcaaacccaaccagggcaaggccgacatagaggttcgttgagggatcggttcctactaggtaaagtgcgaaggctgggccgatgctcatggcgatagcctgtccgaggccgtggtatccaatgccttcgccgagccgttcttgcggtaagacgcttgctgcggcggtcgaggctgctgttgttgctgcgccaaagcccacgccttgcagcaaacggctgattgtgaagagggggatgccttgaacgacagcggacagtgctgttcctgctatgaggatagcgatgccggcgatgataacgagtcagcacttgccgttgtcgataacagggccgacgaacagtcgtgctaacgcggcggcaatggagaagacgagtgcaagtacgccggcaaggctcgcaccgtaaccttggcctgccaggaagacgctggttccactgttgagtccttggcccatgacgaagcaacagaaggtcagcgcgatgataagcacgaaaataagcgaccacagcttcggatggtcgtccttaccgatatttggcatgagaaccctcctatgattccaatacccgtattctacgtctgcaaaaagtgagatgtaagcgccaaaatgaccgcgtcttaacaacccgctgggcttgaggcagaatcatcgcatcgacttatcctggaaactgcctgacgaaggcgacaggatgcttgtcagcaaggcggcaaatcttaacgagagccaaatccaagagcttgcaaatcttcagcgaggcgttgcagcaatatatcagaacgaatggaccgaacctgtcctctgtcacatcgaaccgcatgaacgcggcctagagtactcgccaacacagagcaagcacagcgcgaaggacaaggtttcttctgaagagcttcgctatctcaactcttgtgtgcttaatccgttcaagctcgatgagccaagggaatacaacttctgcgactgtgtgcacaagatggacatacctgactccatgaaggcacgcttgattgagatggcagggactcctctgtcctcgaggaagccactgtttgaatggtgtgcttataggtatttcaatattggacgcatcctcgacgacgccagggatttatctgccgacagcctcaaagagaggctttgctcccatctgctttcaagctggaaattcgaagatgattcctcacccgaaagctggggaccaatccaatacctgttcattcagtcgatgtttaacgctcatctcaacgagctgagaaagaggggtaccggcatcgagacaacggaaaaggcctcagcactcgccgaagtatcagcggtcttatctcaaacaaggccggtgatctaaatggcgtttgaaaatatagagcaattaatgccggatacggccgaaacgagattggccttcgaggaggcgcaacgcaccgttgctgattgtgcagatgccgcatggcgggatatttcttccggcgatgtcctaaccgcgagcatttcaacagttcaagaagccgcagatgacgcctggaaagcatgcgagccaacactcaacgctgcaggcgaaactgtccgcgatggcgcaaggaacggagcttatcttggcggcaggttcgtacttggagttgccgacgttggagaaaacgcatatgtcggtgttcaatcgaatattgaactactggccgaagacgaagaagcagcggtgaaaaccgcgcaaacacacgctgttgacgatgcagccaacgcctggggcgacttcatggaagccgatgagcagatacgggaaatcggagactatgtcgaaactggaggcgaaatcgccactgaagttgcgcttggtgccgtagccgtcaccgcttctgcccctgcagcactcgctgctggggctgtactcgttcttgacgaaatgggaaagagcttggaagccggcgctgaagacggtgagatatctcaggaggatatcgtcggagaagtcgttgcgggaactgttacggcagcaacgcttcttgccggacgaggtctaaataactttcttgcctcaaaggcagcagaatcgggcgcaagctcacgaattctggatgatgccggaaaggcaatttacgaaggcgaccgactgcttcccaataacgagtttgcgatcgacggcgtgaagtgtgcaaccgacgatctcgggcagctttaccgcgttggcgacgacctcgttccgaacatgagctatgagatcaatgggtataaatacgttaccgatgcaatgggtagggtcgaatcggccgaaggcttcttacaactaaagacccacgaaggtcgtttgaccatcaaggacactatccagtcaatcggaaaagggtttgaagagctttttgatcaaagaggccatctgattgccgaccgattcaatggatcaaatggccttgagaatattgtcgccatgggcggcgaggttaaccaaaagcctatgcagcaatcgagcaaaaatgcgccgatgctttggctgatggcgctgaagtgttcttcaaggttgagccactttatgagggcgggtcattcaggcctagctcgtttgctatcacggacattattgacggcgaagagacggttacgtttcttcttaacactgcaaaggaaatgtaatgagtgaaaagaagatgctacaagggatagcttcaattcttgaggaaaccctccccgaagactggagcaaggtcgtgttttacgccgagtacgccgagggtgcgttctctattgagtattacgttgctggcagcggaaaagacgacttcgttaaatgctttgaccaaaaaggcgtttcgagggcatccttgatgaaaaactttatggctatcaacaagttcattgaacctgaaagggccgcgcttaagcccgaaaagagatggggatcgatgacgcttattctccattccaacggcaagttcaaagttgattacgactactccgacatgacagaaaacgcttacgcccgaaagaaggcctggaaaaagaaatatctcgcctagcaacgaacggtctgggaaatcaccgcaaagccacccgtgcatactcttcgagcgcacgcgtcgtcggcaacgtttcgaccagcgcgtttttgggagccatgcaaacccctgttcaacattcctcgggagtgattgctctctatgacgaatgggattccccatcggggaatcccattttttgttgccgacgacgtccggtataatttttccgtttacgacgtcgttcggaaagggatgccgacctctatgcgccagggattcgacaacgaaaaatacatcgagctgcaagccgccaacatcagaaagcgcatcgcgcaattcggcggcaaactctatctggaattcggaggcaagctcttcgacgactaccacgcctcgcgcgtgctgcccggctttgagccggacaccaagttccgcatgttggaaagtctggtggacgatgtggaaatcgtcatcgccatcaacgccaaccatatcgaaaaaggcaagacccgcggcgatctcggcatcccgtatgacgaagacgtgctgcgactcatcgacgtgttccgttcccgcggcttcctcgtcggctccgtagtgctcacccaatacgccaatcagcccgccgccgacgcctaccgccaccgcctcgagcaactcggcgtcacctgccgcctgcactacccgatcgccggatacccgcacgacatcgaacgcatcgtttcagacgacggatacggcaagaacgagtacatcgagaccacccggccgctcgtcgtggtcaccgcgcccggccccggctccggcaaactcgccacctgcctgagccagctctaccacgagcaccagcgcggcatcgacgccggctacgccaaatacgagacgttccccatctggaatcttccgctgaaccatcccgtgaacatcgcgtacgaggctgccaccgtcgacctcgacgatgccaatatcatcgaccccttccatctggaggcgtacggcgagaccaccgtcaactacaaccgcgacgtcgaagcattccccgtgctcaaagccatgatggagcgcatcatgggcgaaagcccctatcagagccccaccgatatgggcgtcaacatggccggatacgccattgtggacgacgatgcctgccgcgatgccgcgcgtctggaaatcgtgcgccgctacttcgccgccgccgtgcacttgaagcgcaccggcactggcgaggaacaggtggagcggctgcgctccatcatgaaccgggccggcgtgacccccgatctttctcccgcccgcgccgtggcccttgagaaggaagccgccaccggtgccccggctggtgccatggtgctgcccgatggccatgtggtcaccggcaaaaccggcgacctgttgggcgcggccagcgcgctgctgatgcacgcgctcaaggccgtcaccggtgttgacgaaaccattccggtaatcgacgatgccgccatcgaacccatctgtcggctgaaaaccgaacatctcaacagcgtgaaccgacgcttgcactcggatgagacgctgattgcattgtcaatcaccagcgccaccagtcctgtggccgctcgcgtcatcgacgggctcaaacagttgcggggctgcgacgccttcttctccgttatcatctcatccacggacgaggcgctgtatcgcaaactcggcatcaacgtgtgctgcgaaccgaagtacgaacgggtgagtctgtatcaccggtaagcgccaccgataagcgcggtatgccgtgaatcgtcaagccggtaatcatgcagcatgcggcctgacgattcgctgctgtcgcattgtctctcccctcggccatgctgggcttgttttccgtttgttggagagaacgggaaatgccatcagcactacggaaagagaaggattatccgtgaagcggttcgtgggtttagacggtattaaaggactagcgctgatagccattgtgctgtaccactgcatgcagcaacggctgccaggcggattctacggagtcgacgtgttcttcaccgtctctggattcctgattgccgtcagtttgattcgttctctggcgaaaaccggatcgctgaatctcgtgcgatatattcccaagcgtgcagtgcgtctctatccggcgctgtttctgctgattccggtcatcgtctccgtcggctggctgttcgatcacgacattctagtttccatccgcgaccaagtcatcaccgtgctgctgggctgctacaactggtacgccattgccggaggccaaagctatttcgaccaaatgaacccgcaggtgtttcgccatctgtggttcattggcgtgctcatgcagttctacgtcatcgtgccgttcatcgtctggctgatgtggaagctccgccagacgaaactgccttcactcatcccactgggactcgcggcgttcagcagtatcgccatgtgggtgatgtatgtgcccaaaggcgaccccacccgcgtctacttcggcaccgatacccacagcatgggcctgatgctgggtgtggctctcgcctggtgggtcaccgctcctcagttgggccacgctcgccagagggctgtgccgatgccccgcaccattagctcgagcgcttcggcagccgcacatcgggctccgttacctcagattcccgtggagcatcgcatctggaatgcggcggcaccggtattggcgttcctcagcctgattgccttggtcaccatggcggttatcggcaaacaggatgcattcgccttccgcggtggcatcatattgtccagcttgttgtccgtgctgctgattgccggtaccatctccgacgattcctggatgcaaagcctcatggtgttcaagccattggcctccctcggcaagtattcgtacggcatctacctgtggcactggccgttgtggattctttccagcgcccttgccccgaagatcttcaaggcagtagggccttggcctctcatcatgaccgcgttgctcaccgccattgcggtgatgatttcctggctgatggtggagaaaccggcggcaacgcactcggcggtatccgtcgtggtgccccttcgcacgaacaagaagaatcatgtggcccgggttattgccgttgacgttatcctggtgctgtcgttggtcggctgcgtgcagggcattgctcatgcacctgcgaaaaccgccatgcagatccagctggagcaacaggccgcacaactggaacgtatgcagaaaaccgaacacgtgctgctgcgccatgccgtgccggcaccgcccaagcccaagcatgagatgcccaccggcgatcagattaccgccataggcgattcggtgatgctggcctcatcacagggcctttcggaagtcttccccggcattcagaccgacgcgagcgtttcccgctccatcatggtcgcccccgaactcatcggcaacgctctgtccgccggcagtctgcggcagtgggtgttgatcggccttggcaccaattcggcaatcacccccgatcagttggaccagattcgtaatatgatcggccccgaccgcgtgctggtactggtcaatgcccacggagaccgtacgtggattccacctaccaaccaggtgcttgccgactatgcggccgcacatccggacaatgtggtgctggtggattgggatgccacagccaacgcgaacgcgcaggtgctcggctccgacggcatccacccgagcatggatagcgatatctatgcaaaggcggtcagacagaccatcgaacaatggatcgcaagcggcaggtgaacggcaggcaacgctgagttgtccaaccggtcgtgaagaacggctatgctgaagactgcatcaacgagaccacacgttgggagacatggtgagcgcaatccttgaaggaaagcccgataagaatcttattctcgttacgggaaggattcatccgaagttggctgaggatgtcgccgagcagctcggcatcgacgtccttgaaaccaccgcatacgatttcgccaacggcgagatgtacgtgcgctacactgaatcggtgcgtggcgccgatgtgttcgtgctgcaaagccactacaagcccatcaacaaggcgatcatggagcagctcatcatgatcgacgcattgaagcgcgcctcggcccgttccattactgcggtctgcccgttgctcggctactcccgtcaggacaagaagcaccgcggccgcgagcccatctcctgccgtctggtgttcgacctgctgaagaccgccggtgccgaccgcatcatgtcggtcgatctgcatgccgcgcagtcccaaggcttcttcgacggcccggtcgatcatctggtggccatgccagtgctggtcgactacatccgtgatcgtttccagggccatctcgacaacgtcgccgtcgtctcccccgacgccggccgcattcgcgtggccgagcagtgggcgcagcgtctcggcggcggtccgctcgctttcgtgcacaagacgcgcgacatcacccgcccgaaccaggcggtcgccaaccgtgtggtcggcgacgttgccggcaaggactgcgtgcttgtcgatgacctgatcgacaccgccggtaccatcgcgggcgcatgccacgtgctgcaggacgcgggagccaagtcggtgaccgtggtcgccacgcatggcgtgctctccggcccggccgtcgagcgactcaagaactgcggtgcgcgcgaggtcgtgctgaccgacaccgtgccgattcccgaggaaaagcgctgggatggcttgaccgtcctgtcgatcgccccgctgctggccagcgccatccgcgccgtattcgaggacggctcggtcgccgaactgttcgacacctaccccgagcaccacggtcaaggcttcctgttcgcctgatcacgtgcgtgtttgttcgtggaaagcacacgatgcgagacgcgacatggcgtagtctttcggtaaataccgacaatatggtataaatgaacacttgtgggccgaaagcccacgactcccccatggtgtaatggcagcacacgggtctttggaaccctttgtcttggttcgagtccaggtgggggaacggctgacggccgctcgacatccgggcggccgtctattgttttgaggtgtttccaccctcaatagacattccgatcgaagggaatacgtcagttatggcattatccgcagccatcgtcctcgcagccggcgagggtacccgcatgcgttccaacaagccgaaggtgctgcatgcttttgcaggcaagaccttcctgaacagggtcatggattcggtggccgccctgaatcccgacacgctggccgtggtcgtgcacttccaggccgagcgcgtcgccgaagccgcccgctcctatgacgagcaggtcaccattgtgaaccaggacgacattcccggtaccggccgcgccgtgcagtgcgcaatggcgcagctcaccgaggctggcaaggtcgatggcccggtgctgatcgccgcctccgacatgccgctgctcgacagcgagacgctgcaccgtctggtcgaattccacaccgcctccggcaacggcgccactgtgctcaccaccatcctcgatgacccgaccggctacggccgcatcatccgcgatcgcgaaggcaacgtgctgcgcatcgtcgagcagaaagacgccaaccgcagcgaactcgccgtgcaggaagtgaacacctcagtctacgtgttcgaggcttccgtgcttaccgaggcaatcgccggactgaagtcgaacaacgcgcagggtgagttctatctgaccgacgcgctggaaaccgccaaggccgctggcaaggtcggcgcgttcgccgctccggatccgctcaccgtcgaaggcgtgaacgaccgcgtgcagctggccgcgctgtccaagacctacaaccgccgcgtctgcgagcgctggatgcgcgacggcgtgaccattcttgacccggaaaccacctggatcgaggacgatgtccaaatcggccgcgacgccaccatcctgcccggctccttcctgcaaggccacacggtggtcggcgaggacgccatcgtcggcccgtacaccaccctgatcgacgcaaccgtggacgaaggtgccgtggtcgagcgttcccgcgtacaggaatcgcacatcggcgcacgcacgaacatcggcccgtggacctacctgcgcccgggcaacgagttcggcgaggatgccaaggccggcgcgttcgtcgaaatgaagaaggcgcacatcggcaacggcaccaaggtgccgcacctgagctacgtgggcgacgcccagcttggcgaccacaccaacatcggcggcggcaccattaccgccaactatgacggcgtgcacaagaaccgcaccaccatcggctccggctgccacgtgggtgccggcaacctgttcgtggccccggttgaagtgggcgacaacgtgaccaccggcgccggttccgtggtgcgccacgccgtgccgagcgacacgatggtctactccgagaatacgcaacacaacgtcgagggctggaagcccgcctgggagcgctgaaccatgcccgcacttcaggattccatcaacgccgtccgtgtggccgccgaggccgcggaccgtatcaaagccaccgacatcgtggccttcgacgtagccgacctgctcggcatcaccgacatcatgatgatcgccggcgcctccaacgagcgtcaggtactggccgtggccgaggaaatcgaaaaggacctgttccttaagtgctccggccgtcagccgcgctctcgcgagggcctgaccgagggccagtgggtgctgcttgactacggtgatttcgtgattcatgtcatgcacgaggaatcgcgcgaattctacgggctcgaacgactctggcgcgactgcccggccatcgatcttgaactcgcacacccggaaacggcggagcatgcggaagatgctgccgtcaccaccgcgtaacgtgcgaatcacataacgctgatattcgcgtgtcgggctgcctgttgccaaacatcattgacggcatcaggcagccctccccttttttcctgtttcctcactggaaccgaaaggatcgtcactatgaccaatcatgttcgttccgttttccttatccgtcatggacgcacctcctacaacgccgctcacaagctccaaggccaggtcgacattccgctggacgccgtgggtgaatggcaggtcaagcagaccgccgcggccttgaaaaggctgtacgtcgatcgtcggcaggaaatcaaccaccggttcattgtctgctccgatttgaagcgtgcgcacgccaccgcgcaagctttcgccgacgtattgggtggaatcgagcccgtcgatgatcgtcgcgtccgtgaacgcagcttcggtgattgggatggccatgccgtggccgaactggccgaacgctaccccgaggacttccgttcctggatggagtctcggggcggcgagctgaagtatggtgccgagcccaaggaagctgtgggcaagcgcggcgtagaggctcttgaggactggtccacgcgtgccggagacgacacggacctgttcgtgttctcgcacggcgcatggattgcgcagacattgcagaccctgttgggcatttctgcaatcgatccgaccttttctacggtggtttcattgcgtaatgcgcactgggtgcgcttggtgccgatggacaatcccgatggcactgtgcgctggcgtctgctggactacaatcacggtccggccatcgccgacaccgacgagtgggaacgcgaacgctgatcgtgtcacggctcccctgctgagccaacaggttcagtgtattcgaaaaaccgttcaagcagtaattgaataacccaatgcctgaataatggcggaaacaagccaaaaagtgtcgccaaatcccacttttgccatttggcgacacgccggcttttgccagaatcgacatctcgtcgtaatgtatacgaggtccaaacaacgggccaacaattgaaaacggggctatagcgcagctggtagcgcatctccatggcatggagagggtcgggggttcgaatccccctagctccacgacgaagccatcaaatcaggcgatatggtggtttctccgctggttcatggcgggtcttgcgactcccatgaatcggatagcttcactcggggctatagcgcagctggtagcgcatctccatggcatggagagggtcgggggttcgaatccccctagctccacaatcaaggccggtgcttcatgcaccggcctttctcgttttctggcctatcggccgacttttgcgcaacattccccggaaagcgtcgccagggggacgctcttccgattggcgcgacaccgacgtgagcgataacagtaatcgccactacaatgaggtgtggtccctatcgtgttgattatcaaaggagacaaaaacatcgtgaccgtcacccgtgtatatatcgccagccctgaaggcgccaatggccgcaacgtcgtcgcttacggcatgctcaacgcattgacttccaagtacaagaccatggtgttccgccctgctgtgtccaaccatgacgaattcaccccgatcctgctcgccgcctccaatgccggactcggcgtggccctgtccaccggcctcgatgtgcacaaggtgcgcgaggataaggacaccgcccgtggcgatatcgtcggcgcgttcaacgatgccatggacgtttcccgcgcggacgccgccctgatcgtgggcaccgacaagtcccacgtcaacgatccgaccaactatgaattcgacgcgaatgtcgccgctgatctgaaggccggcgtgttcctagccgtgtgcaccatcgaccgttggccgcacgagctcgacgagaccgtcaagctgtccatcgagggcatggaggccgctggcaacaaggtgctcggcatcttcgtgaccggatgcgagccgcgccacgctttctccgttaaggagaccctcgccaagtacggcctgccggtctggactctgccgcaggtgccgttcaccgatgaatccaccaaggatctggcgctggagaccttccgtaagaacgctcccaccgatgaagtgctcgccgcgctcgatgtggacgtcaccgcgcccatcaccccgtacgccttccagttcggcctgctcggcaaggccaagagcaacaagaagaccatcgtgctgcccgaaggcgaggaggaccgcatcatcaaggcggccgactacctgcttgagcgcgagatcgtgaacctcatcatcgtgggcaacaaggacgccattctggctcgcggcaaggaactgggcctgaactacttggagcgcgcccgcttccaggctatggacgacgagaacgtgctgaagcccatggtcgccaagctgtgcgagttgcgtgccaagaagggcatgaccgaggagcaggcccgcaagcagctggccgacgccagctacttcggcaccatgctcgtggtgctcggctacgccgacggcctggtctccggctccgtgaactccaccgccaataccgtgcgcccggccctgcaggtcatcaagaccaagcccggccagaagctggtctccggcgcattcctcatgtgcttcaaggaccatgtggccgtgttctccgactgcgccatcaacctcaacccggatgccgagcagctttccgaaatcgcgttgcagtccgccgagaccgcacgtgccttcggcatcgacccgaaggtcggtatgctctcctactccaccctcggctccggcaagggaccggacgtggacatggtcgaggaagccaccaagctgctcaaggagaaggctccggatctgccggtggtcggttccatccagttcgacgccgcctggtcccccaccgtggccgccaccaaggccaagggcaacgatgtggccggacacgtcaacgtgttcgtcttcccggacctgtgcgccggcaacatcggctacaaagccgtgcagcgctcctccggcgccttggccatcggcccggtgctgcagggtctcaacaagccggtaaacgacctgtcccgtggtgctctggtgcaggacatcatcaacaccatcgccctcaccgccatcgaagcgcagtgagcccggcttagctcccggtggctcccgccagcgggagccaccgtaatgcttattttgtagcaagcaacgagtaatctaatcaacggtaacccgtgtctcacgggaacattcaatcacaatggaggatgcccacaatggcgaaaaccgtccttgtcatcaattccggctccagctcgatcaagtaccagctggttgatctcgaatccggcgaaggcctcgcttccggcctcgtcgagaagatcggtgagccggtcgacggccactacaagcacgagtacaacggcgaaaagcacgagcttgaagagccgattcacgaccacgagcagggtctgaagcgcgtgctcggcttcttcgaggagtacggcccgaacctgtctgaggctggcattgtcgccgtcggccaccgtgtggtgcagggtggctccatcttcccgaagccggccctcgtgaccaacaagaccatcaaccaggtcaaggatctggctgtgctcgccccgctgcacaacggcccggaggccaagggcgccgaagtcatgcgctccctgctgccggacgttccgcagatcttcgtcttcgattcctccttcttcttccagctgccgaaggccgccagcacctacgcgctgaacaaggaaatcgccgatcagtaccacatccgccgctacggcgcccacggcacctcccacgagtacatctcctccgtggtgccggacgtcgtcggcaagccggctgaaggcctgaagcagatcgttttgcacatcggcaacggcgcttccgcttccgctgaggtctccggcaagccggttgagacctccatgggtctgaccccgcttgagggcctgatgatgggtggccgtaccggtgacatcgacccggctgtggtcttccacctgattcgcaacgcccacatgaacgtggacgagcttgacgccctgttcaacaagcgttccggcatgatgggcatgaccggctatggcgatttgcgtgaggttcaccgtctggtgtccgagggcaatgaggacgccaagctggctctggatgtctacgtgcaccgcatcgtcagctacatcggcaactacacctaccagatgggtggctgcgacgtgatcaccttcaccgccggcgtgggcgagaacgacgacgtggtccgcaagatggtgtgcgacaagctcgctccgttcggcgtcaagctggacgaggagaagaacgccacccgctccaaggaaccgcgcatcatctccactccggactcctccgtgatcatcgccgtgattccgacgaacgaagagctggccatcgcccgcaagtccgccgcaatcgccgaagccggcaccgacacctacggcaacaccttcgccaagtaagtaaccgccgttaggcatctcaccaatctctagttgcaacactatgggggctgattccgattggaatcagcccccattcgtatatggtcatgagaccactacccccgcgtcatactctcctcagtcgcctccggtggacagctcccctcagagaggggagttgtccgcgtagcggactgaggggagttccaccagaacacaggaccccttactgcctcagcatgccgctccacataccgacgaagtcaggcaaggtcttgcgcgtggtggacacgttgatgacctcgatatcgggaatacgcagccccagcatcgcggcgaacgtggccatacggtgatcagcataggtttccatcacagcaccgtgcaacgtctccgccggcaccggttcgatacgcaatccaacaggcaattcctcagccgctcccccaacacgacgaatctcgttgaccaatgcctccagacgattcgtttcgtggccgcgcaagtgaccaataccaaccatgtctgtcgacttatcagcaaacaccagaatcgccgccaacgagggcgcaatctccccggccgccgtcaaatcgaacgtacccagcccacgcacggtgccgtcaccggtcacttcgcaatagcgcacgccatcgattgtcgggaacgatactttggcacccatctgttccagatagcccggcaacaaaccacccggctgggtggtggtctcaggccaatgaggcacccggaccgtgccgccggcgatcaatgccgcgccgaggaatggcgccgcgttcgacaggtcgggctcaacggtcaccttgctcggcagttgcattgcgcgcggttcaaccgtccatgtgcgggcggattcgtcggcctcaaccgcaccgccggcaccggtcacatcagccacagtcatgcgaatgtgcggcaggctcggggtcttctcccccgtgtgcgcgaggtgcagaccgccaggcagtttggaactaatcagcaacaggccggagatgaactgggaagaaccggacgaatcgatgctgacctgcgcctgggcagccggcaaggttgcaggcggcgtaatagtgaacggcagacggccaacctcgccgtggtaatcaaccgttgcacccagctgttccaaaccgtcaagcaccggcttcatcggacgtgcataagcctgttcgtcgccatcaaaattcactgggccatctgcaaacagggcaaggccgggcacgaaacgcatcaccgtgccggccagtccgcagaacacattgacgttgccatggaatcggccggatacaggaggagtaaccgttacggtggtgtcggttgcggaatccacgtcgcagcggacaccgagggcttcgagtgcgcccatcataaggtccgtgtcgcgcgaacgcagcaggccaatcagagtaacgggcttgctgccgagggcggcgagaatcaggtagcggttggatagggacttgctgcccggcaccgttaccgtagcgttcaacggctgtgcggcgagcggggcaggccagagattcgtgagtcgttcagtcataaggccaaatctatcaaacaaattattcaccggtcggcagcgatgcgggattcgatctgctgatcaggtgcggaagacggctgctcaaaaccgccttcgatggcctgcgcgtgcaacaactgagcggccgcgcgatcggcctcgatggcggcgatctggcgcgagaacacgatgaaccagccgaggaacgccagaccagccaacgcctccacattggtgagggtgttgtgacccatcatcatattgacccagaatgcagcgcatacgagcgcggtcaggtcggaggccaccatcactgctttggacaggcgtggcgcaagccacggcaggagcacgaacagcagcagcatgacgaacggcaggcctttggcgcatatattgtgcaagagattgtgcggcgtgtaccgaaacacgccgatgccgatgaatgccaggccggccaccatcagcaggaaggacagaatggagatgcgcagcatgaaatgtgggatttcgtagccgcgattcggatctctgttggtgcggtcgtgccagaggcgctgtagccgttcggtggtcaccagttcggagatggcgaagtagctgacgatgatgatgcatgtgccggcaagaatcagcgtggagttgaacatacgggccgcaaacgtggttctgtcgccgagctgcgaaaagttgttgtgataccagtatgggtcgtcggtggtcatgccggcggtgaccacgccggagatgacgaagaacggcaacagactggcaatagttttggcgttcatcatctccgcctgtacaaaggtcatgtaccccaccacgccggcgaaggcggcgcagacgctggagatatagccggagaagatggcattgcccatcatgtcgttggccgcaccgatgagtgcaaaagacgacaggaaaatggtcgaggcatacaccaccgaaagggcgacgatttcgaaaatgcgacgaatcggtgcaaaccaaccatgtttgaggttcaatgaacgtgatttgcgcgcatagccaataatgaaggaaatgacgccgcatgccgccacgatgcccgaacataccatgaatcggcgttgcgtcagctgccagatggccggcgcgtattccatgtacaggttcatcgataccgcgccaacgacggcgcaaatcaagaaggagatgagtccggaggtttctgcacgctgatgacgtcccatgccgggcctcccctatctattcgatgccgcgttatctttcaacaacaaacaaaactccccccgaggacaacgctttactagcaagccagcgggatttggctgtcgccattctactgaaaatctgaaacactacaaaaaaacgattatgtacgggcttcttagcctttgcgactatcgttaccgccttgccgagtaccgttgttcatgcagaaagaaagcagtattggacacaatcgaatgagcgtgtcagtatcgttgaaaaagtaatgaatgacggttctatcggttcaacctttaagggacgaaccagccgcggtaccatggcgctgatgcatgactatgccgagctcatcaatgaattacgtccgacagcagagcaattcaccgagatcgagcaatactgggtcaaacgaattcaagcgttcttcaccagcaaaccattcaagctggagtccgacaactcgctttccgttgatgcggccgtggaacatctgctgcggcaggcagcgcagcggcgaagggagaatccgggcaccatgtacgtcggcaccgtcctgcagcatctcgtcgcggcaaagctcaccatcgttgctccggaagtggaaatcaacggcgcgtccgttgctgatgatccgagtccgcggcttccaacggtgaggccgcggaccgtctcacaaaaccgtccgcggctccgccctcctgtttcgtcgcaactgactacaccgacgggttcgggcgcttcgtcacgaaaacgccattgcgatgcaccgtatacgcgccgccgtcactgccccgttccgcccggaacaggacgatcggctcccctgcgatgtcgcgcagttcgacatccgatctgccacgtgtcagatagaagtcgaatatggcgtcgtcggattgacgcacggtgtgcagaacgtcagaggtcacgccgctggcgggcgaccgcaggttggcttccggctgccggccatcctgcggctgcgcggcaagccaacctcccacgaatcgcgtcagatcgctcacgcccagatcgcagccgaggaaatacgcctccccttcgccgtacgtgttgcgggtgatcgcggccatgccgtcaagctcccactcatccgcttcttcgccggcatacgaggcaagcacctgcacatgcggtccggcgacggtcacgtcaccgagcttgtcgatgacgcgatcgagccagtcgaaatcccaatggtcttcgatgggctggaggcgatctcagctgaagatggcaagggccacggtgttgacgccggcctggcccatcaggcggatgtcgtcatcccagatttcctccggccattggtcgggactatagtcgccaccgaaagcgatgccgcgtccgtccgcggtcagcagttttggccatgcgaagtcacgtcatgcacgcacggttatctcctttggcaggcggcgcagggccacggcccatatcggataccagctgatactagctgatagacactcctggccgatagtcgacacgccgccggttccggccccactgccggaaccgacatgggtatgttcatgaccgccgaccgcaggaacgaacaggcccgtccgccacggaccgcatcttgcggttcaggcggacgggccttatgggaagggatgggaacgggagatcagttcttaataactgcctgcgcctcatcgtcgacgatctcgccggaagcgagcttggcttcgagctcctcaacgatctgcgcatgcatcttctcatcgatcttgaccttgaaccagaacacgacgaggctgaggatgatgaaaacaagcgggacgtagaaggcgaaggtcttgaacgtggcgatgttggacgcggtcatgtcggctgccgtggcatgaccggtcatgccagccgcgagggcaacggcaccgaccgcaccgttggacatcgcgccgccgatcttgtcgagcatgggacgcaccgacaaggtgaccgcctcgttgcgcttgccgttcttcagctggccgtactcgatggagtcggtcagcgacagaatcgcggtcatctggatgaactgcgcaggcacatagaagaagatcagggcgacgatgacgaccggcaggttgctggagaacagggcgagcatcgtgtagccgatgatcatggagaccatgccgccggtgaacaggtagcgacggggaatccagcggttgagaatcgggtacagcggcgccatgatgaatccggcgatcagcggaatgatgccggtgatggagaaggcggcaggctcgtcaagcacgaacacgaagaggtagtacatcacaccggtcgtgatgacgtttgcgatggcgtacagcaggtaggacagggcgacccacagcagctggtcgttctggaacagcgccttgaacgcctcgaacgggttgccgttcttctgggccttggcacgcagcgcgctggtgctttccttggtgccaaaggcgacggtccaggcggtaatcaggccgaggagcgcgacgatgaagccgaaggaggtccatccggcctggccctggcccttggcgccggtgaacgtccaggtgaagtagctgacgatcgggatgacgatgacggtgatgccgttgtagccgatagagccggtgaaggtgccaagggcggtgtaggtggaacgttcgtgggagtcggaggacaacgccgggatcatgccccagtaggagatgtcacgcagggagtagaacacgtcaagcacgatgaacgtgatgatgaacagcacgatgaacagcgtggtgttcacgttgaccagtccgaacatgccggagaagatgagcatgatcaacacggaggagaccagtccgccgatgaactgccacgggcggaaacggccccacttggtggtggtgttatccacgaggttgcccagcagcggatcgatgaagatctcggcgatgcggataacgacgatcaggccggtgatgacggcgatcatttgggcggctagagccttgctgtagctgacgaacaggcagctggtgacgtacgtgacgaagtacgtgctcatcgcgttgtagaaggcagcctgccccaagttgccgcacgcgtaggcgatgcgctggcctaacccgcccttcctgcggacgtcaccgtccgcgacattttcgttgctcattaatcttctccttaagaacccagagcatggaatcactcattgattttgtaaagtatagcatactagttttatcaccgtaagcatacaagttttatcaccgtaagcatacaagttttatcactgaaagtaaaaagcattagtaaacaaggagataaacagcgtgtcgcaaggatgggataacatgagctgaaccgagacattgcatggacgcggcgtagcgtcgacggcaagcagtgccagtgatttggaagcggtaaacaggatttgcgttttatataaaaactgtttatccttttcggtaaaggaggccccggcctcttccataatatcattcacaacgaggtaatgacagaaagcaggagagcatgacagacgtcacacatgtcgatcgcgcatcgcaggcttggctgaccgacccgacggtgttcgaggtgaaccggactccggcccattccagccacaagtggtacgcccgcgacccccagagcggacaatggtccgatctcaagcagagccttgacggcgagtggcgggtcgaggtcgttcaggccgccgacatcaacctcgaagaggaacccgcgacggccgagtcgttcgacgactcctcgttcgagcgtatccaggttccgggccacctgcagacggccggtctgatgaaccacaagtacgtgaacgtccagtatccgtgggacggccacgagaacccgttggaaccgaacatcccggagaacaatcacgtcgcgctctaccgcaggaagttcaccgtctccgcccccgtggcaaacgccaagcaggccggcggatcggtgtcgatcgtgttccacggcatggccacggcgatctacgtgtgggtcaacggcgcgttcgtcggctatggcgaggacggcttcacgcccaatgagttcgacatcaccgaactgctgcacgacggggagaacgtcgtggccgtcgcctgctacgaatactccagcgcctcctggcttgaggatcaggacttctggcgtctgcacggcctgttccgctccgtcgaactcgccgcccgcccgcatgtgcacatcgagaacacgcagatcgaagccgattgggatcccgaggccggcaccgcctccctcgatgccgcgctgaccgtgctcaacgcggccgacgcggccacggtccgcgcgaccctgaaggacgccgacggcaacacggtgtggcagacgacgggcgacgcggaggcgcagaccgcgatctccagcgggccgctgcagggcatcgccccttggagcgccgaaagcccgacgctgtacgagcttgacgtcgacgtcatcgaccaggcgggcgacgtcatcgaatgcacgtcccagaaggtcggtttccgccgcttccgcatcgaggacggcatcctgaccatcaacggcaagcgcatcgtgttcaagggcgccgaccgccacgagttcgacgccgaacggggccgcgccatcaccgagcaggacatgatcgatgacgtggtcttctgcaagcgccacaacatcaactccatccgcacctcgcactacccgaaccaggaacgctggtacgaactgtgcgacgagtacggcatctacctgatcgacgaagccaacctcgaagcccacggcagctggtccctgcccggagacgtcctcaccgaggacaccatcgtgccgggtagcaagcgcgaatgggaaggcgcctgcgtcgaccgcgtcaacagcatgatgcgtcgcgactacaaccacccgagcgtgctgatctggtcactgggcaacgaatcctacgtgggcgacgtgttccgcgccatgtacaagcacgtgcacgacatcgacccgaaccgtccggtgcactacgagggcgtgacccacaaccgtgactacgatgacgtcaccgacatcgagacccgtatgtactcgcatgccgacgagatcgagaagtacctgaaggacgacccgaagaagccgtacctctcctgcgaatacatgcacgccatgggcaactccgtgggcaacatggacgaatacacggcgctcgaacgctacccgaagtatcagggcggcttcatctgggacttcatcgaccaggccatctacgccacccagcccgacggcaccaggagcctgcgctacggcggagacttcggcgaccgtccgtccgactacgagttctccggcgacggcctgctgttcgccgaccgcaagccttcccccaaggcccaggaagtcaagcagctgtactcgaacgtccacatcgacgtgacgaaggactcggtgtccgtcaagaacgacaacctgttcaccgccaccggcgactacgtgttcgtcctgagcgttctcgccgacggcaagccggtctggcagtccacccggcgtttcgacgtgcccgccggtgagacccgcacgttcgatgtcgcatggccggtggcggcgtaccgcgccgacgcccgcgaactggtgctgcaggtttcgcagcgtctcgccaaggcaaccgattgggccgaaagcggctacgagctcgccttcggacaggccgtggtgcccgcggacgcgatcgcgacgcccgacacgaagccggccgatgggaccatcaccgtgggccgttggaacgccggcgtgcgaggcgccggacgcgaggtcctgctttcgcgcacccagggcggcatggtctcctacaccttcgccggcaacgagttcgtgctgcgccgtcccgcaatcaccaccttccgtccgctgaccgacaacgatcgcggtgccggtcatggcttcgagcgcgtccagtggctgggcgccggccgctacgcccgctgcgtggacaacgtgctcgagcagatcgacgacagcacgctcaagggcacgtacacgtatgagctcgccaccgcgcagcgcaccaaggtgaccgtctcctacacggcccacaccgatggccgcgtgaacctgcacgtcgaataccctggagagcagggtgacctgcccaccatcccggcgttcggcatcgaatggacgctgcctgtgcagtacacgaacctgaggttcttcggcaccggcccggaggagacgtacctggaccgcaaacacgccaagctcggcgtgtggagcaccaacgctttcgcggatcatgcgccgtacctcatgccgcaggagacgggcaaccatgaggatgtgcgttgggccgagattaccgacgatcacggccacggcatgcgcgtcagccgcgccgatggtgccgcgccgttcgcggtaagcctgttgccgtactccagcttcatgcttgaggaggctcagcaccaggacgagctgccgaagccgaagcacatgttcctgcgcgtccttgccgcacagatgggcgttggcggcgatgattcctggatgtcgccggtgcacccccagtaccatatcccggcggacaagccgatcagcctcgatgtcgacctcgagctgatctgatcagaattgatccgatagtccaccgtgcaaacgatgtggcccccgacttcctcgcaggaagtcgggggccacatcgtttgcacggtccttgttagtccagcggatgcgccggatatcgatgcagatccaaacctagtcgttgtagagcatcaatgaataaagatgtcactcataagctatcaagagaatccagaaccttttttgaattcatatgctcgacacgcaatgtatccagcgtcgtttataatgattcattgtgccttaatgacgcatcgggctatagcgcagtttggtagcgcgcctgctttgggagcaggatgtcgccggttcaaatccggctagcccgaccaaaaaccccggaatctcaacgattccggggtttttccttttatccagttcaaaccgatttatccgattttatccgatgaccgcagaacctacgccgcctcgtccagttcctccgccctggcacggcccacagcatcggccacctcatccagcttctccggccacaaccgcgcatacgtgtcaagcgtgaccatagcgctcgaatgccccaactgggactgcaacgtcttcacgtcgcagccgttggcaatcgcgatgctcgcatacgtgtggcgcaggtcgtggatgcgcacgccggaatcctccatacccgcacgcctgacggccggactccaaatgcgcgacctccacgtgttgacccacagattgccgccacggaccgcacggaacacataatcatcaggatcacgcccatcgcactgacgttccaaaccagccacaagaaattcagggaacgccacccaacgcgccttcccgtttttcggggaaccgagaatcatcttcccgtccttatcctccgcccaggtgcggcggatgcgcgatcgccgacggggaaagtccatgtccttgacctgcagagcgaaggtctcgccgatgcgcggcccgacgtaggcctgccatcgaacgatgagcgtgtcctgcgggtcgttctttactctgccggcctcgatggccagatcctccacctcggaaatcgagagaaataccatgtcgtcgtcatcgtcgacgacgcgcggagtggcgacggactgcatgggattcgcggtgatatatccctgtttcagagcatggccgagcacaccgcccatgaccacgcgcacgatgttgcggatcgaccgtggcttcaacgcgcgagtgttttccgttccgcgttttctgtcggccggatagccgccctccgacagttggttcacccatttctgtatcgcttccgtcttgatgtcccctatgggggtgtcgccccattgggggttgatgtagattctaagttctcgcttgtagcggcgcagggtgccgggtttgatgtcggctttcgttgccgtccactcctcggcgacccgacggaatggcttctgcgcgagcttggggtcgtggtagcggccgcgcctgatgtcgtcctccatggcggctttgaactcctccgcgtccgacaggagccggaacgttttggacttctcggtcttcacgccctgtgcctcggcgtaccagcggcatcgccagcggtcgtactttccgtaggtgctgctgcggtgttcggcgggcaccttggccttcatggggtctttggcgttggcgagactgcgcttcatcgcagcagtcggcggattgccgttctcgtcgtttttgagccaacggtcaacgatgaacactcgtgccataggtatgctccatcttcatctcacgtgctcatagagcagcgccctgtagtcttcgatgatttggacggttatggtgagtacaatggtttgtgtggattgggagtacccggtcggcgaaggtttcggaagtgattccggagcctttcgttttactccggccattccggccagaatccgaccggccctgttgacgttggcgcgttagcagggcttttctttactgcttggcggttttgacggtgatggtggtgccgagcgcggtggtctcccagctcacgccgtcggcttcgctgtaggtgaagtccttggtggcgtcctgcgaggcgagcagggattgagccatggtttcggtgtcgccctggctggtccacttccagtcgccggccttggtcggggcctgataggtgcccttccaatagaggctcttggtgtcggtgccgatccagttgacctcgatggtgtcgccgctgatggtggcctccatgtacgagttcgggtcgttggagttggtttgcttccacgtgccggtcaggtcgtccagctggggtttgggctcttccttattggtctcggtctttgacgtgccatcggatttggccggcgcatcggaagcggcgttgctccctccgcaggcggtcagtccggcgagtaatagtgtggccgcgatcaatgcgactgacttcttcatggttctcttcttctttctcttagagggccacactgtcgtgcagccagtttttgtatgcctggattatccaaggcattacgttgagctcacgcgctatcgcgcattcatcgttgccgtataggatttcggcggtgatgtagtcggcttggcttatgagcattcgagcagcctccgcgtctgcgcgctgctccgtgtaggcgtcggccttgcatccaacgtcgtggtgcttggcgtggctgatctcgtgcgccagcacgcaccgacgctggatggacgagagcctgtcgctgagaatgatctcgttgcgttccacgtcgtatacgccctcaagcccatccggaagcggtcggtcacgtattcgactcgcccactgcagggcgatgtactccaaagcgtcctcgctcatggtatcctccagtatccatatgaacagcccagccgacactcgccgaatgtcgttggtactcaggattgggagcgcccggtcgacaaaggcttgggaacgatcctgagcccttttgtttcattctgtgcgtttctaatttgacttccttgacagtgcatggcagagtaaaaagtactcatccgcctaggtgcgtgaacgagtttcctgggtcgctacggcggcccttgtttattattttattggattatttttcccgcccttttcgcgcggtcgtatctgcgaagctgtccgttatagctgctctcgtaattgagatagtatgccgtgaccagcatgcagtatggcctttccttctccggatgcggctccagtataacgaggtatcgttcggggcgaacgagtatgtgtactcgcgttctgttgcgccaatcctcctcccatatcaacggtttctcgcattgcgtgtaggagcatgaaggacattcctcgcaatagtcgatgctgggacgggggtatctgatgcgctcgcaacggtccatatccgtcatgcgctgtcctgtttcatggtcttcctcggtagtgatatgcacgaaaccggcccatttgccatccgactcttcctcccgtcgtctcacatgcacgggcaatccacggtagtgagggtgggaaactatgaaatcgttctcgaacactgcgtacagtctgttctcgtaatgggagaaggtctcattgacgatttgagacatgagcggcggaacccagtgcggtgtcatgcgtggcctccagtccaggcaaagagattgaatttacgcgcgccaggagtcgtggattgggtgagcttcaacttggatcgattctgtatgcgccagatgatttccctttttgccccagccggtggcttgatgtctgtccgattcgccctgcacacggcaccattgatgacatccacgatttgcatcatctgcacttcatccgatcgtatcggctgtatctttttaatgcacttatgatcgaaatcataatggctgttcgcgcatatctcgttgagcttggcagccctttgcgcggaatgagtgtctttgacatccagatacacgttgtatgtgttcgatgaatcaaacaacctgttgagcatggtgaaatacatcttgtaataccaatcattatgcgattggttataatcttcatgccgcagatgggtcttgtcggcgacaagtaccctgaaccgcatatcgtcatcatcgaagaagtaatccacgagatcggtgtataggccgatttttggttcgctcgcttttgtccatttcacctcgacatgggcggagacgccatgcttcgctttgatgtctacgatcctgtccttgacctcttcttttttgtcctcgggcaggatgagcgcgcccaataccatcacattgctgttgtcccgctccaggtggcagctctcgtcgcaatacaggttgtattcggtcatggtcactcctttgcgattcgctcaatctgtatggaaattccggataactcgctcatggcatctcctcgtaggcttcctgttccgcctcgatgtcgccatgcttcgcggccatcgcatagtaatcacgagcgttcgcgtcatccgaatcggacgacaaattatattcgcccatctcagcaatgagcctccgatatgcggcatctataatgtcccgaggatcaacaccgattaactcgcacgtgttcagcaacgcttccataggcattgatggtttagcgttgagccatcgagagtaaccggacttcgaatgcccaagttttacggccacttcagcctgagaggtttcatgtctcgcaaaacttgctttaagctccagtccgacaagttgcgaaaacctgtggctgcgttcgtcctgaatattactcatgtgagtactttacatctcaaattaagcaattgcaattcacaaaacgcaataacgttgctcaaatgagacacgccgacgttgaccgtggttgtatcgagatatagcattgctcacatgagcaacgttaatgcatgggtcggccatcaagtcgaaacgaaaatacagcaaaaaggactgacgaaaaagttcgtatcagaaaaatctggtatgccatacagcagtcttaacagcaaaatcaagggctatcgaggatttgaccttgatgacatcgtggcaatcgctgaggctatcaacgaatctcccgctgcgttacttcctccccaattcactgctcctgcaatcgctagaggtgcggaatgagttttgaatcgtctttgaatctgaagctcaggctactgctcgacggcctgcgggtcggggaactccaccgcttggacaacgcgatgcttgacccgcaggcgctcgccgacgtgctcggcgcggacgacttcgcccagctggaacaggatatgaaccatgaggcccgactgctccaactcgacgccgtagcccgcttctgcctacaaatccttgactcggccctcatccgtcaaggcgaggatggtctcctgcgccccgtagccgatgaagtgcacggccttggcaagttcccttacctccgcgctctgtgcgctttccttgagccggacggcgatattcgttccggtggcgatgttattcagcgcgttcctgagcaattccctctgggatgcgaccatgatgcttctcctttgaatgcgcgccatgccctttacacggcgcttaccagcattctaggagaaaacgggggcgacagcttctccgccgcccccaccaacactccaacgctcactgctgagaacacccttccggcgctcgccgaaggaggtgcgaaatgagaaaaatgagcaagggcgatgtccgggagtggctgcccggtgagtctcttgaacgggttgacttcggcaacggcgttacgggaatggataaacgctgcccgaaggacgattccgactggggattgaaacaactcatgtggaaatgcgctgcaatcgcggcagacggcgggcctcacgtgaaagtggcattctgcgattattggatcgacggacaaaaggtaccgggacagttccaagtgagctggacgggacatacttcatccaccggcggattcgactcgacatggtcgtatctcaccggactgcagaacggctacctcatggcggatcatcactgttccggcttgtatgccactctccgaagcttcttcagcggcatgttcggctcgtcgtcccaacgccatgagaacaccactggaaccgggccgttggtcacgtactcgatggtctcggacggctcgaacgaatccggaatcttcgttcgcaaccgaagcacatatgaatcatcatcaagcgtcaccgactccacgtacaccctgcgagaaccggtgattgtcacacgtcgtatggatccgcgaacccattccgcctctccgaacggcggcttgtcgaactccgcccgttgcatggcggtctgctcgttcagactgtcggcctggtcgcgcagggcagctatctggcttttcagtaaatcgatgtcatcacgccggtcgttgtcgcgttccttggagcttctgtgctccatgacccatccggcaatcgtcacgaccagggtcagcacgaatccggcaagctcgacgccatgttccgcaatccaattcatgaaccacacactacatcaatccaacatccttgttctcgctggaggtgcgaaatgagtggccagaatctcgtcgacgttctgcagtttgtcttgattgtcataatcgcgggagtacagattatgcatttctcctatatcaggcgtctttcggacgtgctggaatcttgcctctcccatacacggccatctccgattcctccggacgatattcgaactgattgccgatctccttggacaagagatatttacgggaacagcgtggatcgtgccgatacacgggtgagggacgaaacacgacctttacccagcaagtctcccaggacgcaaaagaaggcttcatcgtgaaaacgacatgttccccggccttgatgcatcccgcctcgaatgtctcccaacactcccactccttgcctgtatccggattgacgccattgcatctgatcagcctcacgtcatacgcatcggcatcaccggtgttccacaactcgagattaagcaccatgtctttcttctcgccggcgaagtacgtgggatgcgcttctccgacgaccagccattcgaccgttctgcgatcccatacacgcagaatcaccgtcaccgcgaaagacacgactgcggagaccagcgcggtcacaagaatctgtcccaaatcaatctgtcccaaaaccatgcagaaaagcgtagtcgctttcctgggcgtctggaacatcgtccaataccttgcaaaggaaggtacgaaatgagtggatataaggcaacccctgcggtgcaagcgcaggggtgtggtcacggcccgttctcagatctgttcgaagctgatggggcatccgggcgtccagtacgcagttacgtcgttcccggaatccgcgagcttgccgctgaagacgacccctccttgcgtcctggtcgacgtggtgagcttctgggagatcgcctgcgtttcggcgtcgtcgaacggtccgatcagctcgtcgttaaaacggatattccattgcgccatgtaatcacctcccttctttgcgtgggtgccctcattgtctcgctcgaactcgccggcaaggaggtgaagtgatgggaaccgtcagcacccgcattgaagaaggggacggtttcaaagtcctgagatacgggctcggaagcatcgttctcatcatcggctatccccagtcggaaagcgacctgatcgacgcgcgagatgccatcgccaaacagttcgattacgaaatcagcatgaacgggcgacggcacggcggacatcgttccgtccgcgccgccgccatgccggagtcagtcgtcgatctcaaccagcgaccaccacagggcggcacgcggattgagatagataagagacccctcggggacaccgagagcccgacctcgaaccgaaaccacgccacccgacgcggcggcgctctccaattcatcgagaatcttcgacggatactcttctcccgctaaatcgacaaaccgtcgcttatcggcggtcgtctcaaacacgagtcgatacgtcattattcttcacctcctctcattgctggtagttaggcaatgtccagcttaggggaggtgggccaacgcataaaaaggaagaaaaccaatgagcgagaaactcaccatcgcgaaccccgaggacgggaaccgtcccctctcctatcaggctctcagccacggcatcgacgaaatccgtttgggtgacatgggcatcacggacgcggtgtggcgcgggccgcacagcgagctcgtggcgttggcccgtcgaatcctcgacgcggaggccggacgatgaacgcccgggattacggacagcacgcgagcggctaccgcaggcccgagctcgacgaattgcctcgcggcttcatggtccggttgattctctgggccgtggttttcgccttctgcatcggctgggtgatgtcgcacgccggttgcgcgcatcccatcggcaatggtttggcctcccttgtgggattcggttgcgcgccattgcggctcctgtgccttgcgctgagcgaggcgggagtcgaataacaggcttgccggggttcctgttctttccttccccggcaatcgacaaggacagtcgttaacaccatcgcgccgcgctcggagcagcgggtgtggcgcatggggccggcaggttcgcccccgctggagatcacggtgtcatgtacgtggcaaacagcgggaagccgttcgattcggcacggtccacccccccatatccaccgacatcgaaggcccctcatacgggccggaaaggagaaccatggccgacgaaacagaacccgcgatgttcgacgcgttggaaaaggcgctgatgccgttgaacagcgcacgccagctggccgagctcagcggcatcggcgaatccacgctggccgaatggcgcggaacgcacacgggacccgcctacgtgaaatccggccgccgcgtcctctacccgaaggaggccgtgctcggcttcatgcgcgccaacctgcgcgaatgcaagaaggccagcgcatgaccggccagccgaacgactacgagcatcgcgccgagggcgagtccacgttcgaatggccgttggattccgcggggatgcgcatgagcgcgggcgaactattggacagcctgctcgccaccatccagcatctcaaccgcacggacgcatggccactgaccatactgccgccacgctggacggacgtgatggtcgaccgggaacgccgccagatctcggcggtctgcctgtggaaacgaaaaccagccaaaaaccataaggagggatagatgtgcgagaaacccgaaaccgaaaccgaaaccgtgacgccgcgggtggccttcgccaccatattgcagtcgctggtggccgagtcgccgaacaagcccacgctgcccgtgatgctgtccatgcttgaccaggcgatggatcataccgggctgcgactggagctcgccgccgcgccggcggaccatgaggacgatgtggcgaaagccagccgccgcctctcgcgcagggcgtatgacatgacgagcctgctggccgacggcgcggccggcgccggcgactgggagctgttcgacctggccgacgaggcgcgttccgccgccgttgcgctgctgcgcgcgttggatggtgatgcgtgatggcgggagagaccgttcttaccatcgtcggcaacctgaccgccgaccccgagctgcgtaccacgggcggcggggcgaccgtggcgagcttcacgatcgcttcgacgccgcgcaactggaaccggcaggccaaccagttcgaggacgggcaggcattgttcatgcgctgctccgcatggggcgacatggccggccattgcatccagtccctgcacaagggcatgcgcgtgatcgccaccggccggctgaagcagcattcgtatcagacgcaggacggctcccagagaaccgtcatcgacatgaccatcgatgagataggcccctcgctgcggtacgcgaccgcgcaggtgacgcgcgtgcagtccggacgcggctactcgggcggcagcacgtatggcgacccggccaaacccgccaaccagcaacagggctggcaggacggctccccgactcccgcgcagaacctcggcgctcccgaaggcgacccgtgggcgcaggcgccggccacgacgcccggcaccgcgttcggcgtttccaacgatttcccgtcaaacgattccgaccccgaattctaaggagattcaatgtcacgaaagaaaaagaccgatggcgtgcaggacgcgctgatacccgacgagatcacgccgctcatgctgctcgccctgacagccaaggcatcacgcatgaaggacgccgcggccgcgttccgcatcgcggccagcaagatgctcgacctggccaccaaggatgaatacatcgaaaaatacaagaacattgaccccatcaccgacgccttgtacgacgcctgcgatctctcgcagcacatcttcgacgccgccaacgcggtcaacgacctcattaactatccggtcgaggcccgcgagcgcgtggtgaaggcggatatcgagcgcagtttgttggatccgtggcgtgatttgcccacttcgggtggggatgtggatccggataccggtgaaatcaaggaggactgaatcatgagcaaacgcaagcacggacgccagcaactggagcatgagcgccaacgccggcgcaggaagcgcatgccgcacctgcccgtacaccagaatctatcgatcaaggagcagtgacccgattcagtggctatcaacatcatcgatatcagcgtaaagagcctcatcccgaacccgaacaacccccgcaaagacgtgggcgatgtcaccgaactcgccgacagcatcaaggagcagggcctgcagcaggcgcttgtggtaacccccgaccatgaggagcacggcgagcgcctgtttcgtgtggtgattggtcatcgtcgtttggcggcgtgcaagctggctggcattgagcgggtgccgtgtgttgtgcgtgagttggatgcgaagaccgagcgtgagctgatgctggtggagaactgccagcgttccgatttgacgccgttggaggaggctgacgggtatcagggtttgctcgaccttggtgccggtgtgggggagcttgcggcgaagacgggccgttcggagtcgttcgtgcgtggccggttgcggatcgcgcgtatccccgccgatgtgcgttccgggtcggaggcgttcgctcagttgtcgctttcccagttgggtgatcttgcggagttcgaggcttatcccgacatgatggctgagttggcttcgatggcgggcaccaagaactgggattggaagcgtggccagctgcggtcgcgggttcgcgtcgaggcgtggcagcagagcatgagaacagcgcttgaagctctgggcctgactgtggatgtctcggcttcgacgtggacgacgccggagggctaccggttctacgacgtgtggagcggcgagcccgaccagttcgagaaatggtggaagaaatggcatgaggcccacccgtacggacagccgataatccgattctccgagcgcaccgtattgtgcttcccgcaattgtcgcctgaggagatcgccgaacgtgacgccaagagcgagcggagggaacgggagcaggcggcattccaggaggcgctggccgcccgcaaggaattcgacaggctggcgtacacgctgcgcacggactggatcaggaagcacgccaccggattcaacggcggccagttgcgcaaggccaacacccgtctgagcctgctcgcgctgaccggcaccaacctatgcgacggcctgatcgcaggggccgaatggaacaacatcgacaacgtgctcgccgcatacaacctgctcgccgccacgccgctgccatgcgacgacacgagcgataggggactgtggcgcgaaacgaacctcgcggaactgcaccgccgccagcacgtcgagggagccgcgaacagggaactcctgctcatcctgtgcgcccagatcgaagcactcatcaaacccggcacatgggccgacaaggacgacatcgatctcgcgcaaacctactaccacacgctcgcagacctcggataccccaccagcgacgaggaaaacaaggcactcaacgggtgtttcctgcccgaagacgacgaggcggagtgagccatgacatggacccagatagacgacgggctcaacttcagcccgcagaccatgcccggcacggtatcaaacgccgcgttgggcctatgggtcagactctgcgtgcacaccgcgtaccagctgcgatttcccgcattcgacggcgcattcgacctcacggtcgtgcgctcgctgaaaggcaacgcacggcaggtgacggaactggaggccgcgggaatgctcgaaccggcgctcgccgccggccggtggatggtggtcgaggccgacaccctgatgaaattcggcggcacttccggcagcgaactcaaggagaaaagagccaaggccgggcatgccggcggcgtcgcttcgggcgagtctcggcgaagcaaacgcgaagcaaatgcttcgaagcaaaacgaagcaagtgcttcaagcaaaccgcgaagcaagaccgaagcaaaccatgaagcaaaagacgaagcaaacggtgaagcaaaaccgaagcaaacgtctgaagcaaaacgaagcaattgcttcgaagcaaacgaagcaaccggtcctaacctaaccatacctagccttacctcccctgtagccccctccgcgccgaacgccgaaccggagtcggccgagccgagccaagccatggccgaatccggccacgccaggccggtgacgagcctcgccgaagccgaggccttggccgaggccgacccgttcgcgttcgcctgggaccggtacccgagccacaccggcaatcgggaacaggcccgaaacctgtggcgggccatcaccggcggcgacccgaccgtgccgcacgtcgaggccagccaactgctcggagccgtcatccgctacgcccaaaccgtgcgccaggacggcgaccggttcacgccatcgatgcgcaaatggctcgaaaaccggcaatacgtcaaatggctgtcaaacacaccggcacacaccgaatggggcggcatcacccgccaatggctcaaccagcacgccatcagccaagtcccctcaggcacgtggacggacagcgtcgaacaaacgttctgggcccacgtcaaaaccggcgaagagccggagaccgtggccgcaaggctcgtcaaggaaatcaacgaaaggagccaggcatgagcgaccagcccacatccgagaccctgcgcctcgtggaaggccgcgagtccaaccggtgcatcgtgtgcgaccgatacctgcgtgcgggaaactggcccggcatgagccaccaccacaggaaacgccgcagccagacatacggcgaccccgaacggcacagcccctcgaacgtcatcgacgtgtgcggcacggacaacagcaccggatgccacggatggatccaccaacaccccgaacaagcccgagcattgggctacctgctcaaaagctacgaccccgagccaagccaagtgcccgtgtacagctgccggcgcggctggatactgctcgacaccgacggccaatggcattcatgcccgccacccgaagacctccccacccacatcaacatcaagaaaggcaacgaatgaacgacaccacgacaaccctcgccatcggccaccggaccatccccctcgacccgccccgcccgccaagaaaacccgacatgctcctctgggtcgacaccgaaaccaccggcgtcgacccctaccagtgcgaactcctggaagtcggcatgcaagtcaccgacatgaccggcaaacacccccacgacagcctccacctgatcgttcaccccgacaacatacgcaactgggccaactaccccgaactcctgaaagcctacgaaatgcacctcgccaacggactcatgctcgccgccgccgaagcgcccaaggacacctacgactaccagcacaccgcatggaacatccacgaattcctcaacgaccaactcagccaatacacactccaccccgccggcaccaacgtggacttcgacctacgccaactcgacgtccacctcagccgccacctcaaccaccccatcgccgaaggactccaccacagaaaactcgacctcaccaccctgcgcctcaccgaccaagccatcggccgcgacccctaccagaaccacgcaggcacccaccgagtccaagactgcatccacagggacatcaacgactacaccgcctacctcgacatcatgcgagccggacaccaaggaacccaatcatgaacaccggcaaacgaatacccgcaaccctcacggcgatcctcgccatcctcgcgctcgctgcatgcggagaaacacccaaaggcggcggccagggcaccgtgaacaaccccgaccccggatacgtccgctggtacgaactgcccgacggcagcgcggccgtccgatgcttctccgactccggcggagcgtcatgcgactggggacacatcgaactcaaggacaagcaatgagcacccacaccacaacccccgccccgcagaccatcgaactcatccgccgcctcctggaagcagcccaccgacccgaaccggccaacgatccgaccatctgcgcgatctgcggcgtaccgctcaccgacaccacgtcatccatctgccccgactgccgggaactcgaaaaggactggtaagcatgcacgccaccacatgggccaacgaccccgtcaactcaccaaaccactacacacgctcgcacccgggcatggagtgcatcgaactgaccgccgacaccagcttctgcctcggcaacgccatcaaatacctctggcgctaccacagcaagggccgacccgtcaaagacctcgaaaaagcccgatggtacctctgccgcgtcatcgaccacgacgagaagatcgcatggacacgccaacaacacgccatcctcgacaccctcgccaacgatcccaccatccccgacgccgaagcgcacacatgggcgaaactccggcaaggcttccccgactcggccctcgcctgcctcgaccgcctcatcgaacacgaaaggaaccaacaatgaccaaccccaacacctacaacacggcctgcatgaccggtgtcatcgacaacgtggacttcacgctacgcgacgactccaccagcgtgaccatgctcatcccacccgacacacccgtaggcaccagaaccatcatcatcccccaaggcttcaccctcgccgaacaccggatcatccgcgaagccatcgccgacgcgctcgccgaccacggggaggaactatgagccccgaaaaaccagacgctttgctgtggatggacgcggagaccaccggattggatgcgaacatgtgttcgatactggagatcgggttgagatgcaccagcctggacgccatgcacgaatacgggcggttcgaggccgtggtgcacatcggccgagaaaccctgctgaccgtgcagccctccgccctggaactgcacctgaacaacgggcttctcgcccaatgcgaatcctgcgacccgttggccaactcacccagggtcatcgccgaacaggccctgtggttcatccaaggcatggccgccacgtacaccctgcacccggccggcacgaacatcagccgtttcgacctgcccatggtcgaacgcttctgcatgacgggattcggagaactattccactaccgcatgctggacgtcaccgcactgcgcctcgcagccaaagcctgcggccaagacccataccagcaccgcatgaagcccacgcaccgcgtccacgactgcctggacagggacatcgcggaataccggcactacctcaccctcatgacggggccggcgctcgcagaaaaggaggaccggccatgaagccacgctgcatcctgtgccgcaagcctgtgcccgacaatcacacccgatgcgtcaaacactggctcaacaaccaagaccaatggatggaggacgaccaaccggtacacgagcactgcaccccacgaaggagacccgcatgagccacacggcacgaatctggacacaagaccaactcaccgccgtcatcaaaccggacgccaacggcaaccccacactcaacaccgaactcttccgctccatcaacgtgctcaaggagacaagatgaaagaaattacattaatcaccaccgatttttacattagcgtgctcggaggcacgcgatgaagcgcggaagctggtcggtggaatccaccatcgggctcgtcttcaccatcgccctcgccgtcatcgtcgcgatggtgctggccgtcatcggcctcaccgcctatgcggcaacgaacgtggcgccggaacagaccatcgtccagaaagtcgaaaccaccggcgatgtgcgccgcctgtgcatcgaagccaagaccggcgagcgcgtcgatgccatgtcatgcgatttgattgatccgcatacgggaggtgttgcgaagtgacgagtcaggcgatacgcgacaaggtgctcgcatggcatgggcgcggctacggcgcgacggatacggctcgtcaattgggtctgccgttggaggaggtgcgcgcgatcatccgcgagggcgacggtcggctgaaaccgccatgcaaggtcgagttcatcgaaccgccgctgttcgaggaatgaactggaataccagataaaaacgaaaccctccacacgaggcggagggcatgtcagcaagcaaccagtttagccgatgtggaggggtttcgtgaactgccagaactgcaacaccataatcgaaaacgggtacgcgctgtgcacggcgtgcgagctgcgcttcgccggcacgctcctgcgactcgcgcgcgacgtcacgccgttgcacgactcgctggacgcgaccctgcatccgggcgggcacgcgcccgtcaggatccagacggccactcccccgactcctatcaggcttgacgtgctcgacctgctggacatgctcgatgcgacggcgcgcgaactgtggcgttgcttggatgtcatcgatgccttggattggcacaaggatccacgcatggaggacctcgaggccacgcttatcgactgtgcgggccatcccaggctcgccacgttcgcggatgccggcttctacatggcgaccatcaacggcatcgcccggaaaatcgacctcacgttggatccgccagagcagcgacgcgagatcggcacgtgcgagctgtgcgccacgatgctcaccgcaggcgcggcagaccagtgggttacctgtcccgtgtgcggacgggaacagcgagcgcagacggtcaaactgcgtaggctcaagacgttgtgttgggatgattccaggcgagggtcggcggctgagatagccaaggcgttcacggatgcagggataccggtgcgtaggggtacgctcaacgtgtgggtcaaccgaggcaagctgccctccagccctcagggcctcgcctattgcgacgtgtaccgactcgtgatcggcggagcggcttgacaaaattgtcactgtaaccgatgattgcagtggcagaagtgtcgaaaaacccagctcacgtggctgggttttcgcgtatctgaccgcattgcatggggcgagagtactccgccggcacgtccaaagcgccggtgatgttcgccccgccactcttttcatttgattgtgaggcgatgacgccatgacaatgccaggcatgccgaccatcagcctgcagatcacgtgcaaggggaacaccctcggcgacatcgacgccctgcccgtgcccgtgagcgtcaccccgtccggccatctcgtggtcgaccccctcgaaccggtcatgcgccgggccgtgcaggcgttcgtggacgcctggcagcggtcgtgcgacaaggccgggttatgagcggccgccggggcaacacccgtcatgccaatggctggcgacgccagcaggtcgtggcccgcgtgctggcggcctacgacacgtgccacctgtgcggccggcccgtggacaaatcattgccgccgggattgccgggctcgcccgaggtggacgagatcatcccggtcagcaagggcggctcgccctacctgttctccaactgccggctcgcgcaccgctggtgcaaccgcgtccgctccaaccacagcgtcgcgtgggcgcgcgaacacatcaaacaaacattcgaacaggggcacacggccgacctgaaggccacctcgatgccattggtgacaagcggcgactggtgacgtggggaggagacccgtccgccccggtcgaagccccctcgggcgcagggccgatatctccccggcatgtcaaaacgtaacgccttggacggccgttacgttatcccgttacgtttttttggaggtgagcgcggtgatctgcgaggaatgcggccagccgttcaccccgtccggccgtggaaagaaagcgaaatactgttcggccaaatgcaagcagcgcgcctaccgcaaggccaagcgcatgagccgcgtcaccacccctcccgccccggccggtgacgcggaacatgagcccgaggcgatggacgccctcaccgccgccgatttcgaggcgatgatgaacgacgggcccgaggactacgtgagcgtgctcaaacgcacgcaggcccggctcaaggaagccatgttcagcgccggcaccccgccgggcagcctgaccggcatcagcaagcagctgctcgccctgacccgcgaaatcgaacggctcgaaggcaaccccgcacaaggcatgacgacgcaagaagatccggaggacgacgacgatgacggagaattccgacccgaagctatctgaggtcgcacgccacatcgtcatgccctccggcatcgtcaccagcatgttccccaaggtcaacaagcgcgccaaagcatgcggcatccgctacgaccgctggcagcagggactgctgacgctcatcctcggccgaagagcagacggcacgttcgccgcctccgtcggcggcgtggtgttgagcatctgccgccagaccggcaagaccttcaccgtctccagcctcgtggtcatcctgtgcacgctcatcccgaacctgaccgtcatctggaccgcgcaccacaaccgcaccaacagcaacacgttcgaccacgtgcgcaccctggtacgcaaccccgcgctcatcggatacctcgaccactccggccgcaccgacggcgtgcgcggcggcaacggcatgcaggaaatcaccttcgccaacggcagcaagatactgttcggcgcacgagcccagggcttcgcccgaggcaacgacgccgtagacatcatcgtgttcgacgaagcacagatcctgaccgaacaggccatcagcgacatggtgcccgccaccaacaccagccccaacgcgctcgtcctctacatcggcaccccaccgcgccccgccgaccccggagaagcgttcacggaacgccgccgccaggcgctcgccggcgaggacgacatgctctacgtggaattatccgccgaccgcgacgccgacagcgacgaccgcgcccaatggaggaaagccaacccgagcttcccgcgccgcaccagcgaaaccagcatgctgcgcatgcaacgccagcttggcaaggacagcttccgccgcgaggcactgggcatctgggacgagaccaccaccagccaggccatcaaccccgaacaatgggccaaagccgccaccggcacacccaacatcaaaggactgatcggctacgcgctcgacatgaaacccgaccgcagctcgctggccatcggcggcgccgtcaaccacagggacggcaccgcgcacatcgaactgcgccgcttcgaggccacccaatccaaaggcacccaatgggcggtcgactacatcgccgaccactggccgcgcacagcaagcgtggccatcgactcgcaatcacccgccatgagcctgctggccgacctcaaagcccggcacgtgaaagtcatcgtcaccaactacagcgacatgggccgcgcctgcggcaaattcctcgacatgctcagagacggcaaactcacccacctgccggacgacaaagcaccggcgctcgccacggccgtggccaacgccaccacacgcagcatcggcaaatccggcgtcgtcggatggaacccgatgggcagcgacatcgacataagcccgctcgtggcatgcacgctcgccctctacggcaccaccataaccaaacgagacccggaccgagtacaggaggtcatgatcggatgagcgaacaatccatcagcttcggcaacccctacctgtccaccggctcatcgttcatgacacacatcgccaacgtgcccgacgacgacatgacggacatcatccgcctactggagctctggcgcgccaaatacccgcgcaacctgctacgctccgcgttctacgacgccaaacaacgcttcaacaacctcggcatcagcatcccgaacatcgtcgcccagaaagccggcgtcgtggtcggctggccacagaaaagcgtgcgcgcgctcgccgacaagagcgtgttcgagggattcgagaccgccacgggggccgacaaccacggcatcgacgagatcatgcgcatgaacgagctcgaaaccgacatgagcgaggccgtcatcagctgctacaagcactcctgcagcttcctgaccatcgactacgacccggacgacaacgagcgcatcctcatcaccccgcgctcggccgactggtccgccgcactatgggacaacgaacgccgccgcatcaaagccgcgctgaccatcaccgacagcgacaaatggggcaacatcaccgcattcaacgcatggctgcccggccgcaactacgcctgcatgaaaaccggatacgggtgggaagcggaaccccaatacaaccggctcgaccgcgtggccgtggtgcccatcgtctacgacaagcagatggaccgccccttcggccgctcccgcatcaaccgcgccctcatgaacctgaccgacatggccatgcgcaccatggtccgcatggaagcgtccgccgaattctactcggtccccaaaatatggttcctcggcctgagccgcgaatccttccaacaggacacgtggagcgcgctcgtcagcagcatcaacgcggtcagccgcgacatcaacggcgacatccccgaactcaaacaggtctcccaggcatcgatgcaaccccacggcgacatgctcgaaaccatcgccatgctcgcctcggccgaaaccgacatcccacccgaacaactcggcatacgactggccaaccccaccagcgccgaagcgctcgccgccgccgagaaccagctgacgcgcaccgcgaaccggcagaaccgcatgttctcccgccagctcctcaacgccatgggcatggccgtgcaattgcgcgacaacagcccgcagccgccagacctgaccggcatccgccccctgtgggcgccgacccgcgaagtaagcgacgcggcgcgcgccgactactacacgaaggtcgccggcgtgaacggctactgggcggattccgacgtgggactggccaagctcggactcacggccggcgagctccaatcgttccgcgcctaccagcagcggatgaaggcgcagaggaacatcgagcagctcagacagcagcggatgaacccgcaggacacggaggcggctgatggcagcgaatccgaaggccccgccggaactgcagccgctgttggacagggcgtacagggactaccagaccgaccttgacaacctcagggagggcgcggccgacgtcatcgagaacatggtcgaccgcgaccctttgaacgtcaaggacgcgatccgcgacttctcccgagacgcctcccagctggcgaacgaatactacgacaccgtgcgcggcctgtggagcgaatacgcgggcgtccggctcgacgacttcgaccacacgcggctcatcgaccccgaccgcgccctctggcaggtgcagggcggcttcaacaacaccgactacaacggcctgacctacacgcaggtcaagaacgggcagtcgcgcgcgggactcacgatcgacgacctgtggcccgatctgggcaacccggatgacgcgatgcagttcgtcgccgacatggtcaacgccgccgcacgcctgaccacccaacgcaacatgcgcatcgacccgtcgaaaccacgatgggcaagagtgccgcgtggagcaaggacatgcgcgttctgcaccatgctcgcatcacggggcttcacctacctgagcgaggactcggcaggcttggagatgcaataccaccgggactgcgactgccagatcgtccccagctggggccgccagacactcgccggatacaaccccgaacggctcaccgccatgtggcaggaagccagcaagggaggtggcgactaccgggagaagctcaagcgcatgcgccgggacaatcccatggcgttcacggacggcgtctacccgacgccgaccatgccgtgggagcagtccgtcaggctcctgtcaatgaagggagagccaaaaggcactgcggaatcctggtaccggcgccagctcgccgtcggcgtcgacccgagcagggaaatcctcgaacggcacgagatcgtgttcctcgagaagttccagaagctgggcgaggaatacgagtggataccgaaaagccatgatggcaagcccagcaacgacttccactggctgagccacgaatgcgacgccgaactgaaatcgctggccggcctgaagtacaggaacgtggcccaacgcatcaacgacgccgtcgtcggcggcgtcgaacagggcgttgtcaaggacgtgtttgtactggacttcggaagcacgaaactgcccgacaagttcgtcaaccaactgtcgctgtacaacgcccgtcatgaatcccacatcaaagagctgtgggtgttcgactcggaaggattccaccaaatcgtattgaaatagaagaacggggataaccccccggattatgtgccggtctcaagagccggttacgtgggatccccgttacctcgattctaccatacggcgggttgccagagaggccgatcggggccgactgtaaatcggctgcatcacgccacgcaggttcgaatcctgcacccgccactccacaccacccgcacgggtggttttttatgcccggaacgggccccatcaaccacaaaggagaaccatcatgcacgacatgccgcactggcgccgattccgcaacaaccttcgtctcatcgattccggcgcgggcgaaggcggctccggcgaccccgcaacgggagacccggccgaccccggcgaggacatcgactggaaggcgaagttcgaggagcagcgcgcccactcgcgcaaatgggagcagcgcgccaaggacaacagcaaggccgccgaggaactgcaacagttcaaggactcgcagctgtccgaagccgagaaggccgccaagcgcatcaaggaactcgaagccgccaacgccgcctacgaggcggaacgacagcagaacgagtggaaggcgcaggtctccaaggagaccggcgtgcccgcctcgctgctgcacggcgacacgctcgaggccatgaccgcgaacgcgaaggccatcgaccagtacgcgcaccccaagcccaagggcatgccccaccagggcaagacccccgacggcaaggccgccggcgccgacgaacgcgcatgggccgacgacctgttctccaacctctaaacgcaatcatcccccagaaaggaacaacatcatggcaatggacaccagcaaactccacctgcccaagaccgtcgccacggccgtcgtcaacaaggtcaaggagacatcgaccatcgcggccctgtccccgagcagcccgcagatcttcaccgacaaggaatacatgatcttcaacggcgccgccgaggccgacgtgaccgccgaaggccagaccaagagctcctacgagcaagacctgaactacgtgagcggcaagacgttcaaggtgcagaccaccacacgagtcaccagcgagctcaaatgggccgacgaggacaaccgcttccagatcatccagtccatccaggccgaccaggccgaggccatcggacgcgccctcgactacgtcgtctaccacgccgtcaaccccaagaccggcgggcccctcaccggattcgacgcgctcacggcccgcgccatgcaggtcaccgccggagacgacgacatcaccaacgtcgacaacctggccgaccagctcaacgagacctacgacatcaacggcatcgccatcagccgcacgtgggcctcccgcctgcgcaagatccgcgtgcccgccaccggcatgcgctactacccggagatcccgctcaacctgcaggtcggcaccctcgacggcatcaaggccgccaccagcgccaccgtcaacggggccaaggccaagacacccaccaacgtgctcgccatcatgggcgatttcagcctcatcaaatggggcatggtgcgagacatcacgtccgagatcatcccctacggcgaccccgaccagaccggcgtcgacctcaaagcccacaaccagatcgcctaccgcaccgaggccatgttctcctacgcggtcgtcgattccaaggcgttcgccgtgctcaagacctccacggaagaaggtgcctgatgggcgcgttcacccaggacttcatcatccagccggcaggcaggaagaaacacaagaccggtgccatggacgtgcccgcgcgcctgtggaacccggacggcacgccgttcaccgctttcggaggcgtgaagaagggcacggccgtcgccaccgtggccgccgccgacgcaaccgtctcggccggcgccgcgccgaccaaggccgagttcgacgccgtggtggccgaactgaacgaaacgaaacggcagctgaacacgctcatcggatcgctcaggaccgccggcgtcatcggctaaaggagctccatcatggccgacgaacagccgaatccgttcgccacgcacgaggacctggagaaacgctggcacacgctcacgcccgacgaacaggcgcaggcggccgagctgctgctcgatgcgagcgagagcatccgcaaccacgtgtccgtctaccccgagacccatgaggaatcgtggtggacggcgcatcggcgcggcctcgagattgtgtgctgccagatggtgcgcaccgcgatggagcagcaggtgtccggcgtgcccacgggcgtcacgcagaacaccgagaccaccggccccttctccaactcctactcgtgggcttcgccggacggctacctgcgatggaacaacgactacctcaccgtgctcggcttgggtggccagcgcgccttcagcatcgacatggcatccggggaggtggtctgatggaacgtgttgacgtgtatcgtggcgcggccgaaatggatgccgacgggaacccggtgcagggagagatgcggcatgtggccacgctcatgggtttcgtggagccggtggaggcctcgcagtccccgggcgcggactcgcagggcgtggcccgccgtttcaccctgtatttccgcggggagcccacgggaatcctggacacggattgcctcgtggtgcgcggcaaaccgttgatggtggacgggccgccgctcgaatggtggaggcacgggcttcatatcggcgacgtggtcaacgcgttcgtcagggaggggtgaaaaatggcgaaaaaggtcaaggttgtgctcaaccgcaatgcgttcagctccgaggtgctgcacgaggccgtgaaaccggtcatggacagtgtgcaggagcagatggagggcatggccgaagtgcatccgtccatcaaggtgtaccgcaacgaggacaccgaccgttcgaacgtggtggccacctgtccggccgcggtggagggcgctcatggcgtgctcacgcagatgatcggcaaggtggtcgcatgagcgtgttccaacctcccaccagaacaccccgtttggaacgaatcctgctgaacctgctgcgcgaacgcttcccggatgtcgtgttcggcacgctgcgcagcaggaacaattcggaatccgaatgcgtgatcgtggcggaaccgcagcagaaggcaacacccatcagccagtacgtgcgcgtccgttgttccatctgggtgcgtagggacgacggcaccggcgaactcgccgcctcgcacgagcttgccagcagcatcgaactgtatctgaccggcttgtggcctccgattccgatcatcagcatcgagcatgattccgggccggttcgcatgaccgacgagaacggctgcatctactcgtatctgattctcctgcttcagacgaacaccgtttgaggcagtccataattccaacgattcgttttgaaaggcgatcatcatggctgacaacagttacatcagctcaggcaacaacgccgaactcgtgcgcgccgtcaaggactacgcagtgttcctgttcggcgaaggcgagacatacacgaaaccggcgggcgccgattggacgccgccggcgaacaagctgcccatcggctacaacaccgaggacggcaccaccatccacccggagccgggcgacgagaccgagatcaagggccacaacggcgacgtggtgtattcggagaccgatccgggctactggacgttccggttctccgcgctcgaaggcaagaagagcgtcgtggaactctacacaaactccaccgtggacaaggatggaggcatccacgtcaaggatgcgtctacctccaagaccatgtcgatggtcatcgccggcatcgaccagaaggaacgtcccatcgtcatctacgcggagaagatcaaggtctccgaccgtgacgacatcaccctcaaatccaccgacctgctccagtacaacatgacgctcaagacgttcaagggcagcgacggctaccagtggcatgcgtggggaatggtcgtggaaccgtccgcatccaccgcagcccataacgccacggcggaagccgcggccgaagcctgaccagcttcctcccccgcgggactccgctcttcacccgcggggcttttgattcttccccgcatccaggatggcggtcccgatgcggggaacctcatatccgaccgccaaaccagcaaaaaagaaaaaccgtatcaaggagaccgccatgaccaaccaatacgcgaaggtcgaacccatcatcaacgacgacgaccagctggaggacgtgcacctcgacgttctcggcgtcaaactcgacctgcccaacctcaacagtgccgacctgcccatcgacctcgtcaacgtgatcctgctgatcaaaagccagccggtgctctccgacgaacagaccgcgctcgccatgagcgcgttcctcgcctacttccaacagttgcgtccggactattggaacgcgttgcgcaagaccggccacgccatggcatggctcaccgccaccgtgcgcacctgggccgaacaatccggcctcgacccaaaagcgtttacctcagtgccctccacgccaatcacagggaagcgttagacgccgactggctcgccacataccacaccacatggaagcccgtcacgctcgccgaatggctcaacgcgcccgcggacaggaaacccaaagccaactacggcatcggccaggcatggcggctcacgagacagatcctcaggaaccataccagccattgtttcgcggcgctcgccggctggacgtacacgcccaccggggccgaaatcgccatgtgggacatgttcgaactcgaaggcaggctgcaacgcgaaggctggcgaccctggacggacaggcacgcggacccgttcgcgccgacgcgattggaaaccagccaagcgcgtaaggaacgactcgaacgccgcgaactcctcaagcaacgcttccacatcaccgactagccccgaccgccatcggggagccaacaccactatcaggatggaggaccccgatggcacaggacatcggcaccgtatacgtgcaggtggcaccctccggcaaggacttcggcaaaaccctcgaaggcgacatcaccggcagtgtggacaccgcagccaggaaaagcggaggcagcctcaccggcaccctcggcaaggcattcggcaaaatcggcaaactcggactcggcgccatcggcaccatcaccggaggcgtcaccgcgctcgccgcaaaaggcggcttcacccgcgccctgaacatcgaaaacgcgcaagccaagctcaaaggcctcggccacgacgccaacagcgtcagcgagatcatgaacaacgcgctcgccagtgtgaagggcaccgcgttcggattgggtgatgccgccaccgtggccgccagcctatcggcggccggcatcgcatccggcgagcagatgaccaaggtcctcaagaccgtggccgacaccgcgcaaatctcgggccgatcactcaccgacatcggcaccatcttcggatccgtcgccgcacgaggcaaactccaaggcgacgacatgctccaactgatgagctccggcgtgcccgtcctccaaatgctcgccaaacacctcaacaccacctccgaagacgtgtccgacatggtctcgaaaggcaaaatcgacttccagaccttcgccgacgccatgcaggaagggttgggtggagccgcattggctgccggcgacacgttcagcggcgctttggcgaacgtgaaggccgctctcagccgattgggcgaaggccccggcaagctggcgctcgaatcgttgcgcaagacgttcaacgcggccattccggccgtggacgcgctctcaagccagctcacaccgttcgtggagcagttgaacggcaagctcaccccgtatgtggacagggccgtcaagctcatcgagcaattcagccaggggttgcaggacggcagcatcaccgttcaggacatcgtcggcagtctcggccaattggccggagcgttcgcattgttcgccggggtcggcggcaacgtggacaagatcaccaacgtgttcgacacgctcggcaaactcggtgacggcgggatcggccagctcaccggaaagctcaagcagatgcccggccagctccagtcgagcctgacgggcctgcagcagttcaaatcgtatttcaacaaggatatccgcgacgctctcgccgtggacggcgacccgttcgcgtcggccgtcaaccgcatccggcagggcgcggacaagctcacgggcccgttcagactgctcggcgcgaagatcgcgggctccgatgtgggccagtcggtcgccggagtggcggacaggctgggtgtcggattcggaaagctcaccagcgcattcgattcgaacatcaaggtgctgggctccaaagtcggcaacggcttcggcggcatattctccaagatctcggacagcaagctcgtatccggactgtcatcggtggccggcaaggcgaaatccgccatgagtccggtcgtatccggattgggtgacgtgttcggtggcatcggcgacatcgtgggtccgaaactgcaggccggattgggcaagatcggctccctgttcggctcgttcttcagccccggcaatttcatgaagtacatgggcatagccggcatcattgccgcgttggtcgcgggtctcggcatgctggaccagagcatgcaggggcagttgttcgcgatgataggccagctgtccgcgcaactgccgacactgctgcagcagctgaacatgcagatcaccgccagcctgccggccatgctcgcgcagggcgcggccatcctcaccgcgctgatgaacgcgatcagcacgaacgcaccccagctgatgaccaccgccgtgctcatcgtcaccacgttggtcaacgggctggcctcgcaactgcctacgctgctgccggccgcgctcaacatgatcatggcgctcgtctccggattggcatccaacgtcggacagctgctcaacagcggcatgcagctcctcctcggcctcgtgcagggcctcatgaacgcgctgccgcagctcatcgcgcaggcacccaccatcatcggcaacctcgccagttcgatagccgcgaacctgccgcagatcctgcagacgggcgtgcagatcctcgtcaccctggccaacggcctggccagcgccataccgcagctgatcggtaagatcccggccatcgtgaaaagcatctgggacgctttcacgtcggtgaactggggcagcgtcggcatgaacatcatcaagggtatcgccagcggcgtcgcctcggcggccggcaccctcgtcaacgcggccgtcaacgccgccaaggacgcgctcaactgggtcaaggacaagctcggcatccattcgccgtcacgcgtgttccgtgacgaggtcggcgtgatgatcggccggggcatggccgaaggcatcgaccgcagccaggaagtcgtcaaccggagcctcggcgaactcgccgatgggctcacgttggacggctacacgttcggcatgcccacccccgtgatgagcctgccggccaacgcctgccagatggtcaacggcacgcagtcgaaccagcagggcatgcaatcccagttggacgagctgctggccgaggtgaaggcgttccacgaggatatgccgttcattctgcaacagttgggcatcaacatcgacgggcgggaattcggaagggcggtgcgacgctatgcaaaggcttgagtacgtgtgttccaccggcggctcgatctcgttcgaaggccccatctacggggagacgatgccatcgttgagaggacgcgcgtggacgtacacgctcggcgcgcgcacccttaccggggtggcatggcaggcccgtgaactcacgcttacggtgaaggccgtggacggcgaaacccaattggaccggctgcgcatgctcaccgaccatgacgtgctcgcgcactccagggactccacgatatcgggcctgctgcgcgtggacgacgtgtgggagtgcagggcgctcatcaccaaaagcgaaccgcaatccatcacgccgcgcatcatcgaaacccaattgaccgtgacccaattgggcatgtggcgacgcagcctgccgaccgtcacctatgcgcccagcgaccccgacgcctaccagtatctcgatcacccgtatgacatggactacgattacgggccgccatccgccccaccggtgatagccgtggacgggttggacccgatgccgttccgcatgaccatatacgggccctgctcgaatccgaccgtcacgatcggcggcaaccagtaccggatcaccggtgacatccccggcggcgctcgcgtcgaggtggatgcggtggagggcgagcgttcggtggcgttcgtcaacgcggccggcgaccggatcaactggttcgcgaacgcggaacgcggtgccggccttgattccggcagctacatcttccagccgttgccggcgggccgcgccgaagtgagctggccgggaggctacacgttcaagctcacgcccgtcgaggagaggagcgaaccaccgtggtcagcctcatagtcaccgacgcgaagcacaagccgttgcgcgcggtggacgactacatgctcgatctcgcctacggcagcgatgagaattcgttcaaactcacctgcctgccgcagccggaggccggcgcgctgatcataatcgacggcaccgaatacggcgggttggtgaccgtgcgcaacacggacggcagcgtggagggccccacctggcatggcctgctctcacgccgcatcctccaacccgatacgggtcgggattacctcaccgtatccggcgctgccggcgatgtgctcaacatgttgttcaaacgcatcggattggatgcgctgttcaccgcgtccgcccggcacgcggtcaccatcggctcctattcgttcgaccggtatacggacgcgtacacgggcatccggaagatgctcgccgccaacaatgcgaaactccgtctcatctgggcggacgggcgtgtgaacgcgtatgcgctgcccgccgaacactacggcgacagcatcgacagtgatctgctcgaattcaaagcctcattggactcgcagccggtgaaccatctcatcggattgggcaccggggaactcaaagaccgtgcggtcgtccactggtacgcggatgtcaacggcaacgtgagccaaacccaatcattgaccggattggcggaacgtcaggccgtctacgactattccaacgcgaaacccgacgagctgaacaccgagaccaggaagaagctcatcgaactgcaatcccagggcggcgtcgaggtcaccataacggacaacacgttgagcatggacattggcgacacggtcaccggccgtgacaaccggctcggcatcacgctcaccgtgcccgtggccaagaaggtcgtgaaatcatccggcggcatcctgtccgtggactacgagtgcggcaccgcgtcaggcgatacgacgagtctcagcggctctgcggaatccaacggctccaccggttcgggcggctccggcgcgtactacgcggacggggtcaccatcaccatgcgcaacaacacgttcagcgcggtcgtcaccccttcgcgcgtggacgacgtggagaaaacagccaaggacgcctacacgctcgcctcgaactattcggccgaaatcggcaaggcacagcaggattccatcgccgccatcgccgcggcagccatgaacgtggcctcgataaccacggccacgccattgtccgcgagcaggaacggccaggccgtgcacatcacggcaacggaggccacggccgaaggatccgggctcatgagcgccgcggacaagcggaaactcgacggattggacacctacgcgcttccggccgccaccattgccacgttgggtggagtcagacctgacggcagcaccatcaccgtcaatgaggatggcgtcatcaccgcgcacgccacatcgaccggcaacggaatcctgttcccggtcggctacgtggtcatgaacaccaccggctcggatccggcgaatgatttcggcggcgtctgggaggaacggccctccctgggcgcgcacatgtgggaaaggacgggatgacacatgaagacactgggccgtacatgcctgctcgaggcgaacctcatcctcgtggccggcgtcaccaacacctatcgcctcagatggctgcgcagggtcaccgacaaaaacggggtcacggtcgtcagacccatggacctgaccgggtggacgccccacatacaggtccgccgcgacgggctcaccgtcatcgacctcgccccctacacgctcctggacacggacgggaccatcaccatccgcgtcccggacgaggccacgcaaggcctgcccgcgggcgcgggcgcgtgggacctgctcctcgaagacccctcgggcgacgtgacccgcctggccgccgggcccgcgcttgtcgaaaccaccgtgagcgacaccgaaaggagtccgcattgatccgcgcattggacggctgctcgtgcgacgaggggccggtaatcatcctcgaggacgcgatcatcggcgacgtgagcatcgtctacgccaccgacgcggacatcgacaacctgttcccaacaccaaccacagataaggaggaacacgatggctaacaccagcaaggtcatcgacctggaccggctcgcccggttcaaagcaaagcaggacgcggccaacgacgccaagttcgcactcaagggcgaaggcggctcgatcgccacggccgacaaggcgggcatcgtcaagcccggcggtgatttcgacatcaccgaggacggcaccatcagcctgtacaaggcgatgggcattaactcgttcaccgtttccccatcgcaggcggaacgcggttcgacggtcgcggacgtgaccgtcgcatggagcctgtccaagacgccgaaatcgctcaccctggacgacaaggcgcaggacacggcatccaagggcacgacactctccggcgtgaacctcaaaacgagcaagacgtacacgctcaaggccaccgacgcgcgaaacgccgtcgccacccgcaccgccgacgtcgctttccgcgacaagcgccactggtgggtcgccgccagcctcgacgcggcgggagtgaccgaccagatcatcaaccaggcaaccggcgaactcgccgcagggtacaccaaaacgttcaccctgaacgctgcggccggacagcacatctactacgcgttccccgcgccgtggggcacgccccgattcttcgtcggcggcttcgaaggcggcttcgcgttgttgaagacgttcgaccacaagaacgcgagcggcgcgaccatcagctacgcggtctggaaatccacgaacgcgggtctcggcaacaccaccgtcgaagtgaagtaaaggagaaccctgatggcaatcgaactgatcgacacgctcgcgccgaagaacaacggcacgttccccatggtcaaagccaaggatgtggacgtggacggcaaacgactccccgagaaactcaaggagctcgaaacggctgccggaaacatcgagaccgccaccgacgcggacatcaacaacctgttcaaccccagcagcaagtaacgaaaggaaaccatcatggccacgaaattcatcaacctgaacaacctcgccacattcctcgccaaactcaagaccctgttcgtcgccaaggaactcaagaccggcagcaccagcacctacaaggtgctctccgacaacaacctcaccgacgaactcgtcaccaagatcaataacgcgggagactccacgttctccggcgcatacgcggacctgaccggcaagccttccatcggcggcaaggagatcgccagcggtaaccagaccgcagccagcctcggcctcgccacccccgcggacgtgaccgccgccgccaacaacgcgcgcgccggcgcagtcaacgacgtcaagaatctcggctaccagaccacctcccaggtcgagaccgccatcaccgcgaagggctaccagaccgccgcccaggtcgacaccatcgtcaccggcaagggctaccagaccgccgccaacgtggactccaaggtcaacgccgcgaagaccgaactgcagaactcgctcggctccgcattccgcgccaagggatccacgatgttcgccagcctgcccgcccccgcatccgccaccaagggcgacgtgtggaacatcaccgaccagttcaccaccgacgaccagttcgtcgacggttcaggcaagaccctgcccgccggcaccaacgtcgtcgccgtggccgtcaccaccggcgacaccaccgtcatgaaatgggacgcgctcacaggcatgatcgatttgagcggctacatgcgcaaaaccgacctcaccccggccagcgacgccgaaatcgacgccctgttcgcctaagggaccccggccatggcggaaacatacgtcaccctccacggcctcgcacgggcggtcacgaacctgctgcaacgcaccaacacgcgcactatgttcacggccgcccaccccatcggcgagatcatcgaaaccacccccaacctcgaccccaacacaatcggcggcacatggacacgcctccccgacaccatcggccgaggccgcctctggaaacgcaccgcataaacgtcaggagaacacatgacagtcgaactcatcaccggctacgccggcaccccacacatcggcagcgacgacatcggcgcattccaggccggcatcgtcggacccggcgactacgcgctcgccaccggtaatcagctcagggccaccatgagcaacgcgaacaccatcgccgtccaatcaggcgacgccgtattgaacggccgccatgtgcacctgaccggcaccaccaccgccaccgtgcaatccggcacccaaggccagaaacgcaacgatctcgtggtgcttcgctacacgaagaacaccaccaccggcgtggaaacctgctcaatcgtggtcctcaagggcacccccaccaccggtaccccggcggatccggcccacaacaccggcagtatcctcgacggcgtcgccacccacgacatgctcctctaccgcatcccgatcaacggcatcaccgtcggtaccctcgtcccgctcttcaacgtgctgaaaccaatgaaggacgtgtgggattcgctaacccctatacggtccggcaaaaaaaacgcgacgttcaccggcagcgtcgctgacgtcctgtccgatgcggaataccgtgccctggtcggccggagctacactggtggcgatgtggttgttttcacgcccgtcaccaccggcgtggatacggcgctggtcgcatgctacgacgtgccccataaggtcgtccgcgccatccaggtcggcacccagcagaacatcacgatggatgtccggtttgcggtgatccccgccgtctaacgcgcgccgagaatcctcgtgatggtcaggcactgcgtgtctgacgtgttgccttccatcacgtggattcggtgtccgatgatctgcacgctcgtgtcggcgatccggacgagagtggccttgcctgacgcgagcccgttcacgaaattcatgccgacgaatgagaggacgatcgatcctgcttcggcggcagtgtggaacagcctcgggtaatggtcatcatcattaccctcgatgatcagctcgcggaaatccgtgatcgattcggcgagcgggagggtgccggttttgccgctggcgccctcccataggacggtgggggttagcgaaagctaggcggtcagccagcagccagtacaggtttggtaatatcctttatccgctttgccgcggatggtgatgcttccatcagagcttatataccagctaccgacagcgccgccattgttcgatgcaaacagaatcgacccgtaggaagctggcctgtatccttccgggattttctctatagctttcaattctccggtcgcataactagatgatggcgaaggttggccgaccgctataacgatgcgacctatgcgcatgagtagtacattcatcgcgtaggggccagtaaacgatacagacgattgggttagcgaatccctatccgcgccacatgacggcccagttgacgcggataggtgccgtgtttttaccgtcgaacatgacatcgatgcggtttccggacgggctgacacgcacagaggtgacctgacggccgttcgcgtcccagtcaccgttgatggcggcaacgaccacgtcattgttccagtcgcggccgaactgggttttgaactggccgaacgtccacagggtcgcgtagccgccgctaccggcatccttatagacgccactgccagtgtagagatgcagcggggttagcgaatccctatcaacgtatgagggcgtgctcccatgtgcgttgcgcttcgcggagtacttcactgtctgggcgcaggtagtagcgggctgttgtagcgatgctggagtggccgagtgctcgactgaccaccgccacatctacgccggcgcctaacgcggtggacgcccagctatggcgcaggttccgtctcggcacatacggcaggttctgcgatctgcaccatgtggcgtagcgacgagcgacctggccgggattcaacgagccgatgagtcggccaccgtctcgtggcctgatctcacggagtcgaagtaccgcgaatcgcggcagcacgatggtgcgacggctcaactcggtttttggatctacgattacctcgtgcccgtccacccattgcaggccgcgctggaccctgaccttgccggtgttgaggttcagatcctgccattccaatccgagggcttcttcggtgcgcaatccgaggcatacgctgcagatcagccatgcctcgagctcatgcccgtggaaaccctgcagcaactggcgtatctggcggatatccaaaacctccggttcataaccgctcggtttcggtggcgtgaccctgccggtcacgtccgcatccagtaatccgagccgcaccgccgaacgcagcatctgccgcaatacggcccacgccttacgcgccgctccggccgacgtgatcgagtccagccacgattggatacgcggccctgtcaggtcagccaggtccatgtcacccaattcgggtcgtatgtgacgtcgccatgcactcgcatatccgacgcgcgtgcattcgcgcagcctgccacatgacggccaatacgactcgtcccaatactcattcagcaacatttcatacctccaaaacccacacgcagcatggccgttccatgcggatctgcgtgtgggttttccataccgtaggagccgtgcatgaacctgcccgagggattgccagcatgggcgtacatcgtggtgagcgccctggtgctcgccgcccagatcgtcaccgccatctggatcaaccacagaggggacgagagggatcgggcgacgcgcggcgagataacgaacaaccatgagatgccgttgcgcgacgacctcgacgacaaggccctgcgcacattggacgccatcgaatcattgcgcggcgcggtcgacggtctgcgtgacgacatgaacggcgagttcgcgaccgtcaatcgtcgcatcaccactaccgagcagaacctcatcgaactgcgccacgaggtcaacgacctccggcgcggaggaaacaaccaccaatagaaaggaacaccaatggcaaacaccaaaggcgtggccgaccacaaggccgccaacaccaatatccccggcctgaccgcggagcgcacgaaatccatcgtgctgctgctcgtccagctgttcagcgtcgtccagaccggcctgtccatcgctggcatcagccagctgccgttcacatcggaccaggtgagcacggcgatcaccggcgtcatcgccgtcatcgcatccgtatatgcgtggtggcgcaacaacaacttgaccgtggccgccgtgcagggccagcaggtcgtcaatgccgtcaagcttgcccaggacacaggtaacgccgtggatatgccgggcgaggtcgtgcccatgagcgagatgatctccgacccggacgccaagaccaccacggagtgactaatagtgcagatcaaggaggagatcgtcaacgcagggcacggctacctcaatccgtccctgttcgccgtccacagcacggcgaatcccggcgccacggcccgcaaccaccgggacctgtggtcgcgaggctacgactacgcggtgcacctcacgtccgactggaccgaggcgattcattgcgtgccctacgaccggctgtgctggcaggtcggcaacggcaacggcacgtgcgagggcatcgagatctgcgaggccaccaacgcgtcggacttctggcgcggcatcgacatcgcagccgacgtgatagcccagcgcctccgcacgcacgggtggggcgtcgaccgcatgcacccacaccaatggttcagccagacctacggcggatccgaccatacggaccccatcccgtacttcacgcgcttcggctacaactggggcgccttcgtccaactcgtccaacagaagctatccggcgccacagccgggcaggaggtagacatcatggcaggaatgatgatccgcaacgacaacaccggggtcatctactattgcgagcccggcaagggccgcaccgctctcacacaccccgaccaggccaacctgctccagcaggccggcgtgccgctcatccacggcaacaacggcgccccatggtggggtcgtttcgaccaggtcgacgcgctcgtgcgcaagaccatggaacagctcggcgtatgaaccgcatccaatggctcgtcgaatgcgcgggcctgatcgcagccgtactcgcactcgaactgtatgctgcgctcgccgacgaccaaggcatgccctgaaaaccgaacgccccgctcaggcatcgcagacggctctcatgagcttgactgcggccggacggggccgatttttcacgttgtaggcgcggtccgagacggtgtaaatttatccgatttttatccgatgacctctgaaaacgacatatatcaccgaactcaacgaatgaactacataggcacaaaacgttgaaattccaaccgttttaggtcttacagaatttgatggagaaagacgaaaacaggtcgaatacaacaggatgtcgccggttcaaatccggctagcccgaccgaaagccctactcccgactgggatgtaggattttttcctttttatagtcggatgccatcgctcatttcccctccgccaccgcatcgatctcatcctgacgccgccaccgcttgaggtttggcaacagcgccgacatgcagtcctcggcctgttcgacgctgatatggcaggattccgccatcatcggcgcgcatgcggcgaccaattcatcgctattggcatagtcctgaagaaaaacgccgtcttcatagcagtagttgcaataatctccgtttcgcgttccatccggttcggtgccgtgatcttccgggcggtaaaacggcatggcacaactttggcaaaaaccattgtccggcatttccataagcctcgccatcggcacctcaaaacgggtgctgataagccgaatcatgtcgatgctcggctctgccgttcccttctcccagcgggaaagcgcctgttgggtgacgaacagctcgtgcgcgaactgcgactgcgtaagacctcgctcctcgcgcacgactttgataacctgaccgatcgacatgactacctcccgacatcggaaaacgattcgcgcgtctcgctgtgcgcttgctgattccagtctaagggcatgtcccgttcgccaagcgcgggtacaacaaaccgttgttcgcgcttgtatcccggaggaagaaacagctcggtcgaacctatttcctctccaccccttcaattctcccggttcctctgactcctttgcgagcgccgcggatgggatgagcacgcttacgtatggggttgcgccagacaggacgtcgtcgtagaagcgctgtttggcgtcgatgaagtcgatggaatcctggatttccgcgagctgctcgaccagccgcgcccgcttgccggcgagcatctacttgcgttcggggatgctcggctcgtggaggagcgtaaggggcgcgagtaggggttcgcggctttgctgcggtctctccctcacccggctacaccgggagctccctcgtcagagggagcttaaattcggtctggttataggcccatgggcttcttgggctttttggcgctcatgagcatgaggaagctgcgggactgggcggtgatcatgaagcccgcctcatagctcagcgccggctcattcgggttgtgcgtatccacgaccagctgccatttgcggccgtatcgctcatccggcagggtgaacataatcggctcgtaatgcgcgttgaagatcaggatgaagtcattgtcgaccatccggttgccgtaccagtcgacctccggaatatccgaaccgttcagatagatcatcatggagaacgcatgcgtgttctgccagtcgtccatatccatgatcgagccggtgtggtcgaaccattcgacctgcggaatcatgttcgaatcgtcgccgggctcacggcctgtgaagaagcgacggcggtgcaacaccggatgatccaaacgcagatgaatgagtttggaaacgaaggcgagcagttccttgcgtcccttgtcaagatgccagttggtccaggagatctcgttgtcctgacagtaggcgttgttgttgccctgctgggtgcgggccacttcgtcgccaccgcaaatcatcgggataccctggctgaacagcaacgtggcgaacatgttgcgcatctgacgctgacgcaagtcgttgacgtccggaatattggtcgggccttcaacgccgcaattccaagagcgattgttgctctcgccgtcgcgattgccctcgccattggcttcgttgtgcttttcgttgtagctgaccaggtcgttcatcgtgaaaccgtcatgcgcggtgatgaagttcacggacgccaccggtcgacggccgttgacctgatacagatcggagctgcccatgaggcgtgatgcgaattcgggcaacgtggagggctgtgagcgccagaagtcgcgcaccgtgtcgcggtagcggccattccattcggaccagctggacgggaagccgcccacctgatagccgccggagcccagatcccacggttcggcaatcagcttcacgcgcgagatgatcgggtcctgctccacgatgtcgaagaacgcggacagcttgtcgacctcctggaactggcgtgccagcgtggcggccagatcgaagcggaagccgtcgacgtgcatttcggtaacccagtagcgcagcgaatcggtaatcaactgcagcgcgtgcggcgagcgcataagcagcgagttgccggtaccggtggtgtcgaagtagtgctgctggtcgccttccaccagtcggtagtaggaggcgttgtcgatgcccttgaagctcagggtggggcccatatggttgccttcggcggtgtggttgtacaccacgtcgaggatgacttccatgccggcgtgatggtaggccttgaccatggacttgaattcgttgacctgctcgccgcgttccccggaggaggagtaggcgttgtgcggcgcgaagaagccgatggtgttgtagccccagtagttcgacaggcccttctcctgcaggaaggagtcgttgacgaactggtggatcggcatgagttcgatggcggtgacgccgagcttcttcaggtattcgatgacgctcgggtaggccaggccggcgtaggtgccgcggatgtccggcggcacgtccatgttgaggttggtcatgccgcgcacgtgcgcctcgtagatcaccgaatcgtggtacgagatgtaggggtgctggtcgttgccccaatcgaagtagggattgatgacggccgacttcatggtgtgggcggccgagtcaaggtcgttcatcgccgaggtgtcgtccgggcttttgaaccagtaggagaacaggctttcgtcgccgtcgatgttgccttcgatggccttggcatacgggtcgagcagcagtttgttggggttgcatctgaggccgtgcatcgggtcatagggaccgtagacgcggtagccgtagcgttggccgggctggaggccggggatatagttatgccatacgtatgagttctgttcggtcatttcgatgcgcgtttccgcatcgtgctcgtcgaacaggcatagctcgactttctgcgcaacctgtgagtacagcgcgaagttcacaccggcgccgtcatagctggcgcccagcggatacattgatccaggtctgatctgcatagttttcagtatcccactttcttgtgtcactgatgtgccggggagttgaacgtcaggagaacagcgacggcttgtctttgtcggagttcctgacgatgagtctgcgtaacgcctcatgctggatggcgatcatcgaattggatgaggtgatgcgcgtggcggcaaggtcgctccacggaatccacgcggattccacgtgctcgtccgcgtcgaaatggcgctgctcccgcctgaacgggcccaaatgcaacaccatgatgtgggccagttcgtcggtcatgccttcggacgagtagaaatcgcccacgaagtcaacacccatggtgtcacggtccggcaccacgccggtttcctcggccagttccctcagggccgcgtccatgatgtcctcgccctcgtccatgagaccggcgggaagcccgtaggcgaacatgtccgatccggcacggtattcgcgttcgatgaggtaacggtcggtggacatgtcgtgcacgagcatgaccacacagggggcgtgacgcagcacctggcggccgatctcgtgttccttgccctgcttgtcggtcagagcgatgcgcatgtcgtccacgtggaagatgcgcccggtataaacggtttcgctactgatcactttggcgggcacgtccatgtcgatgccgtccgaggaggcgttcagcttatggtcgagccgatgctccagttgttcctgcttgcttccgccagacatgtcatctcctcggaaaaaacgtttttgccacgttactatagcgtcttaatctcgatgcgcggtaatggacagcgtccatggatcggtcgtgtcgtggaaccactcgacttcaggccttgctccggtcgcttgttcgatggcggctggcacgtcatcgatcgcgtagttgaaccacatggattcgatggcggcatgaggggtgttgatgaagcagggacgcacatggctctcccccgccattccatggccgagcatgatgccttgggacctcatacgggcttcataccgggcttgttcgatggcgtcggtcaccgggtggtgacgcaaatcgctggttacgtacacgtccgcaccggtggcacgtacctcgttgaacagggagtccccggagccaggcagaatggccacatactgaacaaaagtgtccgaatcgccgcatacctggatgccgagcgcgctggtcatgccatgatcggacacttcgtcgaatactcgctgagcgaaatccttcagggcaacaggcttcggcaaacgacccacacgccccaagccgaccggatgagaggcgtttgcatcgtcaatcggcacgagtggtttctggtcgatgagtccgaagtagtcggccgccgcctgtcccacgccgcgatacgcagcgtcggcattagtgtgccctacccacagcccgcagccgtgctggtagagtctgcggacgatgtcgccccggaaaccgagtccgctcgtctcgtgtacggaacggaagaacaacgggtgatgggtgatgagcaggtccgcgccagtagcgatggccttgtcaatgatggcggaggtcgggtcggcggcgaacacgatgcggtgcacgtcgtgactcagatcgccgacaatgaggcccggctcatcccattcctcggcgtagcgcaatgggtacagggtctcgagaacgtcgatgacttgcttgagattcggcatatgtcccattgtagtgggctattgctgcaagggactcattctgcaattgcggacaagccatgctcgtgctcttcattgctcgactatcggctcgccttcgcctacaaacaatccactggactgtttgctcaacggctcagccccctcacccgaggggagctagaaattgtcagtgtgcagcgagttgccagtcggaaccgatgccgcacgatacgtccagcggcacggcaaggtcgacggcgtgttccatggcgttgcgcaccagttcggtgacctggtcgccttctcccggcgcgatttccactaccagttcatcgtgaatctgcagaatgatacggctcttgacgtgagcctcggccaaggtctgctcggcgcgaatcatcgcaatcttcatgatgtcggcggcggatccctgaatcggtgcgttgagtgccgcacgttcagcggcctcacgcgcaacacgattggtcgaatgcagggccgggaagtagcgacgtcgtccgaaaatggtttccgtataccccttctctcgggcattggccaccagcgattcaaggtaatcgtgcaccttgccaaaggtatcgaaataccggtttttcaacgcttccgcttcacgtggcgcgatcttgagttgctgggcaagaccatacgtgctcagaccataggccaatccgtagctcatggcttttacgtggctgcgctggtcgccggtgatctggtcgaccggcagcttgtagaccatcgaggccacgtatttgtggaagtcggctccggagcggaacgcttcgatcagcgcctcatcatcggacagatcagccataatgcgcagctcgacctgtgagtaatcgcagctcatcagggcctcgtacccctcccccggcacgaacacgccacgaatctcacggccggcggcgttccgattggggatgttctgcaggttcggatccacggagctcaatcggccggtggcggcaacggtttgctcgaaagtggtgtggatgcgctcatctgatgtgttggtggcatcgatcagcgtttggacgatctgcttgagcttgttgatctcgcgatggcgcagcaacgctccgaggaaaccgttggcccgctcattgtccactgatttgacatacagatcctgcaatgcggccgcattcgtggtgtatgagccggacttggtgcgtttggtgggtttcaaacccatatcttcgaacagcaccttctgcagctgcttggggctttgcaggttgatttcggtgccggcatactcccaagccatttcctgcgcttggcgagcctcggcggcaaactggtcacgcatggagacgagtcgaacgctatcgactttggctcctgtgtgctccatgccgtgcagcacgcgggaaacaggaagttcaatcgcgcgcatcagccagcattgttcacgctcgtcgataatcggcccgagcgtgacggcgaggctgcggataatggccaaatcacgcagacgatgttcgttcggatcttcttcgacctgatcgtcgtcgaagtccaacgtgccttgcgaaggctgttcggtttcggtgaagtggatgtcgaggaagtgctcggccgcctgcttgaggctatcggcatggaaatccggttgggccagatacccggcaagcttggtgtcgaacatcggcaggtccatgtcaagatcgaccgcgcccaaaagatgcagcaattctttatacccatgcacgatggtgcgggagtgttcgcttttcaggaaccgcgcaagctgtgctcgcagggtatcggtgattggaaggggcactatggccgctgatgttgccgtggccacggcaatggcttgtgccgtggcacgccccggcctttcgtcgccccatgcggccacggtccaagcgtggccgaccgcgtcgccgcagatggcatgccgctgcgagccatcgccatagtcggaaaccgtgaaatcggcgatttcaccgggaaccttgacttcgacgcgatgggccttgacccattcgtcgaactgctccggagcagtgatgctcgtgggttccggcaggttcagatcgaggctgctatcctgctcgttctgctcattattcgtagactcgccagctccggatgtgttggatgccttggccccggtattgaaggttttcagtacacgactcttggtgcgaggtccgaattcaagctccttgaacagggcgtcgatctgtgccacgtccacggtgccgaatgtcagatcctcgatatcgacgcctagatcgacgtctcgtaccagtgcgttgactttgcgattgagtttgacctggtcgatattggcccgcagtgattcgccttttttgccgccgatttcatcggcgtgctcgcaaatgccgtcgagggaaccgaattggttgatccacttggccgcaaagccgtcgcctacgccgggcacaccgggaatattgtcggcggtttcgcctcggagtgccgccagatccggatattgtgcgggagtgactttgtatttgtcgatgatggactgcggcgtcatatgcttcaggtctttgaagtgatggcccgggtacaacacggtgacgttgtcatccaccagctggaaagcgtctcggtcaccggacaataccagtgtgtggtaaccggccttgtctcccatggtggcgagggtggcgatcacgtcgtcgccttcgaatcccggcttctcgatgtaggtgacgccgagggccgtgagcatgcgttgaatcaatggcagctgggtgagcagctcttcgggagccgcctcacgggtgcctttgtattgcggaagcatctcattgcggaatgtgccgcccttcacatcgaaggcgacgcccagatggtcgggcttctccgcatcgatcacctgcgcgagcatggtggcaaaaccccagacggcgttggtggcctggccgctggaggtgctgaagttgtcgaccggcagggcgaaaaatgcacggaaggccagcgagtggccgtccaccaccagcaatgtttcattggtgggtacggtcacgctggcctctcccatagtgtgtttgtgttgctttacgactcagtacggcgacgccgataatcagcgttcgcccgaatcagaaggcttcggatcgccgtacttggcgatgatggcctgagccaggcgcttcttggggatgcgctggtccatggaggtcttctgaatccaacggaaggcaccctgctcggagaagtccgccttgtccatcagcagacccttggcgcggtcgacgagcttgcgctcctcaagcgtgtcttcggccttcttgagcttctcttcggtttccttgagctgatcggtggtttccttgagcttacgttcgctgcgctccacgctgtccagcaaatcgttgatctcggcgaaacggcccatggccacctcgagggtcggcagcagcttggattcctcgtacggcttggtgacgtatgccatggcgccagcgccggtggccttcttcaccagatcggtctgggagaatgcggtgagcatgacgacgggggcgatgttttcatcgcagataatgccggcagcggtgatgccgtccatacgcggcatcttgacatccatgcacaccacatcagggcggtacttgcgggtcagttccacggcttcctcgccgttggcggcctgaccaacgacctcataaccgttgtcttccagcatggcgaccagatccatgcggttcacggcttcgtcctcggccacgacaacggtacgcggaccgtcctcgggcttggccttgcgctcagcaggttcgctttcattggccacggccttgagctcttcgtcggtcagcacctcatcgatgttgatactcggttcttcggacttcttccttgcagccatgccaacctctttcttgaattacccaacaatggggttcacaataatttcagcgaactcctaactaaagtgccctcggtgggactcgaacccaccaccttcgcataccctgccgagctgagggcaattcctcgtcaggaatcgctcctgactcagtttaccctcctgtacatcctgttcgcggtttctctgcgagctttgcccgcacgctgaaccgttcccgttttgtacggcagtcaagagtagcggctgcggacgcggcctgtcaaatatcggcgtgtgggagaatggagtttccgttttcgcggagtgtccacatagatgcagggtttaccaaggtgaccgtgttctttagggtgtgcgctgcgcgaagacggttttttattggctgaaggaggccgaagatggttgaagagacaaagaggcccttgcgccgcaggcgttttgggtgcattctcgaacgcaagggttcgacaggggatgtcacgagcatcgaggctcgttatatctcgccgatcaatggtcagcgtgtgtcgaaacgtttcgcgccgggcaggcggggcgatgccgaggattggctcgagaccgagaggtcgatcgtcgatctgcaccgtcgtgggatgatgacgtggattcctccacgggaccgggatgggaacacgttgacgccgaagctgacgttcggcgtgttcgccgacgggtatgtgcgccggcatcgcaggaaggacggcgccgagatcgcgggctcgacgttgcgtaacctgcgcaatgacatcaagcatctcaaggaggcgttcggcgacgtgaaactggccgagttgaccgaggagctggtgaccgagtggtattacgggccgcatccgaacggggaatggcagttccgctcggaatgcatccggttgaagatgctgttgcgggaggcgtgtgcgccggtctccaagggcgctcctcccctgttggcggagaacccgttcacgctgccgattccgcccgagccggaggctgggtcgtcggatattccgccggtcacgcccgacgaactgtaccatatatataatgcgatgccgggctatacgcggttgtcggtgtatctcgcggcctgtgcgggcggcatgcgcatcggcgaggtctgcggtctgatggacacggacttcgacttggagaacaaggtgctgatgatccgtcgcagcgtcagccatggcgcggatgatctgggcccgtcccggatcggcaggctgaagacgaaggggtcccggcgtacggtgcctatcccggacatgctgattcctttgattcgcatgcatctcgaggatcgtccggaccagtcgaaccacatgttcttccaggccaagcgcggcgagatcctgtgtcagaacactctgcgcaaccacttcatgaaggcccgcaaggcggcgggccgtcccgacctgcagttccgcactctgcgcgtgacccatgccacccgtctcatgctcgatggcagcagtctcaaggagacgatggacgccctcggacatgtgagggaggagaccacgttgcggcattacctgcgtgccgtgccggagcatcagagggaggccgcggaacgcaccgccgcctatctgctgtccgcggacccgtcgctcgcgatcgcctcgctgcctcccgctcccgccgggctggacgcggacggcgatgcgggcgacatggccgcgctggcgttgctgcttggccaggtgtcgacgctgatggccggcatcgccgcccggaacgcgcagccggccggatagcccggcttccgcccgcccctgcggtcacgcgcctatggccggaccgtccatgcccgcatcctgcgcgggtccgggacggtccggcgtttccatgggcatcgcgccgggcagtacggcggggtcggggaacatgttcgcggcgggccatagcccggtcggcccctcgtcgggtgcgggatcgtagccgggggccgtcgcctgcgcctggcggatgcattcgctcacactcccctggaacgtgctctcgcgggtggcggcccggcggaccagatcgaggccggcggcgttgctgcggtccatgtcgacgatgagcatggtcggcatgcccgcgccgaggatcaggtgccggcccgtggtctccacgaggtcgtcgtgcggcgtgatgatcggatggtccgtgacctgcaacgggttggcgggatcgtcgggcagagcgaggtggatgtcctccggcttggtggcggggatgcggatgggttggacggcgagcggctgggcggggtcggggtttctggtggcgatttccccggtgatccatgcggcgttccagtcgtagacgccgaggggtgcgtgcaggtcgggctcggccatgacgcgggcctggagcgcgtgggcgcggatgacgcccctgttctcatgccagtgggagttgaggagtccgatggaggcgagcagctggtctcccaccatgcggcccttgtccttgtacctgttccattccgcggctccttgcggctggtccgccgggttgagcgcgtcgcgtgcgacctggatggcgccgagggcgtgcgcgaggtcgagcgcgatgtccttccatgggcggcgggtgtcgatcgcgatggcgtgttcgtcgagccggtagcccatgggttcggcggcggccttcgcctcgtgcctgacggccaggccctgccgcgtgagggtcttcgagagggcctgtgcgacccgtgcgaacaggtgggtctcctcggcctcgtcgagcgtgaagtcgggcaggatgccgcccttctcctggatgttttggatgtcctgttcggtgtagtcgccacggtccttgagatgcggggcccgccaggctggcgtggtgttgcgggatatgtcggccatgatggtcctccttgatgggcggggccgtctttcggccccttcccatccggcacccgcacgccgcgagccgccggccgattgcatcccgtccgtcaccggcatgtacttcacgacgtacaatcgggatatgggagaaatcacgatggaaccggcttaccacggtatcgaggaggagaccgtcacgcgtctgccgtccaaggcgttcgacgagtttctcaaggccctcgacaggccggtgccgcagaccgcccgggaccttatcggcatggagcccgattggctatgaggttcgcgtccccgcgtcgggcctggtccggcgacgtgctcgacgggtccggctgcggccgtcgcgcccatctacgagcggctgccacttcgtgcgcgggacgccgagaaacacggacatcggccgtataacgtaagtcggaaaaaacagcaggccctccgccgcgggacggagggcccgccttcgggcggagaatcagatctcggccagcgccttgtctaggagcgtgcgcaccgcattgctgcggctcatgtggtgtttgcgcatgtaccgttccagcttcgcgtcgcgttcgtcgtccagacggacgcggatcacgttggaggcaggggtgctgcccacggctaggggacggcctggggttctcttcagcgcctcggatagctgctcgtcggtgtagcccctctcggcctcctcggcatcggccttgagcatcgcggcctcgtcggccggcagttcgtcgtaggagaggatgtcgtagttcatgtccattgcctgcctccttccagcagtttcacgtatcgggtcctcatgcgcatcgcatggatgagcgccggccccctcgatgtgtcggccaccaccacctccagtggaaggccatccggtgatatacccagatataggaccttgagggggtcctcacgcagcacgaggtcgcgaagcggatgctccaccacgtacatggcgtcatccggttcgatgccgtgcttgagcgccgaggggaatatgttcacggtaatattgtgacacaaaataggcgacgggtcaaggacgtatgggggcacggtccgtcgcggccattgtgatccagtcgacgatcgagattctggtaggtggcgatctcatcctgttgggcttggtcctgcgtcaggtcgcgttgccgttggaggccgcctgccggtggcgttggaggctgtcgcgtatggacgccgatgccgccctggccctcgcccgggcgttgtcttccttccgggattacgtctcggttagatgagccgccctgttttgtccgcatatcgatggcatgcgtcgcatggcttgagtgacaaccatgacaatgatcaggaggaggcgtgcgatgacgggttcggctcatggcggtccggccgacgacaatgatgtcggaggtgttttccgcgtatgcgtgggcgtagaagaatcggctcgttccgccccgtcgacgtggggtgttttcgatgaaccgttgacggatcatgatctgctggtattgtcgcgcgcgtttgatttctcggacgggctcagggagcattgcgtgccggccgcttgggaggcccttgattcgacattggattccggtgtgcgcgagcttgtatcgcatccgccccggaccgaggccgagcttgcagcggccatcgcgggtttgggtcatgccgtcgcccggcgggcggtggatggtgcgctcgatcatcttcagtccagatggctgtaacgctgcacttcgatgatgttgcggggcaatctgttctccgtttccccggatggcgcatgttccgtccatcgtgtggactggttggtccgccggcagtggtcggctatctcctttgatatgagccgcatggtctttcctgacggttcggacggtttcggtcagctggggcatgtacatggtcccattatccccaatatcccttctttggcccgatatcggcgggattcgggccggcggcggcgtggatggccggattgcgtgtcgtgtgttgggaggcttgcatggctggtggcgaggggaagcgggggtcgtcgggcaaggcgttcgtggtggccggcatggcggtcgcggccccgctgctcacggtcgtggtcgtgttgttgtgcctggtgatcctggtggtcgcgatcctgcagtcggattacggcctggggacgcgttgcgtgacgggctcctcatcgtgggtggattgggcggtgtcgatagcgaaggacgataagcacgggtattcgcagcccaaccgcgggggcgacccggattacgactgctcgtcgttcgtgtgggcggcgctgcaccatgcgggattcgacgtgggttcgagcccgttcaacactgacggcatggattcggtgttgaaggcggccagtttcgaacggtcggatttcagggatgtggcgtccctgcaggcgggcgacgtcgtgtgggcggacgggcatacggagatctacatgggtgatggcgagttcgtgggcgcgcattgggacgagaggcatggggtcgagggcaggacgcccggcgaccagaccggtgacgagatcggcgtgacgtccacgttgaacgcgcggtacacgcgcgtgtaccgtgcgccggcctcgcagggctcgcaggcggtgtcgggcggcacgtcggattccggttgggacgggatgggcgcggagcaggcgaaggccgcatggttcggcggcctggccggtccgggcaatacgtgcgtctcgtatccgcagggccagtgcacgtggggcgcgtgcctgcgcgcctaccgtctggggtggaagcatgtgggccagtattggggcgatggcggcatgtgggcctcgtccgcggccgcggagggttacagggtgacgcggacggccccggtgccgggcgcgatcgtgagtttcccgcccggcgtgcagggcgctgacccggcggccgggcatgtggccgtggtcgagtcggtggacgcgtcgaagggcacgttcacgatcagcgagatgaacgcgcatggcccggtgtacacgtcgcgcgagctgcccatcgcgggcggcgcgaacttcatcctgcccaaggacccgatccacggggccggcgggggttcctcgtcgacggcgacgtgctcggcgggcgaccaggacggcgagaaggcgagcgtggaggaggcgaagaggatcgcgaagcgcaagatgaaggacatgggctgggatgacggttcccagttcgagtgtctggacacgatcttcaccgaggagtcgggctggcggtgggacgccaccaacccggacagcggcgcgtacggcatcccccagtcgctgccggcggagaagatggcctcggccggccaggattggcggacgaacgcggccacgcagatcgactggggcctgaaatacatccatgacaggtacgggacgccgtgcggcgcgtacgcggaacgcagggccaagggctggtactgagattatcggcgtccgttcgggtggtttttccgggagcggtcgtctcatggcgttcccgggccggccggcgcatgattttcttctcttttttcccgtgcgccggcgggccgctttccttcacggccccacgcccctcccccgggcgtggggcctttcctttctttccggcccgttatcggccgtgggccgtgccggcgcgtggtggatgcgcgggcccgtgttgtcgggccgtggaggcttgtgatgagggaggccgtgatgtccgggatggtgttggccgatgattcgctgatcaacctgttccccgatcccgcgtgggatgtggcggggttccgtgacctggcgggaggcgtgatagcggtgtgcctgtacgcggcggtcgcgatggtgatcgtcggcgtgctgaccctgctgccgggcctgatcacgaacaacatgatggagcgcgccttctcctggaagcgtctgctgtgcgcgttgatgatcccgttgacgatcggcgcggcgacgagcgggttcgcgtggggcgcgggcgcgttcggcacggacgggctggccgtgaacgactcgtaccagtccgcgaacggtcatcccgactggaagggcgtgaagaacgacgaggcgaagaagtcggacgatctgggcggcgtggtccggcagttgggcgaggacatcgcgaaccgtgtgggcaaggccgcgggcgacgcgatcgacaaggccctgtcgacgggcaagaaggcgtggcagtggctgtccggcggcgacgggaagggcaacgtgttccagaaggccggccaggcggcgggcgacgccgcttcgggcgcctgggactggctgtcgggcggggacgggaagggcaacgtgttccagaaggccggggacgccgcgtccggggcctgggattgggcttcgggcggcgacgggaaaggcaacgtgttcgagaagacgggccaggcggcgggcgacctgtggtcgtccctgttcggctgagccgtccggcccgttatcggcatcgggcgtcgtacgggcccggtggcggtggggaaaggagggtgaatcatgaccattattcatccaatcgccgccaccgcgtccgatatcgtgctggcgttgaccgacaacgacctgtccgggttctccgtgtccccgaactggacgttcttcccgttcatgagcctggtgtcgaacatcgtgggcggcctgtgggctttgggcatcttcgtggcgacggccgcgtggatcatcgccgcgttctcctgggtcgtgtccaaggcgatccacaatagcacgatgcagcagtacagcggcatcgtgttcgtgtggatcgcgctgggcatgatgctgctcggctcggccatggcgatcgtcaagttcgcgtccacgcaggccctgttctgacctcggggcccgtccccttttcctccgggcccgtcccgccgtcggggcgggccctttccttttctcgtttttccgttgttgggaggctgtcgtgggcgatatcgtcgaggcggtgctgcagaagctgttcccgtggatgctggacccgatgggcaaggcgttgcagggcatgatggtgggcgcgttctcgtcaaccgccggatccgtgtcgtacgcggagtggaacgtggcgatcacggccgcgaacaggatcggctgggtgatgggtttcgtgaacatgctcatctgcgcggtgggcgcggtgcatgcggccgtgaaggccagcccggcggagtcggtcaagtcgttcgcgatggcggtgctcgcctggccgttgaccgcgatctgcgtgagcgtgatgatcacgtgcgaggggatcgtgagcctcctgtccgcgaggatcctcgcggtgggcgcggacacgaccaagggccggggcatggagtcgatggtgtcggccatgttcaagaagatcctggagcaggcgtccgtcctgcattcgctgacgatgctgctcgtctatctggtgttgttcgtgggcgtgttcctcctgtgctgcatgctcgcggcccgcaccctgtgcctggtgctgctggccgcggtcgcccccttgccggtgatgagcgccggctggaaggcgacccggccggcgatgcgccgctggctttcggccgtggtgggcgtgatgctggccaagccgttggccgcgctggtgatcacggtcgggtcggcgctgatgacctcgcagaccacgtcgggcgtgggcgagggcagtttctgggatctactggtcggcatcgccgcgatctacatggcctgctattcgccgaagatgatcatgccggtcgtgcagttcctgggcgacgaccggagcatgggcatgcagcaggccgcgagccaggcgggccggaacgcgctggtgaccgcggcccagctgacccggcaggtcgtgaccgcggccgccggggtggcgaccggcggggccgcggcggcgggcgtgcagttgcccggcatggcgcagggcgggctggccgccctgaccggccaatgggggcaggtcggcgaacaggccggaaaaatgctcgccggctccaaggccgacggcaaggacaaggatgatggcggcggggcccgggattccggcgcccatgccgccgacccgtcgaaggacgacgggtacgagccgccggtctccgctcccccgggcccggatggctcggccattccggcgcccgatggcgcgtcgtccgccggaaccgcgcccggcggcgagggaggggacggtggccggggcgtcgcgggccgtgacggttcggacggtgccgacgggatcggcggcgagggaggccggggcggcgccggcggcgagggccggcccggcacgccgggtgccccgggcgatccgggacctgccgggatgcccggaccggacgcggcgccggcgcccccggtctcgccacagtcgccgtcgggcccggtcctggcctgacttatcgatgcgttgccgggtggcgtccccgtatgggcggggatcgcgcccggcccttttttcttttttgattggaggttgctgatggtggatgccgacggcagggacgacggggcgagggtgcccacggcggcgttcagccgcctgtcggccacgaacgtcttgttcgggtggacatggccgcagatcggcgtgggcctggccggcctggtcatggtcgtgggcggcgcggcggcgggcatggtgctgccgttgatgctcgcgggcggcgtggtcatggcgtacgggctgatccgttacgaggggttgagcctgatggcgtggacgtacgtatggctggcgtggcggcggcgtgtgcgcgacgggtcgacccgatggtcggcgagcccgctcgcctcgggccggccggcgggcgtgctgggcgtgtggggccaggtcgagtcccgggcccaggtggtcgaggggtccggcgtggaggtggtcggcaccccgttccatggcgcctgctacctgttcgacccggaacgccggcgggcgaccgcggtgctcgcgttgaaggtcgaggagtggacgttgagcacggatgcgtcgaaatcgtcgcgcgcggccgccttgaacgatctgaccgcccgtctggcggacacgccgggagtggtcgagctcaaggagaccgcgctcctgctgccgggagccgcgcccgctccggacctgcccgacgatggcgggtcgccggagtggatgcgccgcgacatggcggaattgtgggccctgccggaggtcatgaccccgttggcgaacgtgagctacgtgtccgtgacctgcgacgtggaccggctcaagggcgtggaccacgcccggggccggctcacggaacgcgaacgggtcggggtcgcgttgggcgacctggtgaagatgaccgtcgccccggccctggtcgaatgcggggcgcgccccggttcggtgcgctggtgcggcctggacgacctgcgcacgctgatccggtcggtttcggatccggccggcaacgcggaccgtcctccggtcacccgcgacgagccgacgctgggctggtgcgaggagagcctcgacggggagagcgtgaccctggaatcgtgcgtggcgcgcacctggtgggtgacccagtggcccgaccggcccgtgccggcgggctggacgcgcgacatcctgcagggcggcaggatgatcgccctgacccatatctggaggcccatgagcatggagaaaagcgagaaggacctgagggaccgcgagtccagcatcctgcagcgcgacacgttgcagaaccagcggaaactgtcgcgcgacgaacgccgtgagcgccgcgagcagcggcagcgagaggcggagcaggacgcgaactggcccgacaccgaccatcaggggttcatcaccctgttcgccccggaccgcgacatgctggccgtgttcgaacgcgacctgcgcgtgcgcgtcggcaagtaccatctgcgcctgtccggcctgcgcggccagcagcggcaggcgttgaccgcggtcctgccgctggggttgtgaccatgggcgcgcacggccaggaggactggttcgacgaggtcatgcccgggttggacgacgggcggcctggtgggaaacggcgattcccatggcccggccggcatgggaaggacgacggggacgaggccgaggcccgcaccaggccccgtatcggggtgcgtgtgggcgtggcgacggtgatcgtcacgggtctcatggtcacggccgggctgactgcgggcatggtctccgcgaaccggcgcgaacggctggccgacgcgtcggcggcgtgcgaacgatccgcccgggcatggtccgcgggatcggccgcatggggccgggaccgcgaccggatcatgggatcggtcgacctcgacgcgctgcgcgccactgaccccgatatggcggacaccctcgaacggctttccgccgaccccgtcacgccggccggatgcacggccggaggcgacacggcaacgctcgacgcggacgcgaaacgcatctccaaggccgccgacaggctcgcgaaacgttcggaacggctggaaaaggccgtggcgaaagccggccagacggtcggcgacgccgaatcgtcacgggccaggagccggctcgaacatgccgtggccgacgcgcggggcctgctggcggggagcacggcggaccagtacaaggtgccgtacctgtaccgtcggctcgaacagctcacggaacaggcggcggggctgctcgacgacgggtccgcgtccccggcggacatggaccggctctcccagggcatcgactccatggtcgcctcgctcgcctccggcacgcgatgacgggccgccatacggttatcggcccggcgcacgcgtgtacggacaaacggatcaggaaacaggaaggaatcggtcatgccgtgtcggtcagagcgttccggactcatcgaacgcgccatcctcgcgcgatcaatgggggcgggccgatgatgcacctcatactcgtgatcgccgtcgttttcgttttcgccgcgtcctgtctgctgacgttcggcctgtgccgcgcggccacgcgccgcgacatgctcgaggcccgttggcgtgaggagtcggccggttccgtgggtgaggagagccatgagagcgcatgaaacgcttgagcgtgccgggcgtcatggcggcttcccggcccgtggttccgcttcgggcctgttggcggcctgcccgtcggacggcagccacgacttctacctgtcgatgatgctcgacgttcccgtgccgcgcgtgcccatgctgcgcgcacgtctgcaagactcccgccgaggggcgcaacgcgcatccgacgcacaggaagctggccgcgtggtgcaagtgcagcgtgggcacggtcaaacgccatttgtcatggctggaagggggacgtgtggtgatggagcagcggttccgtctgcgtgacggttcgccggtcgtgccgcgctggcgccgttgacgatataggcgtccttcgtgggtgtcggcgtcggcgatcatgtgctttttccgttcagggaggtttcgtatggctgatgctcctgccggggtccgtgccggcaaggccgggggtccgcatgggttgcgggtcctgtccccggccgatccggggtatgtggagtggtgccggtccggcatgccccagaggatccgtctgctcaagctcgccgccgagaaacgccgccggatcgagcagggcgtgatctgtccgaaatgccataggcgccgggtccgtgccggcgacacgttgtgcgcccagtgccgtcacttggaggatctgccccgctgccgggaatgcgggaggcggacgagccgtcccgtggacgggttttgcgcccgatgcctgaaactggtccgggaacaggccaggccgatgtgcccgaaatgcggcaggtgccggtgcctcgagggcgaggacatgtgcggcaggtgccgggcgcaccgtgtgttgccatcctgttcgcgttgcggcgcgccgcggcggaagggttcgccggacgggttgtgcggccgatgccggcagctcctttcggggaaggcgaggacatgaacccgatggacgtggccttggaggccctgtacttgctgggtgtggtgctatgctgcgcgctcctgtcccgcgaggagggctcgcgcgagggcctgggttcgcgtcgcgcccgcctgttcatgctggcgttggcggtggaggcgatgcaggcggggttgggttcgctcgcgttccgggagccgtggggcgcgccgttcgcgccctggcaggcgttcgacctggcgggcgcggtcctggcggacctgttcctcgcacgggccctgctgcgcggcgacggcggggctcccggtccggactaccggtgacgcgtaccgccggtcattcctcccgttcgtgttcgtgttccacctcgaagcggatcttgagccgcgtacggccgcggcgggcatggcgtgcggcgcggcttcgcccgccgccgttttcccggaggccgtggcgggtgtggcgtccccacgcatgaacgtgggccaagagttttctcgcggccgccatgacgcgcaggagcgacagcgccacgaggcagccgatggcgagcagcgccaccaggtcgcggttccgggcggcgggcaggttctggatgatttcgaggaggtcgagcatggcctcgatggtgtttgcgatgtattccatgtgccgctgtatgcgtccgacgcccctgctcatgttcacgtctgattcccggtccgatgacggccgagaacgttatggtcgtccacccgccgaaatcggtgccgccgcgggtgatcgcgccatggggaaggaacatcctgaatgattggccatattggatcggagtgcgggaggaaggccctggactttctggccgtcgggcggtcccgcctcactgcatgtcggctgcgcggccggcgggctgcatcgtccggctcacactggaccagaaccggacatgccgtcgaaacccctataattgtcatgtcgtcagaacaagcccggagaaggatatgccatcaatgcttacagtcgcggagacggggagcttgtccgttcctctcgtctccaaccacgatgtggcttcgccgttgagatatcccggcggcaaaagcgtgctgtccgggtacgtcgcctcgcttatcgatgttctcggcattcgtgacgtcacgtatgtcgaaccctatgccgggggtgccggtgtcgctctgcgtctgttgaaggaccacaaagtatcgaaggtagttatcaacgactacgatcccgacgtgttcgcgttctggaacagcgctgtcaatgattcggcttcgttcctggaacgattcgaccgggcggaacccactatcgaggaatggcataggcagaaacgcatcatcgcggaccctgccagcgagctggacagggggttcgcgttcttcttcctcaacagaaccaacagatccggcgtgctgaacggcggcgtgatcggaggattgaaacagaacggtagatacaaggtttcggcgcggtacaacaaggcctcgctaagacgaaaacttgaatttctcggggaacacgccgactccatcgaggtcagaaacgaggatggcagggccgtggtcgaacgattcgtcggattccctgaggcgttcatctatgcggatccgccttacgtggagaaaggcggcagcctgtatatgaacgccttggacgatgagaggcacagggagctcggaaatctgctgaacaatcatgccgactcccattggatgctcacctatgacgatacggcgttgatacgcgagctgtacggggaacggtacggtggcctgtttcctttgcaatacagcgcctccgcccggcgcaccgcgaacgagctgatgatcttttccgatacactgggcaaggccgcagcccacatgcactgacgcgaaggagaggacatggcgaatccgttcggggaaaagaatatcggcccatgggagggccagcaggtggagtacattccgctggatgatctggtcctgtggacggagaatccccgcgatccgctggatggcgattacacgaacgacgatgtcatccgtcgcgcaaccgacggacgcaacgacaagcaatggcagttgtccaagctgtcgaaagagatgggcgacagattcgatttgagcgaactgcccacggtatgcagaatcgatgacggaccgaagtacagggtatacgacggcaacaggcgtgtcattctggcgatgctccgcaaggccggtctcactactgagggccagcaacaactggtgcctccggatttcccagaccccatcccatgcaacgtgtgcgacgaagagaccgcgctggagaatgtggaacgcaagcacagaggtaacgggagctggaagcagtacgagcgggaccgtttcatgtgttcgactacaggggaggcccgaaaaccgttctcatacggctggaggagctcatcaaggcggtgacgaaatggcccgccctgaacatgagatacgtcgaagatgacgtcttcaacaaaaagcatctcgaggagatgggtcttcttcccgacgagccggacttcggggttcctctggagctgctggaggagctcgtggaggccgtcgccgacaaactggataatgagctgaacacgcgcaacgcgcgaaacgaccccgccagcgtcctaccgggcgaactcatggaccgtatcagagaagcacggcaccgccgaccggcgggcgaaaaggccgacggacgggaaagggaacttccctccgacaattccgagcctccatcgcaatcccatggtggtcttggccgggatgatgcgcttcgccccgatacgtccgggacactcccccacaccgatgcatccgccaggaggcgaaggggacgcacccgtcaggtcaagccggcatccattcccgtgttcgggaacccttcgggtctacggctgcagacgggagacgtcaacaacatgtatcgcactttggaggaactgtggaacatgtatgcgcgcggaggcatgcggaatgccgccgcgttcgtgccgatctttcgcatggggctgcgtctgctgatcgatacggccgccatggaacgatgcggcggattggacagatatgtgggcgagtatgccggggaagcgaaaaaacgtctcaggcaggcggcaaacagcgctgatctcgttacctttatgcgcaaccaggcggtgtcgccggaaaatctgctccgactgctccagaacggcgcacatgcgtatacttcgaccgggaacaaggaacaagccctagccatgagtatcctgatcggggaaatgctttcgatcagccacggacgtccatgattcgggggaacggcgtttcatgggacacaagactgtggcagccatttaccagcaaatcgccgtgacgggccgagcttctctataaaccgggtcgcgcgttcacggacggtccggaatccggccatcgcgcacagagtttttcactcctcatcaagccgatacgggggcacgttcggcgtgcatcatggcatgagacgtcacactctcatgggacgggaaagaatttccggctgtcggaggacaatcgttttcgtatcggctttccacatgagaagggggaaacatggaacacggggatgacggtcgttcgcgggatgatgtcatggacggccccgcattgccgccggatgagtctgggcggatactcaatccgttcaggaaggccttcgcctgggcacgcgtgcgtctgaacctgtcgggagagcttttcggcacaccgcagtgtcctgtcgcgcggatcctcgcacccgtcctgaccgttctgggagcttcgatcctcgtgtgcgatctgttcgagagcccgtggagggaggtcctggccttcgcagctctggcggccgccttgttttccgtgggatacaggcctcatccgctcgacgcgttgaggaggcccggcaagcccatgcggtggttcctctgtctcgggtgcgtcctcgtcctgccggttgtgaccttctatatatcggcactgctggtttccctcatacccgacacgtcggagaacgcgggtatcgccgcgacggacacgttcggcgagtatgtggtcatgttcatccagatcatgggcgaggcgtgcctgtcgattcttctgttcgcgctgctgtataaggccctcaatcgggcatggggccggtcggatccatgggtccgttccctcgtcgcgtggctggtttcggcctttctgttcggcatgctgcatctgcctacgtatagatggaattttctgcaatgcttggtcatcttcttctcgctgttcctgggattcgccgcgttcgtcgcgacgcgcagctggacgattctgttcctttcccatttcctgtacgacctgctcagcaggcccatggtgctgaatgcgtgccgatacgccgcccttctgtggctcctggtcgccgcggcttgcgtgtactggcatttcgggaaggggagcgccagccgtccggcttcccctcccgctcccccgatatcggcggattgtcgggtggatggcatgccgggcggcgggatcgccggccgtggcataggatgtgttcatgcggaccgtccctctctcccggagggggtgccggcggttggtccgatgacgggaaaggaacgaggatgagcgaagaggacaaggtgccgtccccggacggcgcgggcgtggtgcccgagcctgagacggttcgcaggcgtccgaagtggctggcgcccgcggccgtgggttgcgtgctggtgctgctcgccgtgggcggtgtggccggctaccgtatgtggtcggcgcgcgaactggccgaggcgaaggaggcttgcgccgtggcggccgacggggcgcgtggcgcggcgaacgactacaatgcggtcgtcaacggccaggccgccgacgcctcggcggtcaccgtcgaccaggtgaaggacgcgaggaccgtggacgcgctggccaaggcgttgaagaccacggtgcccgaatacgaggggtgcttggccggttccaaggccggtttggacgaggcgacgtcgaagctcgacaggcaggccgcctggtacaagacccatgccgcatcgctcgggaaggccgtcaaggcggtggaatcctcgaggctggacaggacggtcgaggacgcggagaagctgctcgccgattcgaagggcagggtcgccgacgagaagacccgtagcatgttggagcaggccatcaaggacagggacgcggacgcgatcggcgaggccgtgaacgcggtggacgggtcggtcaaggccaaggcgaaggccgacgccgacgcgaaggccagaagggaggccgaggagaaggcccaggccgaacaggaggcccaggcggcggccgacgcggcggcggcccaggcgcaggcgcagcagcaggcccagtcctatggcggcggctactcgtacggcggcggcaccggctacaccggtggaggctacaccggcggcggctacacgggaggaggcacgtacacgccgcccgcgaccggaggcggcaacggtgggggttccgcctccagcggaccaatcagcggaggacacggatgtactactgattgtcctccaccatcaagcgacggtctgattcatcattaacgactatcaataaagtccataagggtcttgctcgaatttcgggcaagaccctttttatttccaagttctcttttccctgtgtttttcctgtgatatcggtgtggtttcccggggtacgcgggtgggggtcgtggagtccggcctgtgggacgggttccgtgaggggcgggagaggcccgtcctgttgatcaacacagggaggagacccttatgggttttcgtcatgatagggcgtcggccgggcggagtcatgaaccgctcgcgcgtggcgcgcatggggcggggccggcacgcacggtgcttgccggcctggtggccgtggccacgctggccacgggcggcctggtggcgtcgaccgcgtatgcgggcggcgcgggagacaaccgtccgggcggcgcgaccggcggccttcccgcgggcatgttctggcagtacaaggacgacgcgtccggcagcttcggtccggccgcgaacgccgacggctcgccgcgcatcgcgtcggtggaggccgcgtacaagcgtgccggcgtgagtgtggtgaacgacggcgtgtacgacgggccgggggcgatccgcgatacgttgcggggtgcgttgtcgaagtgcgtggccgggttccgtcagcgtcatccgggcgagggcgacggcgactgccgtgtcgtgggcgtgggctcggtcgccggccagcagggcggcagatgggtgtacaacgggtccggcggctattcggcgtccgagtggtactcgtcctgggactcgcagatcaaaccgtatacatataactatgccggcacacaaagctaccgtacctcagatggctttgatgatgatccgtcgaacagcgtggacaagatcgcgtattcgaacgtggctgcggccgacgcgacgccgaacctaatcatcatcgtgctggacaagtaccagccgaagccgccggagacgcctccggccccgccgacgaagaaggtggagcagggcacgagcgctgatggcatgtcgaacgagacggtgatctcgacgggcactggcgtgggcggcaagaggatggtcgtccaggatgcgatcgatccgaacggcatggcgtacaaggtcacgggccagaaggtcacggacacgaccaccggccaggacgtgtccgcgaagttcacgttcaacacggcggacgggcagccggccccgaacgatgtggccacggccacgtggaagggcggcgacctgccggaaaggcacacattcgagtaccgtctgaccatcacggtctcgctgccttccacgtcgaaggtcacggacacgccgtccgtcacgtggaacgacaagggcacgggcaaggccgacggccacgggttcccgacctggcagccgaacccggacaagagctggatcctgtaccgtgacggcaagtggcaagccgtggtcgatccgggcgagacgaacaggaccggcgcggacgacatgaagttcctcgacggggacacggtcggctccgcggtgaacggcaccgtggaccccggtctgaaggaggctccctccaagctggagctgaccgacgactgggccgccgccgactatctggtcgacccgcaggacgcgtcgaagatccgcgtgttcgcggccgaggccgagcccgaccgcaccgacacggtcgacggcgccacggtgaagcactacacgcagaccagcgtcgcggacatcgcgaacaagggcaccgacgtgaccgacatgttcgacatcaaggtcgagggcaccgtggcgaccgccaccgcgaaaccggactatttgaagaccctgaagggcatgaggaagggcctgcagctgaccctgctcgtcccgttcaccgtgaacttcgcggacggcaagggcgcggcccgggtgcgcgaggacttcggcaggaagccgggcgacgaggtcacgttctgcacctcgccggacggcaaggagctgaccaacaagggcagccagaccgtgaacgggcagaccgagccgaccaacaagccgaagatctgcggctacgtgcctccggtgaagaaggacgtgatcgcggaatcctcgcagggcggcggccaggagagcgtggacggcaaggtcgtccacccgggccagaaggtcgagtaccagctgaccaccgagccgaagctgcccgccgacctggccaccatggtcacgagcgtggcgttcacggactcctatgacgagaacctcgtgccggacaagcagaccgtcgagatgatggacctgaacaccggcaaggtcgtgccgaagtccaagtacgcgaccaggtgggatgaaggcaggcacctgttccagctgaccgtgaaggaccagtcgctgatcggccagtggcgcgcctcctccagcccgcgcgtccagatccgcttcgagggcaccgtcagggaggatgcccccaccgaccacaagatcggcaacaagtgggtgctgaccctgaacaacagcctgaccccgtcgaacgaggtgttcaacctgccgcccgtcttcaacccctcgaagaaggacacccagtccaaggagcagggcgacccgaccgtctcgatcgacggcaagacgatgctgctgggcgacaccggccactacacgatcgacctcgacgccacgcagaaggaccaggcctacaaggtatggcgactaggcctgacggatgatttcgatgacgagtacgtgagcatcgacccgtcgaggatcgagatcacgggcgacgacggcaaggactacaccaacgcgttcaacatccaggtgagggacggcgtcgcctacgcgtacgcgaagaccgtggacaccgagatccccgcgaccggcgagaccgtgaagggcgacccgcagcccgcggacctgaaggcctacagcgagaagtccgacaaggaccacgacccgttgaaggacccggccatcgaccagtcgctgctcggccagcactacgcggtcaccctgccctacacggtggtcaaggtcaccgacggctacgtggtgaagaacaccgcggtccagatcgtcaacaacgtgaggaagaagaccaacaccgtctccaacccgttgaagccgatcaacccgaagaaggacgtgaccgtgaaggtcggcggccacagcgtcgacggcaggagcgtctacctggactccacgttcctctaccagctcgacagctcgatcctgcccgcggaccgcgcctaccagaagatcgcgaactggggcatcaccgaccagctcgacccggcgtacgacaaggcgaccggccagtgggccgtgtacgcggcccgcgacctgtaccggggcggcgaggccatcgccaggaagggcgagagaatcgccggcagcggcttcgacagctcgaggctcggcggcgacatgttcaccgcgaacatcgacccctccaccggcctcgtggacatccaggccacccaggcgtacctggacctcgtgtccgcggacgacgcgcacgagcagggctggcgcgcctacgtgcaggtcacgcgcgtgaaggtcaccgaccgccacgagaacgtgttcaccgagcacgtgaacggcaaggacctgaccagcaacatcgtgtggacccgcacccctgacctgaccccgggcatcaagctcgagaagtgggacaggaggagcggctggccgaagggcgaccgcgacgactccaaggacgcgctcgacggcgcgaaggacggcgacgtgatcgtgttcacgatcaccaacacaagcaaggacgacgccggctacggcgcatggttcaaggccagcgacctgaagctcgaggaccacaccatcgtcggcgacggcgaggtgaaggacctcaagtacccggacaactggtccacgctggtcctcaagcccggccagagcgtcgaggtgaccggcacgctcaccggattcaccaaggacaggcacaccgaccgcgccaaggtcaccggcaccccgttggtcgaatgccccgtggtggacaaggacccgttcggcggcgcctccggcaagccgtccacaggcggcgaagccggcgacggcgacggtcccaggcaggtgaccgtcggcgatcgcacgctgtgcgaggacacgcccgtcgagtccaacaccgacgactggaacggccgccggtcgctgctgggcgagaccggttccgcgatcctgcccgtcggcgtgggcgcgctgctcatggccggcatcggcgccgccgtcgtgatggtccgccgccgcaagtcggcgcatgacgacacggacgcggccctcatgccgcgccacgccgcctgacccgacggggcccgtcccatgcgcgtcgccgcgtggaagggccccttcccggggccggcatcccgaccgggacgccggcccctcatccatgcaacgacatcgatcactcccctccctgtcggggagggggcgggcgcggcatgcggccgcgcccataggagaaggacacgatatgaggaacatcatccgcatcggcgccggcacggaccgccggaaccggttcgtcgcgatcgcgttgggcgtcgccctggcggccggaccggccgccatgatgcccgcggcggcgctggccgcgccggccacggacgccgcggccgcgagcacgacggccggcacgaccatcacactgcaaggcgcagacggagcaagcctggccggccacacgttcgacgtgtaccggatcggcacgtacaccgaccaggtcctggacggcgcgcagatttccagtctcggcgtgcgcggcgacacggcatccaacgcgtgggcggccgacgcgatcggcatcgccaacgcgtacgatccaagcacggccgacgacatcggcaaggtgtacggctatgatgacgcgggcaacatcgccaacatcaagatggactcccaggccaggcagttgcgcaacatcagcaaggccctggcccagtcctcgaggcggccggccgccatccagggcggcacgaacctgacgaccacccggtccacgctgacgatcaacgtgccctccgagggcctttactacatcaccgattccgcgggcaacccgattatggtcggcacgaaatccggcaacgcgaacatcatgaagaacgacgcgaaggacccgcagtggcggaccctgggcgtcgcggtcgtcaaggcgaaaagcgtgagggtcgacaagaaggtccaggtgcagcgcaacggcaccacggtaggcaaggacggcaccaccaacgatccggtcggcgtgaccgtcggcgacaccgtcaccaacacggtcgaggtgaccgtgccgaacaagcaggccgcatccgccgtcaagttcaagctcatcgaccagccgaagggccagacgtacgtgaagggctcgctgagcgtccggctgaagaacgcgccgcagaccgacatcacggccgacgcgggcatctacgacgggaccacgcagaacaacgcgaaaagcatccccggcgacccgaccctgaagaccgcggacaacaagcccgccgacccggatctcgccatccccgcaggcggctggggcatcgacggcaggaaacttctcgacaaatactccaacaggacgatcgtcatcacctaccgcatgaccgtcgacaaggccagcgtcaccgacccggccaacaacaccatccacacgtacggcacgttcaccgacggcatccacttcacgaccatcaccgaccaggacaaggccgacatcaaggcctacgacttcacgctgcggaaggtggacgcgggcaacgtgaacacgctgctcgacggcgcccggttccagatccagcgcaacggcaaatggatgaatctcgactggaacaccggcaaatggtcggatgcggccaaccaggatgccgccaccgtgttcgtgaccggcgacacgaaccatgacgggacggccgacaacagggacgacgcgagccagaggggcctcatccggttcaagggcctcggctacggcacgtacacggtcaccgaaacccgggagccggccggctacgccagctacgcgaaaccgacgttcaccgtcaccatcgacgacgcgggcaccagcatccagtacaggggcaccggcaccgtgccgaacctgaccggcaggctggacaacaacaccgtccaggtcaagaacgtcgcgaatctgacccaactgccgcagaccggcggcgtgctcgcgttcgcgttctggctggcctgcgccatgcccctgttcgcgatcggcggcaccatggccgtgcgcggcgcgcgcaaccgccgcgacgcgctgacgctcacgcatgacggcggcaatccggccgcctgacacatgtcccggccctccaggccggggttccgccgatagggggcggggtcgcgtcccctatcggcctctcatcaccgaatgattcttttttatccggcccgccacgaggggttcgtacgggtcttggcccatccgtcggaagacattgcgagggatgggggaaggaaaaccgataatgcgcacatggctgaaacggatggtcgccggcatcgtgtcggcgggcaccctgatgggcggcgggctcctgatggcgggcaccgcgaacgcggacgagatccgcatgcccgacatcggcaagaccatcacgagcctgacggcatcggccgccacgacgtatccaagggagctcgtcaacggcggattcgactacctgcccgcgggcggctggaacgtcatcagtcccaagctgaacacctcaagaggcaagttcacaagcgtcgacccggtcaacgggcagtacatccgcaatgcgcatgtcacagatggaaacgtcgcatgggtgaaatgggacggttttgatgcctccaaattcgggtggatctccgaccagaaaggcgggaaaccccaaggcttcgtcaccgaccacgcaaacagcgtcgaattgcagcgggacaatgatacggacaatacgtatgcggagatcgtcggcagcgaaatcggcaaaagcatctatcagaagatcgacacgcagaacagcactgacgccgtatacacggtgcgcttcgaccatgcggcactgagttccgagcatgccgacgggatgcaggcgctggtcaacggcaagcccgtgaccatgacccgaatcggcggcaacaaggccggggacaagaccggttggacgggtacggacatcgtcacccacgcgaccaacacggatcattaccgtcatgacggtcagtgggcgacctacgagggcaaggtcacgatcccggcgaacacgcctgtcagcacgttcatgttcaaatcgctgaatgaagcgaaacccgacatgggcaacctgatcgacaacctgacgttcaagatcgcgtacaggctgagctacgactcgaacggcggcacgaaggcgaaggccagccagatcagttccatgaccgagggcaaggtgtccgagaccgacggcaaggtgaagacggtggcggacgacgcggccggttccatcccgtccaacgaaaccgccggcgccgtcaagcaggccaagtcgaagaccaatggcagcgtgcgtctcgcggcggatgacgatgtggcggaatacgccgtcaacggcctgccggaccacctcgtcaacggcgacttcgaatacccgaccgccgacatcatggggaaatcgggcgggcgattctggtatatcagccagaacgacaattcatggtgggcgaacgcgaaggagaagcgctccacgctgcccgccggattcgacaagagcaagttcgcatggcattcgacgcagaccgggaacacgcactatccgatcctcgaacgcgctgatgacatacaggtcgattacaagggcgacggcacgaaccattacagcgagatcaccgccgcgcaggccggatccacgctctatcaggacgtggccaccacgcccggcgtcatgtaccgttggagcctcaagcacgcgagcatcaactcggcgaacatcgaccgcatgagcgtcatgatcggcgaacccggcaaggagaccgctcaggaggcgacgcgcgccaccgtcaacgggaacggcgacaagaccggcaaggtcggcaccgagatcgccaccaaggtctccaacagcgcgtccgacgggtgggaccacaccggccagtgggagacgtacaccggcacgtacatcgcaacctcgaccgtcactcggttcgcgttccgcagcatcgaaggcggcggcaagacgcagggcgaatcgtgggacggcaacctgctggacgacgtgcagttcaccaaggcgtacaagctttcctacgataagaacgcttccgacgcgaccggttccgtcccgtcgaatcagcgtggcaaggagaacgccgtcgagcccgccgaatcgaagactaccggaaacgtgaagacggtggcggataatacgtcgaatctgccggaccatctggtgaacggcacgttcgattatcgcggcaacgagatcatcaacgagaaccagagggtctacggcgacacaacctacctcgccataatcagcgcgaagaccggcgtcatcggcaacccgctgcacagcaagctcgacaactgggattccggcaagttcggctggaaatccaacgacgccaccgccggcgtcgacaccgtcgaggtgcagcgccgcaatcacaccccgtatccgaccaacgcgggcaacgtgtggggcgagatcgccgcagccaagcggggcaagtacatctaccaggacatcgccaccacgcccggcgtcgtgtacaggtggagcctcaagcacgcgtcccgcaacgcgggccaggacgacagcatgcaggtcatgatcggtgaacccggcaagaccgtcgcacagcaggcgacccgcaccacatccaacgggtcggacaagaccggcagcgtcggcaccacgatcaccacgcacggcaccgcgcaggacggcaagtgggagacctataccggcgactacctcgccacctcgaccacgacccgcttcacgttcaggagtgtcagggactccaacggtcagggcctcgacttcaccgccgagggcaactgcgtcgacgacctaagcttcgacaaggcgtacaagctctcttacgacaagaattcttcggacgcgaccggcagcgtgccctccagtcaatacggcaaggagaacaccgtccagcccgccaagtccaagaccacgggcagtgtcggactcgcggctgacaaaaccgcttccggcctgacggtgcatgatctgaagaagaacgacaagggcaaggtgccctccaattcgaaggcggattccacgcagccggccgcgttcaaggctccggacgccaaggtggaggccatcgcctccaggtccgcgggcgacgagctggccgtgaacggcgggttcgacaccccgaagtggacgatcgccaaggaggggcagggcctgccctgggtgtatgtgacgcccaataagggcatgatccgctcctacgcgcaggccatggccggacagacgggcgtgaaggccggcggcctgaccgccgccacgttcgcttggcaggatctcgatgccatcggcggcatccagaacttcgaactgcaccgggagaaggacgggaacacggccgccgacgtgcatgcgggccgtaccgtcgcccagaccgtgaacacgacgcccggcgccagctacacgttcagtatccgccactccggccgctccaaaggcaacgcgggcggcgtgacattgctcaccggccccgacaaggatcatctcaccccagtcaaactgacccgcaccacggtctccaagaccggccagaagtacggggacaagaccggcgatgtggggaccgtcgcctacacgcactccgattccatggacgccacggaaggcagccacgaaccgtgggaccattccgacgactgggaatcctacgagggcacggtcattatcccagccggacaatcccgcacgatgatcgcctacaggggcgtcgccaaggacggtactcttactgcctccgccaatgacagcatcatcgacgacctgagcttccgcctcgcctacaagctcagctacgacgcgaacggcggggccaagaagagcacgtcgcagatcaaggcctccaccgatggcaaggtgaagaccatcgccggcaagaccgacagtctgccgaccgaactggtcaacggctcgttcgactatccggccggcctgatcgccggtgtctccaccaaatacccgtgggacgactggaccgtcgtcgacccgatcaacggcagatacgcgcggcacatcggcatcgataaggacccctgggcgccaatcccgggatgggacgcctccaaattcgcatggaagtcgacccagaccaagggaaccgactggcagcagatcgcacagggagtcgaactgcagaaggactccaagaccggcaaccagtacgcggaactcgtcgcgggacatgcgggcaccgccatctaccaggacatcgccaccatcccgggcgtgtcctaccgctggacgttgaagcacgccagcctcgacaggaaccacctcgacgggatgagcgtcatgatcggcgaacccggcaaggaatccgcccaggacgcgaggcgaaccaccgtcaacggcaacggcgaccagccgggcgacgtcggcaaggtcatctccacgaaggtgagcaacgacgccgagtcgaaccatgagtcgaaccattccagccgtaaccatgacgggcagtgggagacctacaccggcacgtacatcgccaccgggacggtcacccgcttcaccttcaagtcggtaagctccagcaacaacgtcaacggcaacatcctcgacgatctgagcttcaccaaggcctacaggctcggctacgacgggaacggcggaaccggccaagtgccctcgcgcaccgagacgggcaggaccgaaaccgccgcatccgggacggatggcacggtcaggcttgcggccgacaagagcgccggaccggaatccggaaccatcgcggacgaccgcagggtgctgaccgacacgaccgccagacaggatgacgggaccagccagcggacgatcacccgatccgacggttccgtgcgcgtggagacgatcgccgacacgggcgccgtatccggctgccaggtctattatccggccggcaccaggatcactttggcgaccgcgaaggccgactccgactgctgggattccagccagatcggcaagaccaaccgcacgttctacggttggagcgcgaacacggacgccaacgacagggacgtgcccgtcggcgacaccatggaccggaacacgctgaacgcgaacgtcaggacggagatcgtcatgcccgccagggcgaagaccgtatacgcattgtgggccatcaaccccaccctgtcgtacaacgtgaacgcgcccgccggcagcaacgcgcccggcacgcccgtatcgcagaccgtgccctacaacacggccgccgccgacaaatccggttgggcggccggcgacacgggcaagattcccggctaccggttcgacggctggtacacggccccgaacggcggaaacaaatacgatttctacacgccgctcaccggcaacgtgaccgtgtacgcgcactgggtcggcaacgggtacacagtcagattcgccggcaacggggcgaccggcggcggcaccccggatcaggcgttccaatacaacatcggccagaacctgcgccggaacgggttcgtccgcgacgggtacacgttcaccgggtggaagcgcgccgacaaccagcaggcgtacggcgacggccagtgggtcacgaacctgaccacgcagccggacgggatcgtcaccatggtcgcccaatggtcggccaacgaggcccacatccgctacaatccgaacccgccggccggcaagaccgcgggaggccagggcacccccaactgggatggccacaccggagacacgccgaccatcggccagaacggctggacgatcgacgggtacacgttcgccggctgggccaccagcccggacgggagcggcgccaggtacgcgccgggagccaggtggacggcgaacggcacgctcaccctgtacgcgcagtggacgcccggccaggccagcctcacctacgacggcaacggggcgaccggcggcaagaccgacccgcagactggcaagaccgacgagaagatcaacgtgcgcgacaacgggttcacgcgcgacggctacacgttcgtcacgtggaacactcaggccgactgcaagggcaatgcagtgaaacctaacagcgagtggacgttgcgtggttccagcaccctgtatgcctgctgggccggtaacgcgcaaaccctcacctatcacggcaacggcgcgaccggaggcaacacggcggcgcaatccggcaagaccggtgacgaactgaccacaaacgccaatggtttcacccgcgacggatacacgttcgttcgttgggacaccgccaaggacggttccggcaccgcatacggcgaaggcaagaacggcgtcagccagtacgtgatgaagccagcaggcaacgacctgtacgccatctggaaggcaaacccggcaaccatccagtaccgcaacgactggccgaacaccacaggcagcacacccgacaccaccggcaacaccggcgacacggtgaccatcagccagaacagcttcgaccgtccaggctacacgttcaccggctggagcaccagcaaacgcggcgacccaagcctgcaaccgggcgacaaacacacgcttgaaccgagaaccaccaccgtgtgggcccaatggaaggccgaccccgcacacctggtgtacaacagcaacatcggaaccgtcggctcggaaaccaagacggtggacggtgttgtcgaccagaccgtgaagaccatcacgaacccgttcgaccgtcctggttacacattctccggctggaacacgcaggccgacggcaagggcaaggcatacgccacgggagccgactacgtgctgacggccaacgacaagtccacgacgaagaacacctccgtgctctacgcgcagtggaaaatcaacggtgccagcctgaagttcaacccgaacggcggcatcggccatgtcgatgacgtgaccggcgacgccttctccaccgtcaccatccccggtgacgcgaaggagccgaagatcacccgacccggctaccggttcgtcggatggagcacggagaagaacccgcccgcagggagcactttcctgcagccgggcgaaggcaaggtcacactgcccgccgaaggcagcaccaccgtgtacgcccagtgggagccgagcctgaccaccctgccgttcacgggcggacaggcccaggtgccgaccatctggctgtacgccggattcgcgctcatgctgatcgcgctcggcgtgatgatgccgatgctacgcatgcgcatggccgcaaccaagcgcaccggtaagcacatgccgatcaccggcggaaagcacgcgaagtgacggcagcggccgaaaccgacgtgtgggagagcgtcgcggatgcggtccgcgacaagcgggcgcgcgacaatcgcgcccgccggctcgtccgccattcccggatctacgcggtcgccgcagtcatctgcctgatcgcgggcatggtgcttgtcgccatgccccgcatccagcagacgctcggcgaccgcgccgttgacgagcaggcgcgatccgtcagccagacggccgcgctgtttccggaatcctcccgtcaaagcgtcatccaatctgccatcgcatataatcagcgtctttatgaaggcggtcagccacagataggcgaacctgtgttcgacgggaagaccgagggcaatttcgagggcgatgccgaataccggcgtcaactgtccgtgaatgggttggatgccatgggtgagattctgattccgaagatcagcgtcgacatgcccatcctccacggagctggtcaagatgtgctcgaacatgcggccggccatctggcgggcaccagtctgcctatcggtggcaagaatacgcgcgccgtaatcaccggtcattcgaatctgaaaggcgcgaccctgttcacccggctcggtgaactcgaagacggcgacccgttctatatcaaggtcatgggtaacacgctcgcctatcgagtcaccagcaaacgcatcgtctctcctaccgacacgaaatcgttgcgtgtccataaggggaaggacgaggtcacgctcctcacctgtacggggcagggcaatacgctgcgactgcttgtcacgggggagcgcaacagcatgcccgatcaggcccccttgcccggagatgccacgggggacgtaaaaaaggcggcttttgtttcgggcgtcaccgtgccggggatattggctgtcggattttcgctttgtcgcagtcggcgtgccgtgggtcatcatataggtttgccacagacacatgatagtgacaatttgcgttagtaaaaaaaggtgatactatatgtttgtgaaacaaaaacacgtaatctcccgacatcggggtaaacccgaaaaggaagacacatacacgagaaagaagaaactccccatgacacacggcatcaccaagatcacagtggcaaccaccgccgtgatggcaacccttgccgctccggcagtcgcaatggccgacgaaaccacaaccaccggcgaccaaaccaatcaggcaatcacacaggcccaagacagcatccagcaggcacagcagagcaccaccgaagccaaccaggccatcgcacaggcatccccgaccggcgtgaccgaagcacaggccaaggccgacgccgccgcagccgcactggacaccgccaagcagaacctcgacgccgccgccgcccagcagcagacagccgcaaacaaccagcagcaggcccagaagaattatgacgacgccaacaaggcccaacagcaggccgcacaggatgcgaccggcacggccgacaagatcgccgccgcccagcaggccgcgaacaccgcgtccaacgccatcaatgacgccagcaaggccatgcggcaggcatccgacaaccagtcgaagggcgaaaccgacaagcaggccgcacagaccgcgaaggatgaggccacggccgaatccgcctcccatcagcaggccgccgacaaggcccagaccgatattgatgcggccgacaggcaggccacggacgcgcagaagaaggccgatgcggcggataccgccatcagtgatgcgcagaagaaggccggccgggccgatgaggacgcgaagcaggccgcggccgacaaggccgccgccgagaaggagctgacggaagccaggaggcagcaggcttcggcgaccggcgacaagacgaaggccgacgaggcggtgaacgtcgcgcaagccaagctggatgcggccaggcaggccgaggccaaggcgcttgaagccaagcggaaggccgatgccaaggtcgagcaattgtccaaggatgatggaggtctttccgacctggccgcgaagctcgaagcggcgaagaaggccgcagccgacgccgccaccgcccagcagaaggcggaacaggcgcagaaggatgccgacaaggcggtgtccgactcctcttccaacgccgaggcgaagcagcaggccgccgccgatgccaagagcgaggccgacgccaagaaggaagcggcagacgagactcaggacaagctgtctcagggcgcagtggcctacttcggcgacaagggtgcctctcaggcagtcaaggttctcaccgatccgaccgtcaccgagtatcttgacgccattcataatggtgccaagggtgatgcgaccacgttggacaacatgatcgaggccctgaagttcatccaggaagccaatcagcttcgcgcgaaggaaggcctgcagcccctcaaggtcagtgacaccctgatggcacaggccatggcggatgcggattatgccaacaacaacgtgaaccatccacttcaattccccgccagcgaaaacctcgcctggggttacactgatccctttaggggctggtacgacacggagaagtccatgtatgagaaggacatgtccgacggtgtcctggattgcaaggcctcggacggcaagcccgtcaaaccctgcgcttatggccattacaccacgctggtcaaccccgatttgaccctcaccggtttcggcgtcagccagaacggcaacatcacgggtatcggcgggaacacccatagtcagctgttcaccgaaaacgctaacggaatcggctccgacgcgggccgcatcatggacgttgacgcatacctgactgatttgactgcctaccgtgattccctgaccggagccgacgccgcataccagaccgcattgtccaagagcaagcaggccgcacaggacgcttccgatgcggccaaggcgctggccgccgcccagcagtccgcacggaaggccgctgaggaagcccagcaggccgcgcagaaggccagggatttgcaggctgccgccgccgaggcgcagaaagcgtatgacgaggccgtgaaggcgaacgaggacaaggccaaggcgttggaggaagccaggaaggatcaagccgataagaacgcggcttattccgccgcccagcaggccaccaaggaagcccggtccggagccgacgccgccaccgacgcccagaccgcagcccagacggcagtggacaaggcgaacacggcagtcgccgccgcacaggcgaagatcgataccgccgacaagctggaccagaccgccgccaagaacaagacggatgcggaagccgcgatcaagcaggcgaacacggacaagacgaaggccgcagccgacctggccgccgccaaggcagccaaggccgaggccgagaaggccaagcaggccgcgctcgacgccaagaccgtttccgacgcgaaggttgaagccgccgccaagcaggtcaaggccgccgacgaggccatcgccgacgccaaggccgcatacgcgaaggcgaaggacgacctcaacgcggccaccggcaagctcaacgacgcccagaacaccatcaagcgtctgcagaacgccgaggagaacctcaagaaggcgaacgcgaagctgacggaagcgcagtccaagctggacgaggcgaacaaggccaaggatgaggccgacaaggcatacgagaaagccaaggccgactatgatgccaagctcgccgacaagcaggcgtccgacaaggagctcgccgccgccaagcaggccgaagccgaagcccagaagaaggccgaggaggaagccaagaagcagcaggaagcccagaagaaggccgaccaagccaagcaggatgccgaagccaagaagcagaaggccgaacaggccaagaagcaggccgcaggtgtgacgaacaatggtctggcctccaccggatcggacaccaccgcaatcgccacgctggcggcgatcatgaccatcgccggtgctggctgcgtgctcctgcgtgtacgttccgccaagcatgccgatggatggcatgcagtcgaggactgattctcaccgcaccaaacgtgttttgcccgccttcgacccgaaacaggggagaggcgggcaaaaccgtattcccacataccgaagcaaaacggtagcttcttttgttactatcagaaaaaagtcagtgaattacgtgaaagggtctggctatgaacgatgtaggacatgcgccactcccaggcgacgtgctgctacaccaatacctgcaaccaaacaacatcaccatgtaccgtctggcgaaagccatgaacctgccacaaaccaccatcagtggcctgatacacgggaaaagacgcatcaccacaagcctcgcataccatctcgcctacgtgttgggcacatcaccggaatactggctggaattgcagatgaattacgacattgaaaactacgacaaattcaacgaaaacggactgacggccctcattgataatacggtcggcgacactgtctagtcagaacgatgacgagcagaagaacgagctcatcgacaggatgatggccgtgctgaagatgaaatcggacaaggacaccgagaccaagaggttcaagttcgccgtcatcggtgccgtggcggtcctcggctgtttcctgaccggcgcggttctggcggctttgggaggaagcagccagatcagcacgggcgaggatgacgatccgtccgaggagtgacctgatccggccttctcatccccaatgcgggaacaggtggcggaagagcctctcgccggcctcctgctcgtcgagcacgcccatcgtgtattcgtcgacgatgaaccgggtcctcgccatccgttccgccgtctcgtccgacatggtttccgttttcgcatcgccttcctcgatgcgcgtggggacgcggacgagttccagatcggatatcccctcgggcatggtcccgtccggcagacatacgacgacctcctctcccccgccatcgagctcggtcagcttgcagatgccggtgccgtccaccgattccaggtattcgcccagttcggggatcccgtcgcgtgtgaatctgcacatgcgcagcccctgcccatccattgatcccccaatcatgccggatgcccggcatatcccgtcatcatgctacttcctttcgtccgttcatgaatcagacacgccatcatcgccatccggagacgacggcccgttgcccggctgtcggccgaagatggattccccgtcgcccaacgctcccagggatcgcagctcgccgtcgaaccggtcgcgttcggcttgttcgcgcagttcccgctcccagatctcgtagtcgtcggcgtgcagcccctcgtcgggcccgaccttccagtcgaagcgtcgcagccggctgatgccgggcatgacggtgccgtccggacgtgtcaacggatggttgacgacgaccttgagaccggccggccactcgtcggtgacggcgaacccggatccgtcgcccagcgtctcgtattcgcccacgagcctcctgccttgctcgtaccattcgcacatgtgcagcgtgaacgacccgtcctcatgctcctcgtacatgaccgtctcctcttccgcaatcctaaagctcgatgtcctgggcgagcatggtggccgcgtcgtttttgtgttcaatccaccatgccgcgtcgttcatccgcagcacctgcctgcgcagttcggcgaacgcgtcacggtcctcgatgcgcgcgtggcgggcgagcacgtcgacctggcttagggtgcggcgtcgtatcggctccgcccggtcgcactgggatttcgagccccacagttcgcagaacccgtcaagcctgttgcgctgccgggacgcgatgccgatgcaggcgggacatgacacccgttccgcgttcctcacccgctgttcgacgaccacgtacgggccgtccacgttgatccgctcctggtgcccgcatgcgtgcgtgacgaatctccaagccatgacctaccgccttcccgaaaacaagaaccgaaccagcattcgaacaaatgttctattaaggcggggacatgcacccgtttgacgcccggcgggaacgctacgaccgacgcggggcgcgccgcgactccggcccgtattccgacgatgtcatggtacaatttattgtacaaacaggaggtgcgtgatgacacaggccgtggcctacagcaatttcagggcgaatctcaagacctatatgcgcagggtcaacgaggacgccgacacccttctcgtgaccaacgcgaacccggaggacaacgtggtcgtcatgagcgccgacgactacgattcgctcatggagacgctgcgcgtctaccagaacccatatctgagcgacaaggtgatgcgcggcatggcgcaggtacggcagggccagacgatggcccacgaccttgtcgaagcgggcgcgtgatgctgctctgctggaccgaagacgcctgggccgactacctgtactggcaatcccaggaccggaagaccctcaagcgcgtcaacgcgctcatacgggatatgcagcgtaccccgttcgagggcatcggcaagcccgagcccctcaaatggggcctgtccggcgcatggtcgcggcgcatcgactcagccaaccgcatcatctacaccgtcgccgacgacaggctctgcatcctctccgcgaaggaccactactgaacgacatggggcggaacggctcgtgtgccttatcgacgttttcggtcgacgcggctttctcggacaggattcgctggcagttcccgagccggctccaaaagaatcagcaggggtgtggatcactccccaatacgccacagaacttatcttcaacccatccaccgtctccaccgttgccgccgccctggggcggctgcggctgtggtgcgggctgtggctgtggtgcgggcgtgtacccgccaccggtggattgctgcggcgtgtacgtgtatccgccctgggattgcgtgtatccggtgtaacctccggtcgtatcgcccgtgtaggaggagccgttgtccggcgcctgggccgtgctctccgccgcctgctcctccttttcggccctggccttcgcgtccgcatcggacttcgccctgacggagtcgttgaccgccttcaccgcatccgagatcgccttcccgtccttcgattcgatggcgttctccaatgcggtgcgaaccttgtcgtcctccaccctgcccttggagtcgttcaggaccttggtcgcgtcggcaacgatcttgtcggtcttcgaggcgttgaccgcatccgccttgcccctgatctcgttcacggtcttcgcgtatacgtccgcggtcttgtcgagctgcgcggccgccgcccggatgcccttcaacccatccgccgggcattcggggatatcggtcttcgtggtcgaagcggccttcacggtcgaggtcaatacggcgaccgtcttcgcgtccttgacctccgaatccttgaccgtgattgcggtcttcaccgcatccgactccagatactccgtcagcttcttctgcgccttcaccgccttgtcgtatgaggtggcgcattcctctgaagccgccgtcaactgattatggttccaatacaggtatccaccggtgccgacagccgccaaaacaacgacggcagtacccccagcaatcaacggaaccagccacttcggatgcttacgatccggaggtaggtggacttcgaattccgtcaccggctcaaccggtggcgtgacgttcatgttcataggttcttctttctcattcatttgtctttccttatactatgtcgttgactttgacttctccccacggctaaagccgggggattctaagctttgatgggacgtgcgtctccggggtagcacccggatggcgtcttacggtcccgtgggcttcagggacaagtcctgccctgatgagcatgttcaacgccgcgttcttatcacgatccttcaccattccgcaatgctgacagcggcgcgaatccggtcagcaggaaaaaccagtaccagggttttccggcggtggcgaaggcccgttcgatcagagatccgttcatgacatcatattgggaacgcagccagtgcttgtagaatgccagcgcgatgatgtaggccagggatgcgaggacggtggctttctctcctacggggatttgtctgatcacgttcctgattctagtgaacgatcagtcccgccgcgaagacgatcacgccccagatgaacgtgagtcgtgcggggtccgccttgtcgccgtggccgacccattcgagcgccgtcttcatgccggcgagcatcgtgtgggcgagcatgaggcagaacaggaacacggagaccgcgagcagcggggtcaccgttttctcgaccgccatattcaccattcccgcccccagaaggacgaacgaggcgacggtgcaggccacggccgccgcatccgcgcggcttcttttcccgtgtccgatcagcgggtatacgcataggcagcagatggccagcaggacgagcggtgccagggtcagcgcggtttgcgcgtccgcgtcggagaccattctcaggtagtccgttttcctcaggcgcggcagtacttggtaggagatgaatcccagcacggccgtcgccatggcggcggccatcccgacgcgcagcagcactcccttgcatatcgccgcggcatcggtgccatgttcctgctccatgcccttgctccttccgttcgttgtttccgtatcggttttcctcggatccggttcccggatcgtttttcttgttccgttttctgacgataaccgggtttcccggctcgggcacgttcctgttcatgcccgagtcctcgtggctgccaccgtggccgccggccgttatcggcggtcccgctggtggtgtccgtggaagcgtggccgcttgcccgtccgtcgcgtcttccgttttccggttcaggtgtcggcgggctgattgggagagtgtgtcatgctgtcggttctggtgttgctgctggtggtggccgcggcgtcgttcgcgtatcgcgcgttctggatgctgcgggcccgtccgtcgtcccggtatgtggggagccgtttccgtgacgaggtggtggcgatgagccgtcgccagcgtcgtcgcgcgttctggggcaatgtgctgctgtgcgtgttgtgcgtggccgcgatggtgttggtcggcgtgctggtgggcggcatgggcggctcggtgtgaccgtccgtcgtcgtttcgcttccggcccgtcggcgtgtccggcgggctttcgtcttgtgtgtgggcctgatcgtcggaggttggtgtgatgtctggttcgactggggatgctccggtgttggagggagaacaccggttgggcgagggcatgcgtcgcggcgtgttctgtctgggtctggtgccggtggcgacggggttgacgctgcgcgaggcgatgtggatgcagtgttgtctgacggcgggtgtggagcccgggccgatgcccgcgcatgcgttccgtcgcgccgaccggcatgcggtggaggacgcgatgggcgtggccccgggtctgatgcgcgcgatggccgcggatgcgaaacggcgtcggcgcatggtggacgcggacgaggaggggcgtctgcccctcggttcgccctcccccgtggacatgatgacccgtgatttccgcgtgcggccggtcacggcgtggcatcagaccagcacggggcgtgcgggggtcctgtccacgctggtggcggggtcgggggcgcctcgcatcgacgggccggtcatcggcgtggatgtgctgtcgcgtgagttgtggcggttcgattcgtgggcgacgtatgacgcgccgggcgttcacggcccgcatatgacgaccagtccggacgtgttcatctgcggcctgcgcggcaacggcaagtcgttcgcggcgaaggtgatggcgttgcgtgagatcgaggcgggccgtcatgtgatcgtccagtcggatcgcgagggcgagtggggccgggtcgccaatcatgtgggaggccaggtcgtctcgccgggcggcggccattatctgaacccgttcgcgttgccggaccgtccgtccgccggcgaggacgatttgtggcgtcaggaggtgctttccgggcgcaaggcggcgttcatgagcctggcggaggcattgcgcgaggatggaggcccgttcccgctggatcgcgacatgcaggtggtcgtggaccgtgtggcggtgtcgttcggcactgggccgatgacgttggaggcggcggtggaccgtctcgcggaccgttcgtgggtggatggggagtcgccctcgatgacgggtttcgagcatgagccggcgttggcccgtgcggcggcggccgcggcggctcgcgtgtatgcgccgatggtgcgcggcggcaccctgtcgggcatgttcgacagggagtccacgatccggttggacccgtcgagcccgatgatcgtgttcgacacgtcgagtccggcgttgaacaacgagcagctcaagcgcgtgttcacggcggcggtgagctcgtggatcgaccgtctgctgcaggggcgagacgggagacggcggatcgtagtcgacgaggaggcgtgggacctgctgtcgaacgcacgtctggtggactcgttgcagaccagacagcggtccgccggccattggggatgcgcgacctggctgatcgtgcatggcgtgaacgacatgacgcatgtgttcggcgagggcagcgagcagcgtggccgtgtcgaggagatcctcaaccagatgcagacgaagatcatcttccgtcagggcgggtcgaacatcgacatgctcagccggctggtcccggatctgagcgaggacgagcggcgggtgattcccacgctgccgcaggggcttggggtgtggagggtcggcgcggagcatccgcgcatggtgcgcgccctggccggtccgaccctgtcggccctgttcgacacgagcgacctgaggtccgcggcctgaaccgcatcgtttttgttgtatccgtttctccgtattcgtttctccgtattcgttggtgaggaggccgctgatggcggatgtgtccggggatcgtccctggtatgaggagctggcgcccgatctggagggcgatgccggccggggcgtggaggggtcgcgtgtcgattcgcgccgtcgggtcatggccgtgtggcgtgggttcgaggactcgcgtgcgggcgtgtggctggcggagcatacgcggcttctggccggtttgtcgagtgaggggtcggtgctggtgcgtcgtctggccgtgggcgttctgctcgcggcgatggcgttcacgctgctgctgttcgcggcggcgggcggcgacccggtggccggcgggctgctggccatgcccttctggatggccgcgttggccgtgtgcgccgtgctgtgggcgttctgggacgcgtaccgtgattccggggagcggctcgtagatcgcctgtcctcggctccgggcatggccacgcgtcgtcaggtcgcggccgcgtgcggggtgcgcgaggtgatgcgcacgatggtgccgagcgtgctgccggccatgctggccgcggccatgcgggagcgtcgcatgggcggcgacccggtgtggccgaggccctggcaggcggccatgtacgtgggcgaatgccatcacgtcggtgtctggctgtcgttggagatgcacgcgtacgtgctgggaccgaccaggtccggcaagacagtgacggtcgtgatccccgcggtggtggaggcgcccggcttcgtgctggccacgtcgacgcgcagcgacatcatctcggcgacccgtcgcctgcgggagaggggtgtggcggatccgtcgaacggggcccggtacggcggccgtggccgtgtccatatcttcgacccggaggggttgggcgcggcggatccgctgacccggcacaacatgcgttggaccccgttgcaggggtgcgaggacccgaccacggcgatgcgccgcgcgcagaccctggtgggtgtgggcggattgggccaggggtcgaacaacagggagtggggcgtgagcgcgggaggctatatccaggcgcttctgtatgcggcggcgatcagcaacctgccgatctcgaaatgctacgagtggtcggtcagcccccgcaaggcgctcgaggccgcggacctgatccgcgagcatacgggcgaacgggagatgctgcgctgggcggacacgatccgtggcctggagaccatggacacgcgccaacggtcgagcgaatggttcggcgtgaggaacgcgttcgcgatcctcgcggacccgaaggtgcgttcgacgatggatttctcgccgcgcgacccgcgtctgatcgatccgaggcgcatggtcgaggatcatgacaccgtgtacgtgctcagccggccgaaatcgcaggcgggcggaggcgtgaacgcgggcctgttcgccgtgctcctgctggacacgttccaggaggcgtgccaggatctcgccctgtcgcgcgaggcgtcgggacccaacctgcgcaagatcgagccgccggcccggttcgtgctcgacgagctgagcaacatcgagacgtggggcggcctgcgcaacgcgatcacgcagggcggcggcaacggctatcagttgctcgtggtcgagcagtcgcgcgacatgatggtgcgcgactacgaccgggagaccgagcagaccgtttggaacaactgcaaccggatcatgctgggcggcgtcaccgaccgggacagcctcgaatggtggggcatgcagatcggccggcatgaggtcacccgtttcgagtccacgtggaatccgggacagggcccgctcggaggggtcacggaacgccgcggcgcggaggagaccgtgctgccgtgggagctgagccgtctgccgcgcgggtggatggtcgtccagcccgtacgcgaggcgccggccctggtccgcgccccgcatttcatggaacgcggatggtggcatgacgcgaaaggagacaggtgatggacgacacccgtgacgaggtcggcgagatcctggccggcatgacgggaggccggaccggtacggccggcggcgtctcatcccccgtgccgccggccgcggactgggcccgtgggctcgacgccgcgtcggcgtcggccgcgcggctgaccgtgctcctgtcggacgtgtacagggcgcatcagggcaaggacccgtcggccagcctggccgcgcagatcgagcagaccgtgcgcaacctgaccggcgagcctccgcaagagccggaatacgggccgggcctgtggacggcgatgccgcaacgctcctgggagacgatgggcatggcccggccgatcgactggaccggcgcgccctcgcgcacggagatcgacctgatgacgatgcacgcgatccgctacggcgaatggctgtgccgcacgttccccacatgggagcagacgctgcccgcctgctggatcgagcacgacgacgtggtggccgaggtgttcgccctgaaatgccatgcggacctggccgcggcctcccccaacggcggcatgtacatgccggccctcatgcaggacatccaccaggccctcgcccgggtcaaggaatacctgacggcggccggcacgggagaatcctcccacgcgcatcacatggacggcgaacagcatgcctcgcgccgacgcgcccgggaggtcgaatacgagtcgtggtatcgccggcgcggcggatggaagacggaaccggcgttcaccggccgttggcggggcggcgaggatttcgtctcctccacgctccttgcctatgggacgcctccctcgcccgcctcgcatgacgatccctccgccgacgtgctcatggccacgctggcgggctgcgaggaacggctggacggctaccggcgttcccgcgacggcatccgccgcatgcccgacgggccggaacgcgaccgcctgtcacgccagctcgccgcggacaccgacggcgatctgcgggaactgtccgaccggtggcgtgactggaggtccatggagctcgcggcccgcgaccggctcgaccaggccatcgcctccatcgaacgacggctcgacgaccggaaggcacccctgtcccatgaggaggccgaggaggcgcgcgcactggcgtcacggggacgcgccctgctcgacgaggccggggacccgcgttggaaccccgactcgtaccggccccgggacccggacgaggagctgaagctcgcgaaacggctcgaaggcatcgcccgcgaacgggatctcgattccctggaacagctcgaccggctcacggccacgatacgcgcgacgatcggcccgaggggaggcatgcgcccatgaccatgccggacctgttcgaacaactcgactcccctgccgagaccggcgacgattggatccgccgcctgctctcggaaccggacgagactccctcccccacgccggccgccggcgacgacggcaccgataccggccatgagcccgatcttccccaagaggaggaaaggattgtcccgccgcaggcctcaggaccgggggccggtggcgatgtgacggctcccccgcctcccggcgcgcatgcgatccccctgccggcatccgacgacacgtcgccatccgatgacctggatgacatgcaccaggacgcgattccgggattcggcaccgatatggatgccgatgagcccgcccgtgcgggccatgccgtccggatcgtactgacggtgctcgccgtggtcgccgccgtggcgctcgtcggcgtgatcgccgccggcgccgtcaccgcgtccgcccgccacggcgcggaacaggcgcaggccgtgctgcgggagaccaatacgattgcgactcggttcgtcaaagcccacaaggcgtccgacctcgccgacgcgaaggcatggagccgtctggacaggcggatttcagacaacgcgaggatactcgacgagcccgccgcccggctgtccatcagggatgctggatcgttgaagaaccgcgcgggcaaggccaataaggacacgaacacgctggtgtcggcggcgaggagggccctcgccatcaaacaggaggccgacgcgcgcgaatcgctcgcgaaggcggtcggcgaggccaccaagctccgggacggcgcgaaacgcgacgacgacaccggcacggccatcgacgatctgacgacgatcctcgaacgggccgccgagcccggcaaggacgtcaccgtcaaggagctcgaggatctggcctcccgggtcgagcaggcgaggaagaccctcgaacaggccatcgccacgcaggcggagcatgcgaaggccaagcgcgcggccgaggagaaagcggcacgggaacgccaggagagggaacgacaggccgaacagcagaccgtccccgacccgacgccgccacagcagcaacagcaatggataccccaataccagtcgggacagtcggggcaatcgggcggaaccggctcccagcccggcaacggctggagcgtgccgtcccccagcgacggcaacggcctgcccggcaacgatccgggactatagcccatcatccattcgaaaggagcaccatcatgacggacgagacaccacgcaaagacgagcacagggaacgtcagggccttctcggccgagcaagggaccgattcgagcggatggagccgaaacggcaggcgctgctgctcgccgtcgcggccgtaatcgcattggcggccacgatcgcgctcaacccgttccagtccacgacatccgatcaaccggaacctcaatccgcccaacaggcgacagacagcgacaaggatacgaaaaaccagtcccggacggacccgtcttcggaaccatcggaattcaccggttccacggaggacatcgccaacaaggcccggtcgatcctcaactccccggacggcggcaacatcgacacgttcggccagacgctcatccgccacggcgacaaggacctaggcaacgcgaccgacctgttcgacgcgatcggccggcaggagaaggaatccactgtccgcgcattggccgacgaatggtatgccgaggcgttgccgaaggccgccggataccggctcgacgatctcaaatccagtctgcccaaagcggaacatgccgtggacaggcttcccgaccccacgccggacgactgcacgggcctggccaaggccgcgaaacaggcgcgaacgttggtcgacgccggatccgacgactacgacaagctcacctccgcgcagcagaccctcaccaaatcgatcagcgcatgcaccgccaacatgaccgtcgaccagatcgaccgcctgttccctcaggacggaccatcggtcaccatacccgacaccggaaaggaagcacaatgacagcggacaccacgcggcgggagcacagcggttccggcatccgtctcggcatcggctcctgccccggcatagcgaagatcctgccggccggcatccgaggcatcacattgcccgacggcacacgcgtgcgcatgctgcgctgcgtgacccgggagggcggcgccgacatccccgtcgccctgatccccgccaccggggcggtccacaaccgcatgctcggggccgccggcggccagatcgtcgagttcgccggcaggccacgtctctaccggcccgagaagggcggccccatcctcgcgttcaccgtcaccgacctgcgcatccgcgacaccgatgaggcccgcatgctgcgcgccggacaaaacagaagatagtcggccagtttttcagtcccaatattctacgcacatccggaatttccacgctgccctcatggcatcagtttttccgcgcaaccgcatcgcggatggcggaaagcgcttcatccggggttttgccggataccgcagattcggaaaaccgctgcagctaccgatgtacatcttgcattcgtcagaccactggacttggtacaggaaccgatcggcgggctttaccggctccccagacgtctatgcccatgcggaggacggcttctccacccacatgtcccatatatctctggcctgttccgtcaagataagagcgaataccgcagatacaaacacgtcgaccatatcaggtgccgccgcccctaccgcaactgcaacagtgagcaggactggatagtacgttgtcttccggaattgcaggatactgtcttggtttttccgccgcacaatgctcaatataattccgagaaggcttggtattcccagtaaagcgaacaggatagcggaaggaagattctcctttgctcccccgttggcaccggtcgcgcagttgtaagaagaaattgcaagtccgaatatgcaaaatgaaacgaatacaccctgaacaatccagtgcaagggcaaggacatctcattcggactgtcaagccatagcgcaaacatatctacgatgaccatgattgccatcgatacggccatgatgcctccgctggccggatcattatggacgaatcctttgaattgcttgatgataacaatcacaaatacgatgccagcaagtccaataatgacaaatcctatccactgacgcaattgcgatttcagtcttacacgtgtttcgcgattttcttcactatctggctgaatcgacttgtaggtttccccgttttcggccgaaatctctttatcctgtgctgcggagcatccattctcagtcttatcggcttccaacgcattcgccacaacctcaacgggctccggctctccctcttgctcctccacacgcctgtcttcggtttccttcttctccatcatgccgattggccccgtagccggccgagcctccagatcatcatgcacggccggacgtgcacgcgcactcaatgtcgcgatccaggaaagcagcgcgacgaccatggcagtcactgatagcacgatggcaatcatcgctttcccattgtttttactcatatttgtttcttttagctgttctgaccgtcacaccatttccatggtagatgggcgtttttaccgtccgtgaacagactcatcaggcaatgtccagctgtatcaggaatttgcaggccataccctgtcgtgtaggttcggcttcggtcgcgtgcggttctgtaaaatgcctgcctatggcgaagacggtgataagggtcatgttcgatgatgcgacggctgcggaagggtttctcgagcgttgccgcggcgagggactggacgccgtggtcgaggacgcgcggccgatcggcacggtgaagcgcaatgggcccggtctggcgtcatggctgaaagcccatccgggctggcatgtggtggcggagtcggtgaatcggcgtgcggcgtgggccgcggcctggaagattcggcatggcgagcgtcgcggtttcgaggacgggttgtgggacgcccaggcgcagaaccgtgatggcaggtgggtggtgattgcccgccgcgcctcgaaacgccgcaatatccccggcgagggcatggacccgttgttctagaacgatgtcgggccgcttgtcgtggactgccagtggagattccccgtttccacctgttccatgggtgatggccacggaagcatgccggtccctattcccgtttcggcacccatgaccaccgttttgtgggtgctgtcatcgccggcggactccgccagtgagcggacttcgcggatacgggcggaaagcatggtcgcgatggccgtgattcgcgtttcaggtacgagtcccgtgactgacaggcggtgtcccacctgttcctcccacccatcgagcttgccaaggtcatatctggtccagtcggatatgaggcgcagctgtcggcgggctgtcggcgtcttataagtcgcgtagaacggtttggccttgtagtcgcggttgtctatggcgagctctccgcaccacagagaggctccggtgtcgaacaacggcgcgggccggacccgcagtgtctccacgtcgcggatgagaccgaagttattgtaatggcggtcgatgttccgcatgaggtagtccacgagtagccaatcgtcggtcgcatgcaccaccgccgccccttcgcagccgaacagttgcgccgccctgatccactggtccctggcgctcaggcgattatccctcttcaccgattcgagaatctgccatgcggatacgagttcctcggtgtccgtcagcatttcgggacaggtggatactggcctgttgtcgtattcgccgagattatatctgactgctggtatgccgagcctggagcaaaggtccgatgcgatgagttcgttgaccggttcctgtccggtacgtccggctttgatcagtatcctggtgccgtcgcccgcaatggtccatcgtttcggaaggtcgccgccggtggatgcgtcgggcgcgttgaggctgaacctgtgggaggaggaacgggcagtcaggagggttcgtccaagttcctcgtcaaacgggttggtgaagaagttcacggtatcccattcgaggtcggatgattcgggcttgacccaatactggtcggaaaggctgagtccatgcgagcggttgaggagttccaccgccgatcttattcccatcgagtcaagtatgccgcgtatcccatcccgagtgggtgggatggcccttcttctccaccaagcatcgatgcttttcgcgtagatcgcgggtttgccgtgggagatgagctcgagaggcaaccttgaacaatccagtatacggccgctgccgacggccttccccgatgaaggatcgtagtcgaaggccagcaccggatgtcggcgacacatgattatccgtcgttccacgtccgtttccctccttgctccggtgtcagtcactccatcgtatcccgtttccccatcgtcaccatcgtagtatgcgtgccgccgtgtccaggctccggaagaggggctggtggccggcgaggtttcgcaggagcgtttcgagctcggggatgggcaggtatcggctcgcgatggtccagacggtcgcgacggcgatgagggtgagtatggcggtgacggtgatccacaggatctgcctgatgagtccgccgccggtggtggcacggccggtgacgccggcgagcaccgtgagcgtgacggcgaggacgatcagggtgccggtgtcccatgagtccagggtccgggtcattgcgtcggcccatcgggcgagttgttcgatgatggttcctgccgtgtcttccattgcgggttcctttcctccatggctgcggggttcggcgtctccacgcggggcgtcgggttttccggccgattacgggtggttttcctggtcttgccggggttgacgacgccgcttccttgcccggtgatgcgtgcgtcgaggttgcaccagtgctgttcctgccggccggaccggcccggcggcctttgcccgatgggctggtcggggtcgtcgatgtgccacatgtcccggtagacggccacgtcgcgcagcaggttgtggtcgccgtgtttccgcgccgtttccatgacggtcctcgaccagggctgttcgcccgtggcggcctgtcgggcgagggcgtcggcccgttgggtgatgaggagttcgttctggcgcaccaggtcgagggcggcggtgtttctggatgccttgatgggcgggatgatgccggcggtccagccgtcgcgcaccgcgccgttgagccggtcgagcaggccgctgctgagccggccggccatgacggcggcggggtcctgccggtttccgtgctcgtccttggggctgatgtcgcggctgacgatggccatggcccgcttggggtcggtcatccaggcgcgggaccatagcgcgcgcagccattcccagttcggggacctcgtgatcatgctcacgatgcccgggttgtggcattggcggagtttggcctcgaggtgggggccggcgatgaggccggctgcgtagtcgtgttcgcgcaggagtcgtgtcaggctgtatctctcctcgtgttcgtcgatgcgggtttcggtggcggtgcgcgtgtcggggcgcgtcaggagtgtggagagcatgcgttggcgggcgatggcttcgggatcggtgtccgatccggacagcatggcttccgtctgccgggtcttctcgtccttgcatgcgtagaggaggtggttctcctcgcggcctcgtgtggcggccacgtattgcaggttgcatgggacgcgcgcgtcggaggggaacatggcggcgcaccggtcgacggtcatgccctggcttttgtggatggtggtcgcgtatccggcctcgcagttcgctttcgcccagtcccggggtatggtccattgccttccgtccgcgtcgcggcatgtgatcgcgtccgtgtcgatgcgggtgacggtgaacgccatgccgttctcgatgcggtgtccgtcggggccacgtacctggtggtcgttggcgcgggacacgatccggtccccggctcctatcttcaggccgtcggacagcgtggcgaggcgggacgggtccccgtcggacaggccgagcacgcgccgttcgaggatggtgcgctggttcatggcgcgcacctgttcgttggtgccggcgacgaggagcgtggtcttgcccgtcttctgccattgcagggtcatccggtacgcctcctcctcgcattcccggtcctcgccccagtggagacggtggtgggccgcgtattcggcgacgagccggcggcatgcctcgacgctgtccggtttcgcgcggtcgccgccggcgcgcaggcgcagcgtggctttgccttcgtctgcccatctggcccgtccgccgtcggggtcgttcgcccagagcccggggtcgctgcggaagcgccacaggctggtgagggtcgcgcaccggtgttcccgttcggcccaggcgagcagtccgcccggtgcggcgggcgcgtcgagctgcatggggtcgccggtcagtacgagcctggctccggcccgttcgcacagttcggcgatggcgtccagttccggggtgccgaccatgcccgcctcgtctacgatgacgagctgtccggggtggatgaggccggcctgttcccgggcgtcggattcgctgatggcgcggcgtatccggtcgcgttcggcgggggtgcgcgccgcggcgagccggcaccggaattcgcgtcgcaggtcgtcgatctgcgcccggtgccgttcggacacgttgtcgaggagcttggcgatggtgatcgcgttggtgccgatgctgtcggcgagctcgtccctggcccggacggacagggtcaggccgagcacggatcccctcccgtgccgggtctcccatgctcgggcgacggcgcgcatggtggtcgtctttccggtgccggcggggccgatgagcgcgctggccgcgtgcgggttctcgagcaggtatgcggcggccttcgcctggtcgtcgctcagccggtttccgccggcccgcatggactggatgagccgggtgccctccccgggtccccaggcgagcgggtcggtccggccgaacgtggccatgacgcgtttttccatgtcgaggatcgtctggctggtgtatcggtcgagtgtggggtcgtcgaacgtgctgcgtccggcgcggctgacgagcgcggggtcgtcgccggcctgtcctgcacggtagcgggtcggggttattttcacgcagcggcggatggcgagttcggcgacctggttggcggtgtcggcgcgggccgtggggtcgagccggatgtcggcgaggaggcgttcggcttcggcccggatgttgctgagcgtccatgtggcgcgggtgcgttcggtgtgtgccatggcagcgtcggcgagccgttcgagttccgtctggccgggtgtctggtggtcggcgagctgtccggcgaggcggatgcccgcggcccgggaggcggtctgtcccagttctatggtcctgtcccggtgcgagtcgaccgcctgccacatggcgtcgatgctggtgccgggggcttcggcccgcagtttgccgtgccatcgtcgggtcagttcggccagtccgggtcgggcgtcggtcttgggcttgcgggtttccagccagacctgtttgtggagttcggcgcgtcgtttccatccgatcgtatggccggtgcggcgttcctcctcgtcgatgatggcggcgagccgggtttcgatctccctgtcgcgtccgctgaacgcgtcgatgagctcctcgggcactccctggacctcgccggccacggccctggtgccgcgtccgcgggcgcgggccggttcgtgccaggcccagccgagtcgttgggtgagcaggtccttgacgaggttggcgttgtattcgctcagttcgacggtggccccgtagacggcgcgtccgtcgagcgcggtccattggccgtccgtggtgcggcgcacccggttggagatgaccaggtgcgtgtgcgggtgggggtcgccgtccctggagtcccagtggtcgaaggcgaagccggcgaccccgtcgcaggccgtgctggcgacgccgccggccccggcccgggtggccgcgtattcggcttcgaagtagccgatggtcatgtcggccgcctggtggaggcattcgtcgatggcgcggcgtgtgtcctgatcggcgaacgcccagaggatgctcacgcttttgggcacggtctgggtcagatcgtatccggcgatgggcggttgcccgtcgttgtcggcccgtatgccggcctggtcgaggctgcggccggtttcggggtttcggcgttcgttgatgagcatgcgcacggtctcggcgccggcctgccgtccggtctcgccgccgagcagcctgctggccgatccgatccatcggccgggcgggttgccttcggcgttgtagtaggcggctgggtcggggcctgtgagcggtccgggcgtggcctcgtcgggtatggcgccgtcggcctggagcgcctcgcgcgtgcggtcgaggtagtagtcggcgctgctgagtttggtcatgctgatggccatgcgtggtcctctcccttccctgcggcgccgcgggccggtccgtggcggcgcaggagtcgttccgcgtccccgtcctcgccggtccggtcgcatgcgtcgatgatgcggccgatctggccgtcgggtcccgcctgcgtgacggaccgggggtcgtgggcggcggcgagcgtgagcatgcgcatgagcaggatgtgggtgcgggcgcgcgtctcgatgccatgtcgccgtatggtttcggtgtccagttcgatggcgtgcgccctcgtcagcaggtcgtcggcgttcattctgagcctttcgatggttccggcgttggcggcggagcgcagcatgcgccgatcgcgcgccgtcttgtagtcatgtgacttgcggcatgcgtcgccgcagtattcgcctcgcgtgccggtatcgagccgtgcgccgcattcgtggcacgatcgccgtgggcgggcacttgtcccggtgcgggcgagccggttccacctgttgcggcaccggtcggagcagaagtcgggcacgggtccctgggcgggcttgtacacgggttcgccgcacatgcggcagtggccggccggcacccgtcccggttccgccttgcgcgcctggcgccggcatcgggccgagcagtacccgtccgcccataccagggtctcggggtgcgggcaccgggcccatctgcatcggccgggtctgggccattcgcttgtggcccctgtggtccctgggcggtcgctcatggcctggccccttcgtcgagggaccaccatccgtggtccgcgccgttgcgtcctcgatggtcctcggcccatatgccctcgatgatccggtccatgtcgacggcccgcgggcccgcgccgtcgtcgtggtccaggtcggcgcgccattcgtcgtccaccccgggcccgggttcgggccacatgccctcgagcgtgtggtcttcgcccgtgtcggtcatggccgggtccatggtccatgggcgtggacccctccagccggtcaggcccgcgatccggcccatgcccttgcgtccgatggaccgggccaggtccacggcccaccggtcctcgtatgccatgagcgtttccggttcgagccgcatgagcgccgccatgcatctgaccgaccagtagcacagttcgaccgtcccgtggtcggctgggccgacggcctcgttgcgccatgccacccgccggcgcagttcggcggccgcctcggcgacgtcgttcctggatgccatcaggagcgactcctgcgacatgcggcgtccgcgttcccgttccttcctcagctcctcccggcgccggttccggcatgcccggtggatcgacagcggcttcccgcggcgcgggtcccgctcctccaccgcgagcccgcacaccgggcatgcgggcggatcctggatcatgttcccatcgttcatggcgcccccacccggcccgtgtttcccgtcccgtcgataacgccgaaccccgatatcggacgcccggacggcaaacaccatcaaaaacgttgcagttccgccgataggcggccgccgtgaggcggtgggtgcaagaagtccatctccttcggagattgcatcgggatgtgctttttcttgggttttctgatggcgtcgtaccttgtgactggctgtgtgggttcttggttctgtcttcgttgtttctggtttctgtgtcgtgctttttcgtctgtctgggtgctggttttcatgtcgggttttatttcgcgtatgtgtctgttgtgccgctgtttgttcggggccggctgccgcacggaggccgggcatggcgcccccggcgggtgccggctcctgccgaacggggagacgtccacggtcgggagcctgctcgtcgactgtcggggatgcggcaccggtcccgggcgcgccgcgcgatgcgcatggctccgctccatgtgcgtttggggagaccggcccgatggcggtgggctctcgggccatggaccgcatgaaccgggtccacccgccgacctgcccatatggtccttggaccgtggcccggtggacagggacgccatcgtccggcccggtccatggaccaggggtggtccgcgtggccgtccccgcatgggctttcgcgtggaccacgtatttggttggtccgccgaattgtgttttagcaagttggcgtccgctttgtgagcggtgtttttccgcagtgtaggcagcgggttttccgcagggtgtgcggtatcggccgctgcctgtctgcgttgtgttggttatttggtcatgagcctttccggtcctttctggcggagatacaagcaccatccagttaagaccattccgtggtcggcatgctctgcctaaacccgaaaaatcatcgtgactaaacccgcaacaactaattgaacacaaacacgctatgtctcggccaagggtcgcacgaaggccgatgcccgcgaacggttcgacgcgaaggtcgccgagatggaacgcaccggcctgctgcccggcgccaagagcccgtacctgaaggattacgcggagcggtggctggaggaataccggctcaacgtcaagcccaccacgtaccgcacccgcgccggcaggattcatgcgtgcatggaggtcatcggctgtatccgcctcaccgagctgacccctgaccatatccgccaatgcatgcgcgtgctttccaaacggctcgcgccctccacgctcaaggaccatttcgtgagcctgaagatgatgctcgaccaggcggaactcgaggagctcatccccgtggatctgtgccgcagggtcaagccgccaagggtggagcccaccgagaccaggatcctctcgccagaccagccgaagcagctgatcgaggccgtgcccaaccggggagcgaaacgacgcggaccggccctgaccgtggacgttgacgaatcctggatgctgctgttcgaactcgcgttcgcggccggcatgagggaaggcgaacgctacgcgctcatgccctacgagctcgaacaacgcgacggcgtgcccggcatcaacgtgcagcagcagatccagcaatacggcaaaccggaggacgccgtgatacccgcctggctcaaagccgagcacctgtacggtatcctgtggctcaccacacccaaaacccacgccgcccaccggttcgtacccatatccacgagcctgtggcaacgattgtgggcgcgcatcaaacgactcgacataggcccacgcgacctcatattcaccaactcacgaggcaaccccgtgcgcagcagcaccgaacgctacaactggaacaaggccttgaaagccgccggcctcccgccggtcaccatccacagcgcacgccactggaccgccagcatgaccgcccgcgccaacatgcccgacgacgccagaaccgccatcatgggccacaccagcatcagcatgaccaaccactacacccacagggacgcggccagtctcgccgcgctcctcgaccgagccatccctgacctgcacgacgagagggatgtgatagacgcgcaggtcatcgaggaggggaaatgacgaacgtgacgcatagtagacttgtccgcatgagcataaagaaagtagacgggccacaggaccatcatcgatttatcgatgaggccggtgacatgaccttccattccgggaagcggggccgcaaaacctcctccatcgggatggacggagtttcccgatgcttcatgatcgggctcgtacatgtgaaaagtcccctcgacgatgctcgtgcgactatcgacggtttttgtgaggagatcaacagcagcaaattcttccagagctttcccagcgtccaaaagagaacaaaggagggatggcacggcttctacccgcatgccagcaaagatcctgcggaactacgctatgaattcctcaaactcatggcgcaggagatcgacttctccgcacgagtagttgtgggccgtaagataccggcgatctatcagcagaggcacaacgaacaaccacgtgaattctacgccgacctcatgtcccatctactcaaatactcagggaagatagatccgttgattctcgacgtcgcggaacgaggcagcagcacatcgaacctcaaccttcagcatgccgtggacatcgcgcaacagcgcagccgtcgcggcacggtaacgcatgaattgcgaaacaccaccaaattcaacgtccaaccgtatgatcacgaaattctcttggcgctcgccgactacagtctatggacggtccagcgagtgtacgagaagggagacgaaaagttcttcgggcttcttgaaccgaagattgtgctggtccatgatgtttatgattccagcagatatttcaaatcaaagaactattatcggccgaaatacaatcctctgaccagagcatccatcaacttcgacggatgggcgcaacctgaatggtagaaggaatagatggcccgtctcaactctagtcgtgctgtgacgacgacggcatgaagccgactttcgatgaaggacaggccaaaatccaataatacgaccagctgatccttcgaggggaaggatacctgtgtattcttgtcgctgatctataaatgatgatagacggtcatgtgggcggcagtcaagaaaatgcgacagattgtctaatcgtcgatatgtcgcagggccgccccggcgctcgcaaagagcgaccggggcggtttcgtgtttagggcttgatccgcccgacacgggatttattgcttggccgtcttgacggtgatggtggtaccgagcgcggtggtctcccagctcacgccgtccgcctcactgtaggtgaagtccttggtggcatcctgcgaggcgaggagcgcgctggccatggtctcggtgtcgtcctggctggtccatttccaatcgccggctgcggccggtgcctgataggtgcccttccagtagaggctcttggtgtcggtgccgatccagtcgacctcgatggtgtcgccgctgatggtagcttccatgtatgagctcgggtcgttggaattggtctgcttccatgtgccggtcagatcggccggctggggtttgggctcttccttattggtctcggtctttgacgtgccatcggatttggccggcgcatcggccgtagtgcttcccccgcaagcggacaggccggtaagcaacatcgccgcaacaagcagcgcgattgcctttttcatgattggtctcccttcgtgccggacattgtcgtccgacatgactcaatcatatggcgaaacacaagaaccaaggactcatcccggtgctcgcggtgagtcgtcgggatgagtccttatatggctcggaagctacgcggcgagttccacgggagcccgctcttccaatttggagtaggggataacggcacaccgtagttgcggaacgcggtgagcgcgccgcgctgcaacggcgtctgccggtcgtcgccgatgactatcagccgggaatccctgcgcttgggatccttcttcgtgtcatcccaaccgaacatgatgtctttcacggcgtccttgtcgaatcggttcggtgcctggcagaaccgggtcggatggttagcgctacgctggaacaggaaatcgaagttgtgctcgtagctggatacgcctcggatccccacgttcggagtgtagaacacatggcatgagtcgagtttcaatgcaacgtcgtcagcaaagtaggacagcacccttttctgttctgtaacggcatcagtacaatgttcgtaatgaacagttgttcgcgcaaggaaatgccggcatatggtgcgtcatgttcaaagcatagagattcattatccggcctcaacgagaatgatttggttctagcgcaatacatgctttcatgacacatgccttcgtgatacatacgttggtcagaagatattgcgctagaactcagcagtcaccgcacgtggtccacgatgtcgttgaccttggtcatatcgatatcgcgctcgccgaatgcctgccgctcgtaggccaggtcgatgtggtgttcgtgtgcgtaatcgatgatacggcgagccaaatcggcaatgtcgccggacttgttgaaggaacgaccacgcagcagcacgcgttgcataagagggcgcatcgccttgaccaacttgtaccggtctgacttcaccttcaccatccaaccgtcggcaaaatatagcaccacgccttcacgcgggcttgccttggcttcgccgattgcctgggcgacttcttccggcgaatggcagatcgccaccgtttccggccgcacgaagccgtcggcaagagtgaacgtttcctcgtgagcggcatcgatggagaacgattcggcattacgaatcagatgcagcaagcgcagcccggatgattcgtatccaacgatgtgccggtcggactcgcgatcgatgacttcaaacgccgccgtgacattccactcatgcaacatacgccacaattcggcacgtaccgctgaatctgaaggaaacgggcgctcgataagcgcggaataatccgtttgccccgacttcgaccagaagcggaacaatccaggagttcccgccgcgcccacgagcccgagaaatccgttctccttgcgctcaacgcgcacgggcaacgactctggatgttcttgagcgtgattgacgacttgggcgaacgatgtcccctccgtctcgtccacagcaaagaacttctcgaacccgcgttgcaccacctgaccgttgccgccgataaaaagccctcgcgcattgatggtgcgatccgtccaccgatgttcacgaaatgcctctgcagtgaaattgcacgcatacacgtctgtttcgccgcgcaccggaataacccgaacgtaaggatccgcgcgcatacgctccaacaggtttccattcggatcgcccggttccaacggtcggaacatcgcggtgtgaaaatgcttccaggacgaacgaatgtaatcttccggaacacggtcagcggtatcacgcgccgcattgcgacgcaacaattcgtctagaggaacgtcaaaatccctcgtttcccacagtgcgccatgacgttgagcgagtagcgccagttcggctgcataccggggattagcgtgttgcgcatctgccaccacatcccaccccgcatccaatgcgtcggcaatcatgtgccgtcccatggcaaccaccatgtcattgaatcgcttgccgtgctcggattgcagtcggtttcggacctgtgccgagccggcgatcatgagccgaatgtcatcgagagaaatcacgcaatgcggccacgtgttggcggggtcctcacaccatgagcgtgcccacgtggacttgcccgaagcgggcagtcctcgcagaataatgagctttgccatagccaagctcctttcgttgtgctgtggggcgagacaggtgccagcgatggcataaggttctgctcgccccaatattgcttgtattatgattcggctgccgaaaccgagccgcctggttcctgctgtgcggcggagtcaatgggcgccggcccgggggagtcgggcatatccagcggtgatacgtgcgttgaatcggtcgcgtgtgcatggaaccagtcggcaatctgtgtttcgcttaccggttgcagattccatgcgtccagtccaacgttgagggcttcgtggcgtgcgccctccggagacagctggtgcgtgtgaccatacagcagacgatgtccgtcgaacggcaatgcctgatcgcggaaacgtacggcatcatccggccagccataggcaagatcctcacggtaggggaaatgcgatagattgacggtctccgttgcctgcgggcggccaattccgagaccggtcagctccgccgtgctgttcggctcaatcgattcgaacagatctcgcgcgggtgcatcgtccagccaccagtcatcgtgattgccgataaccgcgtgcagatgcctgcagcgcagctgacgcaggcagctcttcagatgccggaccgatgttcggtatccgatatcgcccaaaatccacagctcgtcgtcctcgccgacaatccgattgatattggccacgattgcttcatcgtgcgcatcggtgtctgcggccttgcggaaattgagccgggaatcgtcaagcaccacgcccttcgcccaatcctcggcggccttgcgtccctgcgaggagaggagagcgtcatactgcgtgtgcccagggtcgaacgtggtgaatccgcgcagcacgctgaccagcggatgcccgaaatgcgtgtcagtagtgaaatacttcatgatctgttgttctttctgaatatgtgatggtatgcaatgggttttgctgcggtgcattgagttgcgactatgccaagaacgcatgctcgtgcaggtgcgtttatgaggcatggtgcgaacgagtcggctcgatatcaccggcaatgattcagctatgcgccaatgagaggtgtactgatcagatttgtttggcagcgagcaggctgcgcttgtttccggttattggctggaactgagcagtacgcaaaccctgtttgaaggcgcattcgagcatcgccggcaggttcgtctgctggcgcttggcgtgttcgttcacgccgttgctgctgaatgcgatgtgttgaatcatggtgtgcacaccataaggtcttacgtccgaatccgtcaaatcacggtgtgtgaaatgcctgttgtatataaaaaagtccggtgcaacgcacgatgataatgcgctgcaccggacctactgcagaaacaattgttacagactgtagatctgtgcgccgaacggccagagcgcgagcttggccattttgaacgactggatgccgaacggaatgccgatgatggtgatgcagttgagcacgcctgcacccagatagccgagcgccatccagcagccgaccagcaccacccacaggatgttggccaaggcagagccgactccgccgccgtattgcacggttttgccaaacggcgtcaaggtgagtcccgccatcttgaacgcttgaatgccgaacgggatgccgatgatggagatgcacagaatcagtcccaccaatgcccatccgattgcgatggccaatccaccaagaatgatccacaggatattgccgagaactcgcatgattagtccctttccgattccggtcgattccgcgcatgttcagcttcactattttgccagaaatcatgacggaaacactagacgcaacccttagctcgcccctgattcatacccggaccgttattcaggcggagcgtatgcgtaagcccaatccttttgtgaagattttgtgtattgtcaggcatgcgtgggtttcaccgtcgatttgaatgatgataggcttctcgatgtctgccgtacgaagaccccatcaaggagatgccatgaacctgtatcgctacgcgatgttcatcgcacgcgcctgccgtgggtcgttcgtcggcaatgttctgtttgccaatccacgaatggccctattctcgatgctggtgtagcggggacacgccttatgccgggatgtaccgatggcccatccgcagtcgacgtcgcatgaatcgctcaccatagccatcaacttacgcaaagccgcgaatcgtttgccgtatatgaatgcggaacggatggcggcttttcctttacgtccggactcatcggtgtcctcgcgtcttgacacaagcatggggccggatcgccacacatgacgttaccaacagaaggaaatgctgtgacctcacagaaaaacgcggaactcgggtccgccaccagttccgtaaagcctattgatccgcacacccgattcatcgttgtgggtgtgatcgtcgtcggctcgttcatcgcgctgctcaaccagaccgtcatgtcaccggccttgccggcactgatgcgtgatttcaatatcaccaccggcaccgtgcagtgggtgaccagcgtctacatgctggtctcgggcatcatggtgccgatttcaggctatctgattgataaattctccacccgaaagctcttcgccggagctcttgccactttcatggtcggcacactgctgtgtgccgtcgcgccgaatttcatgctgttgctcgtcgggcgcatactgcaatccgccggctccggcgtgctgttgccattggtcgccgtagtgccgatgctcgtctatccgccggataagcgcggcaccgccatgggcatggccggtatcgtcatggccgccggtccggctatcggcccggttgtcggtggtctggtgattgacagtttcggatggcgcccgatgttcattggcatcgcagtcgtgacactggtcatccttgtcggaggcacgatgatgctcaagaacgtcggcgagttgaagaacccaaagctcaacatcctgtccgtgatcctttcgaccatcgcgttcggtggcctgctctatggcttctcgtccgcttccacgatgggatggagcagtccggtcgtcattatctcaatcgtcgttggtcttgtggccttcgtcgcattcgtatacaagcaagtcaagctcgatgagccattgttgcgcgttgacacccttgccacccgcaacttccgcaactccgcgattctggtcactctgatcaacgccgcagtcgccgcaaccaacgtgacgttgcctatcttcatccagaatgtgctcggccaatccgccaccgtcaccggcatggtcatgctgcccgccgcggcggtcggcatcatcctgagtccggtcgccggcgccgcattcgacaaattcggccctcgcggcgtgggtatcggcggccttgcgctcatgaccatctctcttggtcttctcggcaccatcaacaccaggacatcagtgctgtttgtcgccgtgttctgcgcattgcaggcatccggtcaggctatcgccaacatgccgatcaacacttggggcgtcaacgctttgccgaacgacatgatcgcccatggaaacgccatcgccaacacaggccgccagatcgcggcagccattgcgacctcgcttctggtcaccgcagaaacatccatgaccgcctcgcacatgtcccagggtgtgaagtccgccacggccagcggcatcgcgttctcctacctgctgtgcgccgccatctcgctggtcgccctgatcatctgcatcttcaccgtcaccagccgtgccaaggagaaggccgcacgcaacgccaaggcctccgaggcgcaagcctccgccgaagtcgcggccgaaaccactgaaggccagcccgccgagcatcactacgccggcgcatacgtggcccccgccgcctccctgttcaagcaggcccaggaacagtccatcggcggaatcatggacgatcagccctacagctgcctggacagcgatgacatcacgcatgtggtgcgcgagttcatccgcctcaacgtctccagccttcccgtggtgaacggcgatggcaggctcgtcggcttcgtcagcgacggcgatgtcatgaaatcgattgccacctatgaatcccgtacggtttccaccggcaccggttcgacgatggtggtgttcgacgacgaaaccgtggcctccaaggtgcaggcgctctccggcaagaaggtgatggacatcgccacgcgcaaggtcgttgccgccacgcccgaccagcatgtcggagaggtggcccgaatcctcgccaagaagcagttcaagaaactgccggtggtggatggtgatggcagactcgtcggtgtgatccgccgtaagtccgtgatggaacatgccttcgatgcgctgttcccaaaggatgatcggtgattaggcgccatcatcgctgaatagaatgaatggaatatgaggcttcccttctcgcgggggaagcctcattgctttgtccgcggagtcttacggcacctgcgcaagggcaacgtcacgccttcatgattatactattgaatagtgtgttcctatcgttgcatggtgacgctaacgcatggcgtcacgatactgaagcctgccatctaacggcgggtacggctcgttgctggagtcgtgcacgcatacgcgcgtcggcgtgcgtatgccgtgatgtgacctttgtagtggaattgaagaattgagaacactcgtatgtcttctagtagtacaacaactgaaccaactgtgcgcgaaacacccgaggtttccggcgatgacaatgcgaatgcgcgcgcagcagtccatagcgcgaacaaacccggtgccgcctatgccgcagcagtggccaacggggaatccgagcgtgcgtggatccgccgtgtagtgcttctactcaccggccaggcgttctcgctgctgggctccaatattgtgcaatatgccatctggtggtggatcgtattgcagactaaaaccggttcggccatgctgctggccacgttgtttggcgtggtgccgcaggccatcgtctcgatttgcggcggctcctgggccgaccgtcacagtcgcaagttgctgattatgctgccggatatggtgattgctgtggtcaccgtcgtgctgtcgctgagcttcgcgatgggatgggcgagtctgaccatgattttcgtggtgctgttcattcgttcggcgggcggcggggtgcagacgcccgctgtgcagtcgttcataccggatgttgttccctcgggcaaactattgcgcgtcaactcaatatacggcgtgattaattcggcgaatatgattgtggcacctgcggtggctgctgtgcttatcaacacagtgccgctgtggtcgattctgttagtcgatgtgaccacggccattatcggcgtcggctttgtggcgttgatcaaagcgccgaagaagagcgcggaacatgttgcgaggcgtatggctgaagcggagaatagcgggcaacccgcactcgaaccgatgtcggatgccaatgctgatcgttcgctgattgccggcgtccgtcgtgtgtttgctgacttgaaagatggcttcagctacacatggcgccgggcgaacctgcgcaacgtggtgctcggtgacaccttggtgtgcttcgtggccgtggcgccgatgaaccttacgctgttgctcatgacccgcgaatatgagggcatcgatttgaatctcggattcatcaacctgaccaccgcctccgataaactcgccgccaacgagctgggatggagcatcggtatgctgctcggcggcgcgctgatgtctaccatcggtgccaagctcatccgcaacaacatgcgcgtggtcgccttcggcatcactctggtgggcgtctccgtcgttggtcttggcgtggttcacaatctgctggcgtatttgctgattgatgtggtgaacggtttggcttcggccatctgcatgggcccgatgcgcaccatcatccagaccgaggccgatgagaagatggtgggccgtgtattcggccttgacaccaccatgagcacactcagcatgccgctgggtatgttgatcttcgcgccgttggccgacgtgatcccgatttcgctggtgttcatcatcggcggtgtgctgactctgcccatcggcatctatctgttcggccaggcgcgccacaacaccagtgcacaggtgactcggacacaagcctgacagtcgcctgacagccacctcgcaggcgcaaagtcaactaccctatttgcgcatacagatcgtaagatgcatacttcggtagatcgtagacggtgatcgagaatggtgcggatcggccattgcccggccaatccacgaatgtgatatctccatagatgattgcgttctgtgcgttgcgcagtactagggaaatcttgatttgctgcccatcggatggcttgaatccgtctgttgtggcgcggacctcgccattgaacgtcgtgccgccgtccctgttgtctattttggatgttccgctgatggggaaggtagcggttccttgagcctcggtgacgttgtacgtatcagggctaagcacaacgaaatctacggtggccggggccgtgccctcgcccgcttggccggcgttatatacagtctgattcgggaatgccatattcagtgcttgcgtctgcgagaacacgatggaaccgtctttggcccgccccgtaatggtaatctgcggatactgcacctgctgggtcttactggtgttgcgcagggcgaaagcgtagtggacatacccttgctggtccgccgaccagccggattccactattttcagaggattgtcggtgacggtgtcttgattgtctccatcagcgccgtcagtgccgcctactccgcccgtgccattggcattgtcggttcctgacccgttcgaggagtgcccgccatcggccttatcggttgattggctgctggattgtgtcgaggaatcgggtgatgttgccgacccgataatgccaagttggcctgccaacacaatgcctcccgcaatggcggcgattatcagtgccgctccggcaatggaccacagcacgatggcgcgtttgctcaagtgcagacgccggaatagtcgagacgccgacgcgctgccgttcgttgttctcgttgatggcggatttgccgatgatgcgttcggtatgggcggattggactgggagaacagcgcctggcgaaactcttggacgctctgtggccgtttgctgggctcgaaagcgcacgcatagccgatgacggcgcgtagtcgagccggtactgcggcatcatcggcaagtcgctgctcgtagtcgctggcatcgggatatacgccggtcagcatgaatccgagtagccggcccagcgagaatacgtcggaacgcgcgtcggttttggcaaagccatattgctcaggcgaggcgaatccgtaggtgccaagcgccgtggtatcccgtgaacggttgcttgcctctgaccggatgcgcgcgatgccgaaatcgatgagatgcgcgccatcctgggccacgatgacgttggccggcgtgatgtcgcggtggataacgccgtgctggtgaagctcctgcacggcttcgcaaatttggtcgataagctgcacggccacattcggtgcaagccgcccgttttcctccgcaatttgcgcaagcgtgctgcccggcacgtaatcgtagacgatgacgaaccggtcgggcagctcgtacgtcgcttccacacgcggcagacgattactctggcaggcgctgagcgccgcccacacattgcgttgcgctaggggagagggaatcttcttgcgtacgaacgggccgttgccgtcaatgctcaccagttcggtgacgccggaaggtccgcgagcgagcgtacgctcgacatggtacgcatcgtcgatgctcatcgcatgcatcgcctgcttatcgtccatgtctctccttgatgccctcttacttgcgtctcactggtgagtgttgttgggccgaatgtcgtcaatcggccggtagcaacgtcgcctctcccatacgatacaactcgtcgtccgtggcaatgcggtcgaatccattgcgtatacaccagatgataatcgcgtcgcgtcgctgtttgcaccacagttcggaaacgcctgcaagacgaagtagccgttgggtttcacgtaatgtgcacttgagaccaaaagccagcataatggcgtgatctcggccggggcggcttttgccggagaaaatgtcataaaccactgtggcgttgaggccggatgcccgcaccacgtcggctcgtctcaggtcatgggcttccatacggtcgaacagatagtcggtcagcgtgcgtgcgctgacgagtccctcatcgagatactgctcaatgctggcgctggcgagcagccgatccaacagttcctcggtcaaatgttcttcggggatgtctgccattgcccatgctccttgtcgctgtgttgcgggtgctgtgctgcgccagcgtacgcggttgctcgattcccagcgtacaggacgccgacttttcggaaacacgccgaaaaattcagttgtcagctgatgtatggcccgcgcgtgtcgccgacaatggtcgatgccatccgtgtaggtgcggtggcggaaaggatgttcatgcgcggtatcaagcatcgacaataaagctaacatgcatacaaaatgctaatttgcgtacataataacaacgccatacactggtttcgatgtatcgcagagcaaagcgagcaataagaagggacgcaatgatgagcgaacgataccggcttgccatggcagtcggattgaccgtaacggttgccgggcttgcctcttctgtgctggtaatgctgctgcttaaggaaagaagggcatcatgacaacgccatttgatcaacaacctcagccggttccaccgtccgaaggcacgaatgacgcaccggaagatcgcgcgaatgcgcctaccgtgccgaatactgtaccggctggccaaccgaacgtagcgtctgatggtgctaccactactccgatgactccggctacggcatcgcagcggcccgccggcgcgccatttgatcgtgtatatgcggtcagtccgcaacagctgttccaagttattcacgaccagctgactactggcgccacgtttaccttggataacgaaaacacccagaccggagcgttttccttccactcctatgatggggtgaactgcacgctaaccgtagtcccgcagggtgcggcaggggccgccattcgtctggaggcgactggaaacgaaagcgccaagcgcgttgatgagttcctcgccgctctggacaagcgtattggtgtggctcctgcacccgccacacatggtgccggtgctgccactggttttgctggtgccgctgcgcctgccgtgcttgctccgaatgcacaaggggtgaagaagacttccaagctggctgtgttcgccattatttggggagtgttgttcgtactcgcccaatttgtggatgtttctggccgatcctggggcggactgctgttcgccacggtgattccggcactgctctcaggcttcgccgtatacgtgacccgcccgagtggcaaggtgcaaggccgagtgctggcctgggtggcagtcggtatcaccgttgtgggtctggtaatcggtggcgtgttcgtaattcgtgacggtgcgaaggccaaggctgatcgggcggaattggaagcatcgctcgccaccaagtgcgaagcatattcatggccggagtcggatatcgcggcgctgctgccgcagccgaaatccacaaagggtgaaattaaaagcgagtcttcggactacttctccatcgaggtgtgcgataccgacgccaagcagtatgccgactacgtcaagtccatgcaagacaacggtttcaccgtggactataacaagtccgctgacagtttcaatgccaagaacgccgatggatacagtgtgagcgtttctcgtgacactgacgacgaaaccatcatgtccatcactatccaggttccggagaagaaggaagatacgtctacggacggcgacgccgcgaagcaggatgataagagcactgatacgggcgctgattccagcgatgccaacaagcagagcgaccagtcttcggatcagaaggcgcagcagaacaccaatgacagtgctgacttcaagtccacgatggacagctacgaggcctttatcgatgagtatgttgccttcatgaacaaatatcagaaatccgataacgtggtcagcatggctaccgactatgccagcatgatgaagcgttactctgagttctcccagaaggtagacgccattgacgaaaactccctcagcagtgaggatttggcctactacaccgaggtcatgactcgatgcacgcagaagctcgcatcggtgggccagtgatcagactggcgtatcgaggtaacggttttccaagaaagggacgatgacggtatatgggtatacgcggcagacagtatacgccaatggatgagccggccttcaacaaggccatccccggaacggaggctctggccgggacactgaaagacacttttagcgcattccgtagtgggcttgggattaccgaacccgtggtttcggtgaattgtgaaggttgtggcgctccgctttccggtcatcgcaaagaagtcgttcgatgcgaatactgcgatcgcgaaacgcagctatagccaacatgccagcataacggccggtcttgcgattgcatagtcgcaagaccggccatgtgcattgagatatcgaggaaaacagatggcagttattaaggcgttcgccggcgcgctcggcggtacattcgcggacctgtggcgtgatatcatcaccgctggtccgttcacggaacacaccgtcgttgtgccgggcattccccgcggaagcaacaacgatcgcggttcgaatgaatacggttccgagggaataatcaccaatggttcgcgtatctatgtgccagagaatactgcggcgttcattttctctgaaacaggtatcgaaaacgtcatcaccgagtcgggcggttatgaatatcgcaacggggaacagagcgtgctcgccggagacggcatcggatcgttcttcaaccaggtcgccgatcgattcaccttcggaggtcagcctggccgcaccaaatatgtggccttcgtcaacctgcgtgagattcgtggcatcaaattcggcacttctgcgccgctggtgtataacgaccggttctatggcgtcgatttggaaattcgcgcacgcggatccatgtcgctaaaggtcactgatccagttcgattcgttcgtaactttgtgcctgccactaccgtgtcgtattcattcgatgatgaagggccacgtaggcagattctgtccgaattcgtacagtcgtttattgtggccatcaattcgttgtccaatgaatatcgtatttcgcaattgcccggcaaggcgaatgacatcgcagcatgcgtgcgtggcgatcgagccaatgccggtacatggaatgatcgttttggctttgaagtgtccagcgtgggcatcgaaagcatcgagttcaccgagcaatcacgtcagctcgtgcagcagttcgcctcgaataagatgaatgttgccgcatacgagggcgtttcccaacaagctggcaatatggctgcccagcagcgcattgcgcaaggtattcaagacaacggctttggcgatggcggcatgttgcttggtatgaatatggcgcaagccatcagtcctatgacggccgccccggttcaagcgccggcgccggaagccgctgctcccgcctctcacacggcatccatgtctgtggaagaacaagttgaggcgatgaagaaattgaaggaattggttgatatcggcattctctcccaagaagaatttgatgcaaaaaagcacgaaattctcggcctgtaaacggtgcattcatgcaactcgaaacagctgataatgagggaaacgctggtgcgacacggacaaaatggtgctcagggcttcgaactgggttgttcaatccgtttcgatatttcggcgactcagcgcttgttcgggccgccgtccgggaacatcaagtaagtgatgatgccggcggcggttccactggccagtgctccggtgatgacggcaagagcctgcatcgccgtgctgagcgtgggcttgcccgttgcggcagtctttgaagccttcaatgttgcggcactgggcttgcgtttctcggtggcggcgttgtcggcaacgttgccaccgtccgtattgactggggcattgtcggcaacggcctcgccgtcctgctcttgggcgcgccgttcgcgaatgcgttgctcaatgggatcgtcgaccaaagtcttgatgatgcgtgccagatcgcggtcttcacgacgtgcgatctcggcgctgaacaccgtacgtaaagcgagatactgcagtttggtcatcgggcttttgccggtctccaagttagacaccgtctgtcgcgcgactcccagctcgtcggccagttgctgagtcgtccatccggctaccttgcgaatcggacccaggttctcctgaaacttatcaatccaccattgttcgatttcagacgccgccattacgcacctccttccacgctgtcaccagtgtacgttacctgtaccgaaatcaatccaaaaaacagtgttcatgtgaaattcactgcgtatttgcgctttcgccggcttaccgagattagccttaaacaaggaataacagagtagaagcagaaggtatgcgcgtattcgatttcgacggaaccatctatgatggcgaaagcctgttcgacttgtacctgtattccgcccggcatgacccgaaagtgttccgctacatcgcccccgtgctgcggtacgcagtcaaatacaagcttggccgggccacgcttgaacaaatggaatacggcgtgggtaagatgaccgaaggctatctcacggaactgagccgatccaaacgggtggcgagcgtcgaacagctcgtggacgacttctgggaccgatattacgcacgtatcaagccttggtaccagcctgagtcggacgatgtgatcctcaccgcatccttcgatctgacggtgggggaggcctgccgcagactcggcgtgaggaatctcgtggccagcgaggtggatgtggggacgatgaaggtcacgtacctcaacttcagcaccaacaaggccaaacggttccgcgaactgtacggtccggacgtcgtcatcgacgagttctacaccgactccaaattcgatcagccgatgatcgacatggcccggcacgcgttcatggtcaaggggaacaccatcacgcaagtcaagtaggaaacaacagaaaacaacacaacgtaaccaataacgaaaggggaacatatatgagcatgccgctcgatctatacgtaatccggcatggcgaatccgaagcgaacgtcatcgtccaggcgggcgagcagggcgacaattccctgtacacgcaggacaacgtcaccgtacccgaccgctcctggagactcaccgccaccggacgcaagcaggccgactgcatcggccgctggctggtcagccagcagcagctgttcgaccgctacatggtctcgccatacgtgcgcacccgcgaaaccgcagccaccatggccctgcccaaggccaaatgggaggagaaccgtgtgctgcgcgaacgttcctggggcgagatcaacaccatcaccaaggacgaattcaaaaacaactacgcgcgcaactggaacttcaagaacaccgatccgctgtactggcgtccgccggcaggcgagtcgattgccgatgtggccgaggaccgtgtgcacaacatcctgacctcgctgagccgcaaatccgattcggaatccgtggtcatggtcacccacggcgacttcatgctcgccctgatgctcaccatcgaggatctggccgacgaggaattcctgcatcgcgccgattcggacgactggaagatcaccaactgcacctgcctgcactatacacgccgcgacccggaaaccggccgcacctccaagcgtgtgcgctgggagcagaccgcccggcccgtgctcgacgagacgaccggccgctgggaggtcaaggtggagccgtggcgcgaattcaagcgcccgtatctctccaatggcgatttggtggatgtggtgcaggccgtcgacccacacctgctggagtattacggcaaatagcctttcccggaagagagacttcacaaaatcttcgtgagctagaatggtgcgtggtgcggctggttgtgaatgccgtgccccaagcgagagcgaggagagtagtaatgtccaatatcttccaatggcaattgcatggcgacggcaagacgctggcgcccggcgaggtagtcgagcccgatgaacgtctgacttgggtgcgcaccgccggtatcggcgcacagcacgtcatcgccatgttcggtgccaccttcctggtgccgattctgacgggcttcgacccgtccaccaccctgttcttcacggctatgtccaccgcactgttcctgcttatcaacaggaacgtgctgccgagctatttgggctcgtccttcggcttcattgcaccgatcaccgcggtctccaccgccaacaagggcattgcggtcgccagcttcggcatcatggtcaccggtattctgctggccctggttggcgtgctcgtgcattacgccggctccaaatggatcgacatcatcatgccgcccgtggtcaacggcgcgattgtggccatcatcggcttcaatctggcaccttccgtgtggaccaacttccaagccgcgcccgacaccgcactggttaccctgttggccgtgctgctcgtggccgtgctgttcaagggcttgctgggccgcctcaatattttggtcggcgtgatcatcggctatgtatatgcctgcatccgtggccaggtcgacttctccgccatcggcgacgccgcatggatcggcttcccgaagttccacctgccgcaggccgatttctccatccttcccatgttcatccctgttgtgcttgtgcttgtggctgagaacgttggccatgtcaagtccgtggcccaaatgaccggccgcgactacgacaatcagatcggcaccgccctcatggccgacggcctgggcaccacgctcgccggcttcggcggcggctccggcaccaccacctacggcgagaacatcggtgtgatggccgccaccaaggtgtactccaccgccgcctactggtgcgccgccgcctttgccctgatcctgagcctgtgcccgaagttcggtgccgtgatcaacacgatccccgccggcgtgctcggtggcgtgaccacgctgctgtatggcatgatcggcatgatcggtatccgcatctgggtggagaacaaggtcaacttcgacaagccgctgaatatcatggtggcagccatcaccatgatcattgccatcggccaattcgcgttcactgttggtggcatttccttcaacggcattgccattggcacgatcgtgattcttgtggcctaccacggcctgaaggccattggcaaggcaaccggcactattgccaaagacgatccggatattttgtagtgtgttttagggctactgggctgtatcttggctcagcccttttgcacaatggcccctaccttcacgggtgggggccatttgcgtgttccatggagcggtgctcgccttacgtggtggtaaaacccatggggcggcaaatatcccatggggtggtaaaaccctcatggggcggtaggtgaaaatggctttattctgcggtttcacaatttcttcaaaccgccccatgggcaagttgccgccccatgggcaagttaccgccccgtggggtcataagtaaagagtgggatgacagtgtggcgagcaccaagcaaagtagggggcttacgctaagctcggaaagcttgcgtaatttgcgtaacctttgacatgaaaggccactgtgccccgtaataatttcgatgatcgtgacgattccgctgatttccagatgaacgacagcgcggaatcccgcccccttacctttggcgaacttggcgtacccggaccgctggtgcgcgtgcttgcggcagatgacaagaagaccgcattccccattcaggccgacaccctgcccgattcactggccggccgcgacattctcggccgagggcgcaccggctccggcaaaaccctcgcattctccattccgctgatcacccgcctcggttcctacgattcgttcggcgaaatcgcgatggaggagttccgcaaggaaatcaagcgccgcaagaaggccagcctggaagagcgccgcgccgacgacttcctgccgcacccgcgcggcctggtgctggcccccacccgcgagctcgcgaaccagatcaacgacgtgctgatgccgctggcccacacgtttggcatgaacaccaccacggtgtacggtggcgtcaagtacatccaccagatccgtgatctgaaggccggcgccgatatcgtggtcgcctgcccgggccgccttgaggacctgctgcgccagcaggcgctcacgctctcgtccgtcgaagtcgtggtcatcgatgaggccgacgaaatggccgatatgggcttcctgccgccggtcaagcgactgcttgagcagatttcgcccgacgcccagcacatgctgttctccgccacgctcgatcacggcgtggatgaagtggtgaacaccttcctgcacgatcccaaggtgcacgaggtcgattcggccaccaccgaacccgacctgatgacccaccacgtgttcgaaaccacgcgcggcgacaagcacgaactcgtgcgcatgctcgcctcgggcgaaggccgccgcatcctgttcacccgcaccaagttccaggccaagaagctcgccaagaacctgacgcagaacggcattccggccgccgagctgcacggcaacctgaaccagaaccagcgcgatcgcaacctcgctgcgttcgattccggcgatgtgcgtgtcatggtggccaccgacgtggccgcccgtggcatagacgtcggcggcgtggagctcgtggtgcaggtcgagccgccggccgacccgaagtcctttgtgcaccgctccggtcgtaccgcccgcgccggcaaggcgggcgacgtggtcaccctcgtgctgcccgagcagcgccgcgagacgcgccgcttgctgaaccaggccggcatcaagaccaagatgatcgaagtgacccacgattcgcccgaagtgcttgagcttgtgggcgaccgcgccgagcgcgtggatggttggagcctcgacaagtcgcagcccgtgggcaacccgcgcaagggcaagaacaggggcgccaagaacgcggcgggcgacgagtccggccgcggcggcaagcgcaagcacaatcgcaatcgcaaccgtgacgagcagaacgttgccgagaccgagttccagcacgagaacgcaggcggcgagtttgttgccgaaggcgagccgcagcgcaagcacggcgacaaggccagcaagaaggccgtgaagaagaaccgcaaccgtgcggaacgccgcgcaggcatgagcaaccccgaggccgagcgccgcgactatctgttcgagcatggcgatgaccgccgcgaggagcgccgcaagggcgaccgtcgcgacggatacggcaagaaccggtacgacgagcgtcaggacaatggccgcggccagtacggcaagaaccgtcgcaatgatcggtacggcaagggcgacaagttcgataagcgcgacagggccggatacggtcgcaacgatgatttcggcagccgcaggcacaatgcgggccgtgatttcgaacggtccgattcccgcgatttcgagcgtccgcgcaagcctcgccgcaatgaacgcagccacgaggattacggcttctcctatgacgagcgctcccatgacggccgcaggcagtccatgcgcaacacccgtcagggcgaaggcggcaagcgcatccatcgcaagaacgagaaccgcatcgtacgcgacgagcgttcagaaggtgccaagcgtcacgaacgccgcatgatcgccaaatacggcaacacggaaggcccgaaccgccgtcattccaagaagaatcgccacaatgcgccattccgtatgaagtctggacgccgttagtccgacagcgcgtatgaatcaggcccgacgacctttgatggtcgtcgggcctgattgtgttataggccggtgtttgcgatgcggatgcctgttcgcctgcctagcggccatgacgattgcacttatcgccgcagtcgttgtgatcgtggccatgccgaaacggcggtaatggcctgtacgcaccctagaataacggatatgacgcaatcgcagccccgatccaaacgcacgcccacccttgaaatctacgggagaatccttgacgcggcaaggcggatcgtggaacgggacggtgtggacggtctgaccatccgtgcgctgtccgcacaggccgatgtgtcgcccaccagcatctaccagcacatcggcggcaagcaggcggtgtgcgatgcgctcatcgacacatacttcaccgatctgcgcgaacagctcatcgccattgacgaatccgaccccgtgctgcgcctgcgcagggcgggcataatctaccgtgaacacgcgctggacgcccccggcatttacgcgctggtctggatggggcaggcgtcggactcggcccagcactgcctggacgccatcacgcagatcattcgatacggccaggcagcatctgtattccgcggcgatgacccccatctaatcgcatcctccatctgggtgtccatacacgggttcatccaattcgaactgcgttccgcacaaccccgcacacgcggccgcgaacgggtcgaccggtcgtacggttacctgctcgacctgctgatccgaggcattcagaggtgaatgagttagctccctctgatgagggagctcaccattgatacgctgtactgccatcggcgttgcggatggtgaaagtgggggattgctcgatgttgaggtccacggtcagggaatgctgggcgtcggcgctcgtcgaacgatagacgaagtgcttgttttccagcttcacggcctcggtacgcgcatccagcagccatgggttgcgacggcgcagcgcgatcagcgcctgatgcagccggtatgtcggctctcccagcgtggacagttcggcaggggagccggggaacttcggacgtacgtcgtcatcgccgccgaaacgctcctgcttgacgcccacatagccctgttcgtcgccgtaatagatgcttggcacgccgccgaccgtcatgagcaccgccaatgccaacgccgccttggccgggccaatctgcgatgcgatacgcgtcacgtcatggttgccgatgaacgtctgcggcacgaaggaatccaggaacgcgttgtgccgcttcaagttccaatccagctcgaagaagttctccgtctccagcgcatgctggatcgacttccatagctcgtattgcgtgatcgaatccatcgtggattcctcgatgatgcgcgggtaatcgccatggatcacctcgccgaaaatccacgaatacgggtgtgcggctttgacctgcggcaacacgcgcgcccagaacgggctcggcacggcatacgcggcgtcgaggcgccagccggcggctccgcgatccagccaatggctcatcacatggaccacatagtcaacggtctcgtcagccgaatggtccagcgccaccagatccccgtgcccctcgaacacatccaaagcgggttcgccattatcaccgacatgcgcgcggaccagaccatgccacgggttgtcggccggattcaagcgtccggcggtctcgtcaagcgccgcctgaacggccggatgattgcggctcacgtgattgaacacgccatccagcatcacctgcaatcccatgtcccggcaggccgcgacaagctgatcgaacgcggcatccccgcccaatcgcacatcgatatgcatatggtcgagcgtgtcgtatccatgcgtcgccgactcgaacaccggacccagcagcaggccggacgcgcctagatcgcgcacgtactccagccagggaattatcgcgtcaaggccgcggccatggaactggcgcgggccggcgggcctgatatcggcaccgcagaagcccagcggatacacgtgccagaacaccccgtacttcacccaatcgggcattgtgcggctcgaatccatgcttacaaccactgtgcacctcctgattgacaccgtgtccattttcgcacatcgcggtgcgaatcccgggtaatcggcatgaaacgcagtccgtgaacatgtggccaagctcacatattgggacattttcctgaggcgcgacatgccgtggctacgcttccaaccagtgccataagcagacgagagataccccaaaagggtcgcaatgaagagaacctttcccgcaaaggttattgaagaggaacagagggttattatgaccaccgccgcagcccaggccccggcacctggcaagttggaattcaaggacgattacacgccggacgaagccgaacgtgtgattcgcaattcgaagggactgcccgtaggcgtgcgtcccaaaatggtatggacatggaagaaggccctgctgtgggccgccatcgccatcgtatgtgcctgcggatgggcgattctggccgtctcgcgcggtgagcggatctccgccatctggttcctggtcgtggcgctgagctcctacgccatcgcctaccgcttctatgcctattacatccagatcaagatcatgcgcaccgacgacgcgaacgccaccccggccgagcgcgtgcatgacggcgcgaacttcgaacgcaccgaccgccgcgtgctcttcggccagcactttgccggcatctccggcgccggaccgctcgtcggcccgatcctggccgcgcagatgggctacctgccctccactctgtggatcatcctcggcgtgattttcgccggcgccgtgcaggacatgctggtgctgtggatctccgccaagcgccgcggtcgctctctgggccagatggccactgatgaaatgggtaagttcggcggtatgatcctatccatcttcctcgtggtgatgaccgccatcgccatggcattcctggcgctcgtggccatcaaggccatggccgcctcgccgtgggccgtgttctccatcggtatgaccatcccgatcgccctgatcatgggctgctaccagcgtttcctgcgccccggccgtgtcattgagaccacgctgctcggtttcgtgctgctcgtgctcgacatcgtcgccggcggatggatcgcctctatcccggccgtggccgccgtgttcacactggacgccaagcagctcgtcatcgccctggtgatctactcgttcgccgccgccgcgctgccgcactggctgctcgtcaccccgcgcgactacctgtccacgctgatgaagatcggcacgctcgtgctgctcgtcatcggcatcatcatcgccaacccgtccgtcaaggtgccgggtctgaccgaactggcctccacctccaccggcccgaccttctccggcaacctattcccgttcctgttcatcaccatcgcctgcggcgccctctccggcttccacggcgcggtgagctccggcctgaccccgaaggccgtggagaaggagaaccagattcgcatgatcggctacggttcgatgctcgtcgaatcgttcaccgccgtcatcgcgctgatcgccgcgatcaccatctcgcagggcgtgtacttctccaccaacatgtccgccgcacagatcaccgccgcatccggcgtgagcatctccgccacctccacgccgggcgaacaggccgatgccgccgtcaaggccgtggagtcgatgaaggtctccgacatcgaaggcaaccagatgcaggtcacctgggattccgtggacgagaacggcgcggccaagacctacgaaggcgccgcggcgcttgagcaggccgccgccgacatcggcgagacctccatcgtctcccgcaccggtggcgccaccacgttcgccatgggcatggccaacttcctcaagtcctacctgggcggccacgactcgatggccttctggtaccacttcgccatcatgttcgaagccctgttcatcctgaccaccgtggacaacggcacccgcgtggcccgctaccagatcggcgaaatgctcggcaacgtgcgcaagctcaagaagttcgccgacccgacctggaagcccggcaacatcatcaccacgctgatcgccaccgcgctgtggggcggactgctgtggatgggcgtgtccgacgcgaacggcggcatcaacgcgatggtgcctatcttcggcatctccaaccagctgctcgccgccgcctgcttcgtgctgatcaccgtgtgtgtggccaagatgggctactggaagcacctgtggataccggtggtaccgctcgtgtgggacatcgccgtgaccttcaccgccgacttccagaagatcttcgggccgctgagctacttcaccaccgcctccaagtatcaggcgcagatcgactccggcgagctgaccggcgaggcgctgaccaacgccaaggccgcgctgtccaacgcgtatctggacggcgtgctctccgtgttcttcctggtcatgatgggcgtcttcgtggtagtcggcatcgtggtcgtggcgcgcacgttcgccgctggcaagtacggtgccgaaacgacgtccgaggagccgttcgtggaatcccagtggttcgcgccctccagcctggtcgccaccgcgcttgagaagaaggtgcagcgcgaatacagcgccaagctgcatgagcttgtgcggaacgggcaggttgcagcgtagtgcgtcattggctccccttttttcaaggggagccaataatcagcgaaaggagacaaaatgctcggcaaactcgttgccgtatggcacggcatcgtctggtatctgcgtgagatcagcggcgaggcccgctacgaccattatcttgagcatttcgcggccgagcatcccggcgaaacaccgatgagcgaggtcgaattcattcgcgcccgcgaggaatacgaccgtctccaccccaataccagttgttgctgctgacaggccgcaatagcataacaacaccataaaacccgcgcgccatgggaactacgtagccattcttccgttacaatcagtgtgacggcttccgcccccgaagaagaaggtgttaattccccttggacgtctcactggcgcatttcctccaacaagtgctttccaacccggctctgaccgtcacaacgttgctgacgctgggagtcatcttcgtcaacggctggaccgacgcacccaacgccatcgccacctgcgtgaccacacgatgcatgcgcgtacgctccgccgtcatcatggcggccatcttcaacttcctcggcgtcttcatcatgacgcagctcaacgcctccgtggcctccaccatcagcaacatggtcgatttcggcggcgacacgaacgcggcgctcatcgccctatgcgcggcgctgttctccatcgtcgtatacagcgtgggcgcctcgctgctcggcatacccacctccgaaagccacagcctgatcgccggcctgtccggagcggccatcgccatccaaggcggcatcggcggcatcaacatgggagaatgggtcaaggtgctctacggtctggtcgcaagcctcctgttcggcttcgccgtcggctggttggtatgcaaggccgtgaccctgatttgcgctggcatggaccgccgccgcaccaacgggttcttcacctacgcgcagatcgtgggcgcggcggccatgagcttcatgcacggcgcgcaggacggccagaagttcatcggcgtgctgttcctcggcatggcgttctgcaatggccaacccagcgtgaccggtgtgatgattccgatctggctcatgattctgtgcagcaccatcatgggcgtgggcacgtccgtcggcggtgaacgcatcatcaaatccgtgggccaggacatggtgaaactcgagaaataccaaggcttctcggccgatctgtcaagcgcgctgtgcctgctcgtcatgaccgtgctcggcatccccgtctccaccacgcacaccaagaccagcgccatcatgggcgtgggcgcggtacgccgcctctccgccatcaacttcggcgtggtgcgcgacatgatgctcacctgggtgttcaccttccctggttgcggtctcatcagcttcgtaatggccaaactgttcatggtcgtgttctagaaaggaatccacccatcatggcgagacaaaaagacacgttctacttcgacggattccgccgcagcgcggactacgcatgccaggccgcgaagctgctgtccgaggtcatgcacgacttcaatccgggccagctgcgcgaacgcatggacagcatgcacgcgattgagaagtcagcggacgaggtgcgccacgacatgatggacgaactggtgaccgcgttcatcacgccgttcgaccgcgaggacatcgacgagctcggccacgtgctcgacgacgtgaccgacagcatcgaaggcgtgctcaaccgcatgtactacgacaacgtgaccgacatgcgcgacgacgcggtccagatgtcggatatggtggtgcgcgccacggaaagcatctgcgagctggtcaacgaactgccgcgattccggcattccaagacgttgcgcgaactggtgttcgccatcaacacgatcgaaacggacgccgaccacctgttcatcgagtcgatgcgcacgctgcacaccacctgcaccgatccgctgcaggtgttcgcctggcatgacgtctaccgtcacctcgaacagtgctccgacgactgcgagcgcgtggccaacaccatcgacagtatcgtcatgaaaaacagctgaggttggtttttcacaacctccctctgatgagccgagccgtgaagaaaacgccggaggcgtttttaggcgagggtgagtgacaacgagcgaataagaggtcagctgcaagctgtcctgaatcgcgttcgaggtggcatcgcgaagcgatgtcggagggagaggcctacttgaccaaaagccccctcacctatgggcgttgagccagaggatggcgagttgggtgcgattggtcaggccgagcttgtccagtatcgcgctgatgcgattgcggaccgtgccttcgctcaggaacagtctggcggcgatgtcgcggttatcgaggccctcggcgaccagcgcggtgatctcacgttcgcgctcgccaagcaggccctcgatggaatcggcggtatctctggaatcgtcggaatcggcaggatccggagttcgttcggtgagcttgccgagcacttccgcgccgagcaccacctgaccggccatcaccgcctgcagcgcgggcccgaccgccgccacatcctgtttgatgagatagcccttggcgccaagtcccatcgcctgcgcgatatacgactggtccgcaaacgtggtcaggaacagtatgcgcgcggccgggtccgtggccagaatctcgcgcgcggcatccaaaccgctggtgccgggcatctgaatatcgatcagcagcacgtccggtcggctcgccggtgtctcgaaataacggcgcacggcggcgtctccgtcatttgccatccatagcacctcggccgtgccggtggccgtcagaatcgtctccaacgactggcagacgatcggatcatcatccacgattgcgattctcatcaatccctcgattccatggtccaacgcttcttcggcacggatacgaacacacgccagccgtcctcatacggcccgcagaccgcggtgccgccaagggcgcgcacgcgcgattcgatatccgccaaacccatgccgcgcattagctcatcggccgaaccacgcatatcggcaacgccgtcggcggcgagtcgcgagccgacgtgcgtggcgcgcatcgcacgcgggcgggcagcggccgtccgggacccatcggactcggacacggccggccccggatcctgaatgaccaactgccagaacgcggggaagtcacgcaacgtcacgctcgcctcgcgcgccgcgctgtgatgcaccacgttcgacaatgcctcgcgaatcacggtcgcgaaacagcgcgagaccggcgcaggcgccttggcgatatcgttggccagcgtcacggcgaaaccgggggagatgccgtcgaacgacgtgacggcatcatcgatctgcgcggcgaaatcagtgccatcatcctcaagatcatgcaccgaacggcgcaccatcgtcatcgcatcatccaacgtcgcacccaacgtggcgaacccttgcgcagcgaccgtatcgttcgtcgccttggccaccgttttgccggcctgcgcctgcatgatcgcgcgggtcagcagatggcccacattgtcgtggatctcccgggcgatacgcgtgcgctcgccgagggtcgccatgcgaatcgactgggcgcgttcctcatcgatgtcggcgatgcgcgaacgagtggcccgcgaggattcgcgcgccctgtcctgcgcgtgcagcaacgcgcgccgcgcctcgtccgaggaggcgcgggcccggcccagaacgaatccaagcagggcgaccagcgtcatcaccagcgtctggagacggtcggtgccacgggcgaaccaaagcgcgatcagcggcaacacccatatccagcgcgcggcggccgaaagccacggggccgaacgcattgcatcggcaagggaacggcgagaggccgcggtccgcgagacactgggggagcggccacttgccgcagtccgtgccccagcccgggctccggtcgaggcgagggccggcagccgtgcagtatcgtaggcgatgagcggcatgaacgcgcaccatgaaggcaccgccacggcgatgacgagatacgccgtacacaagacccaagaccattgcgcgggacgcagccattccaccaatccggcgacggaaacggccaacagcaggccggcgatgaacacgccatcggaccgtagcccgacaagccaggccaaagccaggcccaacacgagtagcaagcccatctcggccaacacgcgcatggcacctccccggctcgacgctcttccaccaccagtctagcggtgtgcggaacacgacgaacttgacgggcgtgcggaattacccgcatgacggtccaagacaacgggcctacacttcccgaatagatgaggcacaagcgtcggatgtcgtcgacacaaccgtaaagggatgataccgatgattacgcaaagccacagggcgtccaactattcgatggacgagatcagcctgatgccggtcgataaggtgtacaaggccatgcagaccgacgccgaaggactgtaatgacaaatgtcacgcctgtacggccaagtcgtgacgtttgcctgtggcggcgtccggccccttcttgggatgatggaatcgccaaggaagggagtgactatgacaaccgacaacagagcttccgaacacgactcgacaaccaacccggctctggccgtgcacgtcagccaactggtcaaacgctacggcgacatggtggcgctcgactattttgaccttgacgtgaaccagggcgagattttcgggctgcttggaccgaacgggtccggcaaaaccaccgcgatcaactgcatcctcgcgctgctcacctacgattcgggcacgattcgcgtgttcggccagccgatgacgccgacctcctacgcgctgaaacgtcgtatcggcatcgtgccgcagaacgtggccgtgttcaacgaactgaccgtcaccgaaaacatcgactacttctgctcgctgtacgtgccgaagaaaaccgaccgcgcgccgctggtcgaggagtccatcgaattcgtcggactccaggacttccgcaagttccggcccggcaaactgtccggcggtctgctgcgacgcctgaacatcgcctgcggcatcgcgcacaagcctaacctgatcttcctcgacgaacccacggtcgccgtcgacccgcaaagccgcaattcgattctggaaggcatccagcggctcaaccaggccggcgccacggtgatctacaccagccactacatggaggaggtcgaacagatctgcgaccgcatcctcatcatggaccacggccggcacctggcgctcggaaccgccgacgagctcaagaacatgatcgacacgggcgagcgcatcaccatcgaaacgctcgatctggcggattcggcgatggccgaggtccgtgcgctgccgtgcgtgatcgaagccacctacgacggcaaggaactcgacgtgcgatgccgtcgcggcgaacacaacctgaccgacgtgctcgacgcggtgaaacgctccggcgccaacatcggccacctgaccagtcgcccgcccaccctcaacgacgtgttcctcgaactcaccggcaaagcactgagggactgaccatgctcccctcagtcggcaagcaaataacttggctcccctctccgaggggagctgtcgccaaaggtgactgaggggagttcctgagtaaggagacatcatgtggaccacatttctggtcgcattgaaagcgaacttgcgtaaccggtcggcgttgttctggatgaccgtgttcccgattgtgctggcgaccatgttcaacggactgttcggcgggctggccgaagcatacgaactcaagccggtgccgatggccgtcatcgaagacacccgttggcagcaggcggacggtgcccgcaccttcgtagacgcgctggccggggaaacggaatcggcctcagacgacacgacctacgccgaaatcgaccaaaagctgctgaccatcaccacagtcgacaccgtgaaggaggccgaacaacggctcgccgacggcactgccaacggctatctgaccgccgacaataacggccgattggcgatgaccgtgagccgggaaaccgccgtcacagccaaggactccacgcaaaacagcggactggacattagcctcgcggccctgcgcagcgtcatcgacctgtacaaccgcaccgacgccgttacccggcagaccatcgccgacaatccacaggccgcgctcagccggaacttctggaacagcgtcgggcagaacgtcgacatgacccatgagacgacgctcacgcatttccagcctgacgagatcgcccgatactattacgcgctgctggccatgtcctgcatgatggccatgggatactccatcagcacagtcgccgccgcacaggcgaacctgtccgcgctgggcatacggcggaccgtagcgccgctgagccgggccaaacagctcgtcgcgggcttcctctcctgctggctgtgctcgtcggtcgccctgtccatcgcattggcctatatccggctcgcctgcaacgtctcgctcggcggacgcgaaccggcggcgatcctcgcggtcatcatcgcctcgttcatgaccagctcagcaggcaccctgctcggtgcggtgccgaagctctcgtacaacacgaaatacgggctgtcgaccggcatctcctgcacgctgtcgctgttcaccggactgtacggcgggtttgccatgcagatcagcgactggatagcccgcaacgcgcccatactcggcaccatcaaccccgcacagcaggtgacgaacctgttctacgacatcctgtactacgacagctaccggccgttcatcaccacctgcatcattctgctggcgatgagcgcggtattcctcttggccggcatcgcaatgctgaggaggcaacgttatgaacacctgtaaagccacgctgcgcgtgctgttcgcgcaccgggtctacctgatgatctacctcgtattcataggcatcctgatgatgtccatcagctgggcgatgctgacctccgcatccggctccatgtccgcggtgttcgaatcgaccaagacgcgcgtcgccatcatcgaccgcgactccgaccggggtgatatcgccacgtcgatgcgcgcctacctgcgcgattccagcgaactggtggacctcgacgacaccagcgaaacgctgcaacaggccgtcgcctcgaactgggtggacctgatcgtcatcattcccgacggattcgctgacgattatgtcgccgcggcggcggacggcgacaatccgccgaacgtggacacggttaccagctacgcatccggctccgggtcgatggcgcggatgaacgtcggcgggttcctctcgctcacccgcaccgcactgatcggcgcgcagacgagggtcgaccaggcggcgctcgccggcatgatgaacgctacaggaggggccgccggttttgatggcgcgagtctggaccaagacatgctggactcgctgccggaagggcaagtcgacaagccggatatcaaggatctgtcccaggccgccaaaatggccgccgaatcggccagcgatacagacgtgaaccatcagatcgccgtggtcgatacgccgaccgaggagtcggcaagcgctgcggatacggcggtcagcggattcggcggcaccatgaaaaccgcgctgtacccgctgtccctggcgatgaccatctgcggatcgatgatcctgggcgcgttcaccaccggcgaggtgcggcggcgtctcaccgcctcgccccgacgcatggtcctgatgggactccagcggttgctgacgttgggcggattcgcgctcgtcgtatgcgtcggctatttggtgctgtcaatcggtctgatgatggcggcggggctcgatccgttgcacctgagcgtcgggggagtgctgatgacgttcggcgcgacctgcgtgtacgcgctgatgaccgtcgcctgcggattcatgctcagcgagttcgggctctcggaagaggcggccaacgggttcgccaacatcttcggcctgctcatcatgttcacgtcgggtgtcgcattgccgattgacatgatgcccggcgtgatggtgaccatagccaagttcctgcccggctggtggtattgcaccgcgatcgacaacgcgctcggcttcggcacggcggcggaaaccggcataagcgtcgccggctggtccggctcgctgggattggtcgcactgttcggtgtgatgttcatctgcatcggcctggccgccggccgcttccgccgatcccgccccgccctggccgcgcccgccaccacgcagctggccgagtgagaaatcagcctttcaaccgataccgctgtgccgggtcgtcggcgaacttgactcgggcgacccgcccttccttcatcagctcgcgcataccggatgtggcggccagcggcgtcaactgcagttcgcgcatgatctccttgacgctcatggccgaatgccgctccagtacggtcataatcgccttgaccacgtcgcccggtgaactgttcgccatcgtgcgctgcttggtgatggtcatcgtgaacgtgttgatgtcgttgcgcgtggtcgccggctcgatgccggcctcgcgcaacgcggcggcgatgcgctggtagccgtcgccgccttccgggttcacaaacccgccgcccggatacggcgtggactccagcagcgtgaacaggaactggtttcgggtggagacgaacggcgcgcccgtcaccggatgagggctcgccagcacatcatgtgtcaccatgccgtacaggccacccggattggtgatctcgatgcgatcggtgaacacgctgatatgcacctgcgtgccgcgcgcatcgggcgaataatcacggtgggtgagcgcgttcgcaatcgcctcgcgcaacacgagcggcggatagtcgggcttcttcgcgccaatccaacgcatcaacgagtcgaccgcatcgtcgatcatcaccggaatcgaaccgaccaccgacttcgaggcgaccaatcgttcgtcaccccggaacacatcgtcccggctcgtccccggaaacacggcaatcgaaatgccgagccgcggatagaacttctgcggatagcggcccaacgccagcagtccggccaaggtggggcgcaggattccgccgacctccgactcgtcggaatcatcatggcgcaacacctgcagatccagcagcacatcgatgccgtctcggtcggcgaacacgcgcggatgctgttcgcgcacgcgtgccaacagtccggcaacaagctgcgggtcgaggtcatcggtcgtggcgtcgggcacgatatccagatcgtatgtgggctgcagatgctcctcgatgagccggtcgacctcataggaggtcatgcgccggtcgccgtcgccggtacggatgaacgagccgccgtgcggtccgagcgcggtggtgaagcagggcttgtcgcgcggcagcatctcgtcgatgcgcgcgaacaccagattcgcgccttcgaacgggcaggtgacgatcacgggccgcaccaccggcgtcatcttctcgcacgcctggctcagcgcctcctgcatggcgcgcgcgtcgaatccctcgaccggcgtgaacccgttcttttcggacaggcccaggataatccagccgccggagccattggagaacgcggacagcgtatcggtgatggtcgaggagatcttgcgcttgcattccttgacctcgcactgttgcgtatcgttgccgatcagacgcatgagttcgatcagctcagtcattttggcagtatagtcatcgaccatggcggcctccttgaaaccattgtgccccataatccgccgcccgctcgcctccagccccgccagttcaccccaattcatgcagaattcatgggccaaaccagacgaaacgaacgtcgatgtagggttcggttccgcgtgttcgccgatgatatcggccggtcgaggcgggcgggctatgttgggtggcgtgggaatcttgcgcgtgattgatgctacggctgtgtgcttcgctctgggtatatccggcccgatcagcgggactcagccaatgtgatgccgcccgcagccatctgcttgcgggccgcaacaccaagttcctcgctgaccggcacggtcagatcctcgaacacggtgacctcgaagccgagcttcttggcatcgagcgcggtgtccttgacacaatgcgattcggcgatgcccaccacatccacgcgactcacgccggcggccttcagcgcgttggccagcgtcttgccggcggattgctcggcctcgacctcctcgcgggtctggatacggtcggtattgtcctcgataccctcaaaaccggaatatgccgccgaatactggcccttcttgaaatgatgctcgatattcagcgccttgatcgccggatgcaattcggcgttcagcgtgccggccgcaccatgcttcggccacgtgtccacgaaatccggctccgccgaccagtgcgcgcccggctcgatatgccagtcctgcgtggttgcgatatacgcgtactcgctgcgatgcgcgttcacataatcggcaatccgctcggcgaccgcgttgccgcctgcgacacccagttcgccgctttcacagaacgtcggctgcacatccaccacaatcagtgccttggtcatcgtcattccccttattgccttggattcgttttgaatattgtctcgaactcgacgtgcgattgctctcatcatagccatgcgcggccctgtgggaaacgttcgggcttacactgcaagcagcaatcgaatacaagaaccaggggagggcgaccaagaccatgctggaccatctgacgttgcacgtgaaagacatcgaccgtagcatcacattctacaaacaggcgctcgcaccgctcggctatatcgtcaaggcgcatcatgagcctacgctcggattcggcgtggatgacggaaccctgcactccgatttctacgtgtcaccgattgaagggctggaggcggaggcttcgccggtcacgccggtcacacacatcgcgttcttggctgacagtcagcaagccgtgcaggcgttccatgcagccgcgctcgccgccggcggccgagacaacggcgctcccggtccgcgcccgtaccatcccggctattactccgcattcgtgctggacccggatggcaataacatcgaagccgtcgtggattgggctcattcgaacgagtaaaaacatatccgtatcgtgcctcaggcggcatcgacggcgtaggctccaaccagtcggatttgtggtcgcaacggcggtataggtcacatcacgcaagcgtgaaggtgatggtctgctcggcggtttcggtgccgatccatgtgccggctttgcggttccaatccatgccgtccgcgtgcagtgcgtcaatgccgtattgacgtgcatgcgtgaccagccagcctgccgtctgccagcaaagtcgagtgcggttgtcggcggacaggccgtccggcagcgtgatcgtcaacgttgtgctggccgtattggtcgcagcgccgttgttcgtgccggttttgccatttgggggcacaaccgagacattgacattcggcagtgtacctcctatggcggcaaccaacccgtccgcgtccgaggaggttgctggctccaacgcgcacgtgacgcccgccgaccgttcaccggtcagccccgaggcccaagcgcgtgccatcgcatcccatgtggcatatagttccggatagcctgagcgctgcacctcctgcgcggcgtcctccaccggaatcgtctcccaatccggcacctgcagcagatgatcgtagaagatgtttgtcgcataggtcatgtcggacacctgctccgccgtgccccagccttggctgggccgctgttggaacaggccgatcgaatccaagtcgccgtagtccagattcgtcagcctcgactcctgcatggccgtggcgatggccaccgtcgccgcgtgatccggcagtccgcgcgtgacggcgatgttcgcaatcagcgccgcgttctgcgcctgatcaggcgtcaaggtgcggcgggctccgtcggacgacaccgccgcgcaatatgcttcctcggccgtgcgcgcggtctcgcgaggcgtgaatagccgtggcagcagcgtccatgccgcgatcagcgccgcaacaacaagtatgacggctgcaatcagcgcgcccgcgccatgggagcggcgtctgccgtaccgcacctgttgtcccattgcgcctccaatatttcggtgtcatggctgaccgtgaccggctggcctatgcagcatgcgagatttgccgtgttccggctcggccgtcatcatgacagcgtggcatatccacctgaacgacggctgcgccatcacgcgactttgtgacaattcttcacgcttcctgacatccgcgcaaatcagcccctcgaaaccgagaatggcggtcgggattgctccgacaccaagggagctgctgccgctattgtgtgaagggcgatttgtaccgggttgaaggagaggaacacatggcacaattgcagccgtactgcgcgattgagggcaatgatgatggattgcccgtcgtgttcgtgcatggcatgggtgtggaccatcgctcgctgatgatgctcgacaaggcgtttgacggcaatgattcaattcgacgtatatatctggatctgcccggtttcggccgtacgccggcattgcccgagcatgcctgcggactgccggaaatagcggattggctgcaaacggccattgacggtcttgtcggtaaagcggctccattcgccatggtcggcaactcgatgggcggtgcgcttgtccgcgaagtattggcgcgcgaacctcgccgagtggccggtatggcattgatcgcgccggtcgtggacccgcagcatgccggccggcatgtggccgaacatgtggttgcacagcccaatcccaagctgacgcactccttgccacaggaacaggtgttcgatttcattaccatgggcgtcaaccagtcattcgacgcgtggcgacgctaccaacggttcatcctgcccggcgtggcgttgtgcgaccgtgcggcatgcaaacgactggatcagcgctattggctggccgataatcccgaggaaatgctcggcatatatgcgggtccggtgctcatcgtcaccggcaagcaagaccagatcgtcggatacgaagatcagcaagccctgttgccgcactatcccaacgccaccttcgtgacgttggacaatgccggtcacaacgcgcacatcgaccaacccgaagccgtcatcacgctcgtgcgcgaatgggtggctcatatggcgttcgctccgttgagctgacggtctgctacagtctgccgaagcctatatgcatatgagcgaccaatgccggttgacgcaatacgccttgcaaggtatatcgtttttcgatatagtcatatcgatgttcgcggtgtcgccaaaaaaacgtcggcacctgaaaggaccgggctatgaaaaactacatgaaccgatgggtgttgctcgcgttgaaagccatcgtgattctggtctggctggcctgcctatggggccaactattcgccgtaccgggattgagcggcgcgctggccggcctctacccgagccagacgtcgatgcactggccatatctcattatgggcgtgctgttcctgttctgcatcgaagcggcgttcgtggccgtatggaaactgttctccttgtccggctcgggcgcgaactcgagcaggtgatttgagatgacgattcgcatcaatctcgacgtcatgatggccaaacgcaagattggcgtcggcgagctcgccgaacaaattggcatcacgcccgccaacgtgtccattctgaagaacggacgtgccaaagccgtccgcttcaccacgttggacgccatctgcaaggcactcgactgccaacccggagacatcctcgaatgggaagatgacgattgatcgacacgccaccggctcgaactcatggttcaacttgtagtctctcccaaaatcaatgatgccctatcatcctgcaagacgatagggcatcatcatgtgattatgcgcagctgatatgtcgcgttgttatcactcggcgtccgcggccggtgcctccttgggcgcagagaggaagtgctcctcgctgggcagcacggcgttcaggatcacggccaccacgaacgccacggcgatgcagttcgaggcgaagatttgttggaacagtgccgggaactgcgtgaagatgtcgctcacctgggtgaagccgatgccgatggtcagcgaaagcgccgcaatcgtgatgttgcgctgcgtgaagcccgcctcggcaatcatctggaagcccgaaagaatgatgttgccgaacatcatgatcgtgcagccgccgagcaccgcctgcggcagcgagttgaacacctcggcgatggccggcacgaagctcgccagcaccagaatcagtccgccggagagaatcaccttgcggttgacgaccttggtcatggccaccaatccgatgttctgtgcgaacgaggtcagcggcagacagccgaacaggccggatacggtggagatcaggccgtcgccggctatggcgcccgcggtctcgcgttcggtgggcgtacggttcaggcccaccttggtcagcgcggcggtgtcacccagcacctcgaccgaggagacgacgtagagcaggccgatggagatgatcgagccccagtcgaactcaggcttgaacggcatgaactgcggcacggacacgatggcgaggttctggaaaccggagaaatcgaccttgcccatgcagatagccgccacatagccgaccaccagaccgaacagcacggacagctgcttggccgtgcccttcatcaacagctggaacgccaggcaggcaaccaaagatataagcccgagcgtcaggttctgccaggaaccgaagtccttggctccgctgccgccgccgaagctcgtggcacccacgttgagcagcgagaatccgatcgacgtgaccacgatggcggagacgatgggcggcacgaaccgacgccaatacttggccgtcaagcccagcacaagttccagaaggccgccgaccattaccgcgccgaccaccgcgccatagcccttgtccgcgcagatcgccacggcggccgccacgtaggtgaaggagatgccggtgaccatcggaagtcgcgagccgatgagccacgcgccgtacagttgcaggcaagtgcccaggcccgcaaccagcaggccggactggatgatggtggccgattgggccggggtcatcttcgcggccgaggcgacgatgaagatcggggcgaggttcgccacgaacatggccatcacatgctgcaggccgaacggaatgcccttccagaaggatactggcgcgtccagcgaagacaacgcctcaaaggatacggaatgattggttttcttctctgacatgattctcttcttctctctgttgctcccgccggcgggagcagccaatgtgctcagtgcctaaatgtgatttcgccggtctcgggattcatggactcgacgatggccagcgaatccacatcgtagccttcagcgcgcagcgcgtcaccgccgccctggaagcccttctccacggcgatgccaatgccctcgaccgtggcgccggctgcttcgcacagatcgatcagaccgcgcaacgccttgccgttggccagaaaatcgtcaataagcagcacatggtcgccggcgttcagatacttcttggccacgatcaccgggaactccttctgcttggtgaaggaatagaccgtggtggtgtactggtcgccgtcaaggttgatggactgcgccttcttggcgaacaccaccggcacattgccgaaatgctgggccgccacacacgcaatgccgatgccggacgcctcgatggtcagaatcttggtgatgtgcttgccggcgaaatgagcggcccatgccgaacccatgcggtcgaacaggcgtacgtcgcactggtggttcagaaacgcgtccaccttgagcacattacccgccttcaccgttccctcgctttggattcgctcctcaagttcctgcattgaacctcccattgttgtatgtcagtgaatgatatggatactcgtaagtgtacgttgtcctgcgctgacccgtgcatgtggtaaacatgaatgtcgcgattcaaagggaggcaacagtgtacgacgagccggaagtcatcgcacgcagcgcacaggaactcgtgggcgacctgaacccgcagcaggcggaagccgtgcaataccgcggtcaggcgctgctgatcggagccggtgcaggctccggcaaaacccgcgtgctgacccgccgcatcgcctggatcttgagccagttcggcgcatggccgagccagattctagccatcaccttcaccaacaaggccgccgccgaaatgcgcgaaagactcggctcgctgatcggcccggtggcccagcgcatgtgggtctccaccttccactccgcctgcgtgcgcattctgaggcgcgacggcaagtccatcggactcaagtccggcttctccatctacgattccgccgactccgagcgactcgtcaaaatcatcgccaccgaattcaacctcgacatcaagcgctacactccacgctcgattctcggccatatctccgacctcaagaacaatctgaccggttggaaggaaaacctcgccgttcacgcgcccgacttcacgcccggccagcgcggctaccagttcggcacggtgggcgaccttgaagccatctacgcggtgatctacgccgaatacgagcatcgcttggccctggccaacgccgtcgacttcgacgatctgatcggccgcacggtcgagttgctgcgcactgacccggccgtcgccgagtactaccatcaccgcttccgttacattctggtcgacgagtatcaggacaccaaccacgcccagtacgtgctcgtgcgcgagctggccggcgtggacacgggggagaaggccatcccgggcgcgcctaacgccggcaagtccggccccgcctggatcaccgtggtgggcgattccgaccagtccatctacgcgttccgtggtgccgacatccgcaacattcaggacttcgagcaggacttcccgaacgccaagaccatcatgctcgaacagaactatcgttcgacgcagaccattctggatgcggccaacgcggtgatcagcaacaacgagggccgcaagcccaagaaactgtggaccgcgctcggcaagggcgagccgatcgtcggctacgcggcggacaacgcccagcaggaggcccagtgggtggccaccgaaatcgcgcgcctgcacgccgaagcgggcatcgcctactccgacatggcgatcatgtaccgcgccaacgcccaatcccgctcgctcgaagaggcgctgatcaacacgaatcagccgtatcagctcgtcggcggcaccaagttctacgaacgtcgcgaaatcaaggatgcgctggcctatttgcaggcgctcgtcaatccggacgacgatgtgaatctacgccgtattctcaacgtgcccaagcgtgggcttggcgaccgcgccgaaggcgtgctgctcgcctacgcgcgtgagcatggcaccagcttcttctacgcactcatgcacttggatgagatcgaggtgccgacacgcaccgccacctcgctacgagcattccgcgatctgatgggcgcgctctcgcagttcacgcgcgcgcacgactccaagcccagcgagatcgtggccgaagtattggagaagtcgggcttaagggccgaactcgagaaatccgtggacccgcaggacgcctcccgtctggagaacctctcccagctgcagtccactgccgccgaattcgaacagaacacgcctgacgccacgttgtccgcattcctggagaccaccgcgcttgtggccgactccgaccaactacccggcgaggcggaggactccggcaaggtgacgcttatgaccttgcacaccgccaagggcctcgaatacccggtggtgttcctgaccggcatggaacagggcaccttcccgcattcgcgttcgatggaagacaccactgaactgcaggaggaacgccgactcgcctatgtgggcatcacgcgcgccaagcagcgactgtatgtcacgcgcgccgccgtccgctcccagtggggccaggccgccgatatgatgcccagccagttcctcgacgagattccggattcgctgattgattggaaacgccgtgaagccggcgtggagcgtatgcgcgccagctgggagaccgatggattcgccgacgatttgggcggctgggatgatgacgattttggcggcgccgcgtttggcgggtcgtcgacgttcggctcgcgtggttcgtccggttcgggttcgtcctatgggtcgcggtcgcggtatgggtcgtcgtatggctcgggttccggctcttcgtcgtatggttcccgttcatcgtcgtatggttcccgctccggctcgtcctcctatggttcccgctcccgttcccgttccggttcttcgtccggttcatatggtggcacccgtggcggcaaagtcaccacgcgtcgtaccgcaccgaaatccgattcgaccggctctgccgtgcctagctcgaagctcaccaaggacaatggcctgaatatcgccgacttcgccgtgggcgacatgatcagccacgaccagtacggtctcggcaaggtcaccgacgcacaagacaagggccgcaattcggtaatcaccgtggacttcggctccgccggcgtcaaacgcctcatgctccgcgtagcgccgattgagaagttgtagataaattggcccctctgacgaggggctgagttatataccaaataaattcgcaaaaaacaagacttgtgttcttcatcacagtgtgggcataatgcggaggttgtgcctacgagccctgggaacaggggagaggaaaaagtagttatgaagaacaagctgtttgcatccgtgcccaatattctgttcggcgcgctgatcaccatcgcgccccagacctttgcgcacgcctgcaccggccatgacatgccgggtgcctgccactactcgcagcaggcggccaccggcatcggcgtcgtcatcctcgtgttcggcgtcgtggctttgttcgtcgccccgcagattcgcatcggcctcaatatcgccgccgcagccgacgccctgctgctactcgccgtacccacctttctgatcggcatctgcaagggcgcgatgatgcactgccgcatggttatgctgcccacgctcatcgtgctcggcgtgctcaccatcgtgttcgcggccatcgccatctggctcgactctcgcgccgccaagcgcaactgatcgagcagacggccggagcccagccattgcgaacgctggactccggcctcgcttattgcaaccgcactataagcaacataaggactcatcgtgccatcccatatcgcattgcgcggccttccgattgaaaacctcaaacgcaagccgttccgcaccggcgcactgctcgccgtcgtcaccatcctcgcgctgacattcttcggcggcaccatgctgaccatgaacctcaacactggcatgaccagtatggagaagcgcctgggcgccgatctcatggtcgtgccgcaaaacaccgtgcagaaggccgaagcgctgctcaccaacggcaatcccagcactttctatttcaccaaagacatcgccgacgaggtcatgcaggccgacggcatcgcacaggccaccgaacagacctatatatcatcgctggccgccgcctgctgtgccgaaaagctgcagatcatcggttacgacccggacactgacttcgtcatcgaaccatgggtcgcctcccagttcgaaggaccccttgaagacggtcagatgattgcaggcgcaaacgtcaacgtgtccaccgacggcaccatcgaactctacggccgttcatggccggtcgtcgcccagctcgccaacaccggcaccagcctcgacaactcggtgttcatcaaccaaaacaccgtgcccgacatggtcgccgcctcggccaaggtctccaagcaggtcatgtccgccgaatatgccggcaaagccgtctccaccgtgatgattaagacgcagcaggggtacgaagcgcagaccgtagctgagaacatcaagcgtcttgactcccgattcgccgatttggggtacgtataccccggcggcatcaccgccaacaccagaacttcgctgaccgcgcttgtcacctacctcaagattttcgtggcggtgatctgggtaatgggcgtgattgtgctgctcgccgtattcgcctcgtcggtgaacgaacgcaaacgcgaattcgcgtccctgcgcatcatgggcgccacgcgcggcatgttgaatgccatcattctgaaggaatccgccatcatcggtctgatcggtggcgtaatcggcgtcggcgcggccagcctggtgattttcccattcagttcgctgatcggcaagcagcttcaattgccgtatctgcaagccagcccggttgcggtgatcggattcattgccgtgaccattgtgtgctctacggtcatcggcatcatcggttcgctggccaccatgtggcgtctcggccggcccgaagcctacctgaccctgcgagagggggagtgatatgactgagacaactacgccgcttcagccgaccacggttgagccgaccaagctccagccgaccacgccagctcagccgaacgcgccgactgcgccggattcgccgcacgtaaccgagacgccctccccggaccatctgctgaccttgacggacctgacccgccagttcgtccgccgcggcacgccgttcgacgccgtcagccacgtgaacctcaccgtcgatgccggcgaattcatcgccatcgtcggccggtcgggcaacggtaaaagtacgttgatcaacatggtcgctgggctgattcgcccgacctcgggaaccgtgagcgtggctggacgcaatgtgtccgacttgggcgataaagcactgtccgtgctgaggaatcgcaccatcggattcgtgactcaaagccagaccctgctcggcaacctgaccgtgctcgacaacgtgattctgcccgcaacgatgtttccggagccgctgccgttcgcccaaaacgcagaagcaacggatgccgttgctcaggtggacgctgttgcgtcgaccgatgctgtggcacaagccgctgccaccaatgatgaatcggccgccgattcggccgccgacccgttcatgccggatgtcattgcgccaatcacagaccgggaaaacacgccgtcaaacacggctgcgagccgttcggacctgttcgccacccgagctcgcacgctgctcacccagcttggtgtcgccgatctggcagacagctacccgcgcgagctgtccggcggtgaaatgcggcgcgtctccatcgcccgcgcgctgatgaaccagccgagcctgctcatcgccgacgagccgaccggcgacctcgaccaagagagcaccgacatcgtaatgcgtctgctcagagaccaagccaacaacggcacggcgattctcatggtcacccatgatcccgatgcactcgaatacgcagaccgggtgtatcgcatggacgccggagtgctgtccatagcctcggtgtaatatggtctgctggtgtctgccaacaggtagataccgtctggagtcatagcccatcagcgggtcggcggtaggtaatcgcaagagaaccaacccgttcgtgttcgttcacgacgaagcgctggggaggcccgactcagcgcttgccaggcatatgcaaggcaagcgttccgttcagataacgacagaaggattaatccaatgacgaacgttcagcgttctcgccgtcaggtgcgtctgtctcgcgccctcggcatcgcactgacccccaaggctcagcgcatcttcgaaaagcgtccgtacgctcctggcgagcacggccgtgaccgccgccgcaccgagtccgattacgcggtgcgtatgcgcgaaaagcagcgtctgcgcgctcagtacggcatctccgagaagcagcttcgcgccgcttacgagaaggccacccgtactgccggccagaccggtaacgccatgctgaccgatctcgagacccgtctcgacaacctggtgctgcgtgccggcttcgcccgcaccaccgcccaggcccgtcagttcgtggtgcaccgtcacatcctcgttgacggcaacatcgtggaccgcccgtcctaccgcgtcaagcccggccagaccattcaggtgaaggccaagagccagaccatggttccgttccagatcgccgccgaaggcgtgcaccgtgacgtgctgcctgcggtccccggctacctcgacgtgaacctgccgtccctgaaggccactgtgacccgtaagccggaggtcgaagagatcccggtgcaggtcaacatccagtacgtggtcgaattctacgcccgctgatccgggccctctggtcaacaaatccaggacataccgctcgaaccccgcgcttctttcgagaagccgcggggttcctgcgttgtagggcgattactggccgcacaccgcctggcgaatcatcgtcgcgtacgcataggcgccggtcatattcggatgaatgccgtcatcgttgaggtattcgctatgaccttcgctatacccatgccaatcgatgatgcccacgttcttgttcttcttggcggcctcacgcagcatcgtattgttgttgttctcctgccacgggtatggcatacggatggtgatgaagtatgtcggcttgccgccggtcaggtcaatgagctgttgcacttcctgctcattcgaaatcacgccgttcgtgccgaggccaaacaccaccacactgccactgtggccggcagcggtgtcctgctgatacacatccaccgcctgcggcagctgacggttcggcaggccatcgataaaagcgttcgggaatgcggcctggatggcgtccgaagtacccgacgtcactgaatcgccgaccatcatcatatccgcgttgcagctttccgttgccggatcataggcgtacttcgaaatgtcaagattgtttggcaccttttccgcaatcggtttgatgatgggcggctgagaatccgaaccgttcttattcgcgtcagcggtattggtttcgccgttcgcggcatttatggcagaagactcgggctcgggcttcgccggtttcttgaccggcttggcgggtgccgcgagttcggggcgcagctgaatggctcgcgcttgagcgatgccattccagtccaccggtgcccacgtcagcgccacaacggtcaccaatccgataaccgacatgacccacgcgcccgggcgcagccggtagccggctttcggcagcggcttggcgtgttggctacgaggcatctgcaccgatttacgggccgcctcgaccagctggtagaaggcttccgacgccgccaacaccacgacggcctcaagaacccaaccccaccacggcaacgcctgcgttcgtgtcgccgggttcatgaactgcagcagcggataatgcatgacgtacagcgagaacgatcgcgacccgatatagcgtaggggagcacaacccagcacgtgcgaccagattgagtcattgttcacggcacaggccaaggcgcacaacgatatgaacgcggtaatcaggtacccgccttggtacatgtacgacagatacccgttggcgaaccagaatccggtcagcagtgccgccaaagccgcggtgccaagaacattgcagacgatagtgagacgggcgcccgtcttgtcgccggcctgacgttcgatctgcactgtttgcgaagccgctccagcttccgcagcttccgtacctcgcgaggaaggcgcaatccagatagccaacagcgcgccggcggccagctcggcgaggcgagtatcggtaccgtaatacacgcgggaggtattggccgggtcaaacagcagcaccatgtcggcggtggaagcagccatgatgacaagaatcgccatggagcgcacccatttggacttggtgattttgccgagcaccaccatcagcaacggccaaaccagatagaactgcatcgtcacgcccaagaaccacagatgggtcagaggagaaggcaatccggccgcctcgaaatacggcaccttgcggaagatgtacacccaattgctggcgaacaaggcgctcggcagcgaatcggaaaccactttctgcaacaggctgggagcgaacatccaagtgagccaaggcaccacggcaatggtcgccagcatcaccggccataaacgagtaatgcggcggatcagatatcggccatatccaaaggacccggtgcggtccaccatgttcagtaccgaacgtgtggcaagaaaaccggtgataacgaaaaacatcgtcacgccaatgaatccgccctgcaatagcgacgggcgggtgtggaatgctatgactccaagaatcgccagagcgcgcagtccatcgatacccctgaaatgggcaggcacagacgatcgagatggtgcaggtttcaaggttatgctcacagtattctaagtgtactctcaggaatcgttaggtatactgcccggattacgcatatctcaggtagtgacctatgccgttatgacttatgacttccggcaacccgcaccgaaaccgccggaatggtgacataatcagaaccatgattcttcatctgcatctggtccgtcacggacagacctatttcaaccgatacaaccgtctgcagggatggtcgaattcgccgctgaccgagtcgggcgtcgccgatgccgtcaaggccggtgagcgactgaaaggattgacgttcgccgccgcctactgttcggacaccacgcgtgcccagcagacggccgagaaaattctcgacatcaacgaagccgcgggtaacccgcgccccgcactcgtgacggacatgcacttccgcgagcagttctacggctactacgagggacttgacatggccatggcctggtacgccgcgggagcgccccacggcgtcaaaacctacaaccaaatcgtcgagaagttcgggttgggggcctcgcgtgattttctcaaggaagccgatcccttccacgacgcggaatccgatgaggaatattggacgcgcgtcgaaggcgcgttccgtcttatcgccgacaacccgaatctcaaggacggcgacgatgtgctgcagatttcgcatggcaacacactgcttagcctcggtcaccggttcggcggccctgacctcgatctgaacgaacgcccggccaatggttcggtaaccgtgatcgacttcgacaccgacaagccgttcggcgaagccgtgaccatcgtttcgtacggcaagtagcaaatagcaagcaatacatatcgaatagcacgtacggtccacggcggcacgccgcaaacgaaagcgtcagcaggacagcctttcgcctatagccgcatacgcccacgcgcacggttttcgccctgcgcatgcaatggtatgccaagaaatagggaaggagtgctacccttaggcgagtaagtgtgaccgcaaggaggaaacaatgggagtcggagagatcgctggcctgatcgcggccatcgcgttcgcagtattggccggtttcatgatctatccgctgatcaggctgggcaagatgtttgatcagatatcgcagacggtccgggagtccggtgaacacgccatccccgcgctggacgaaggcgtgaccaccgtcaagcaggtcaacaagtcgctcgaagacgtgaacaagatttccgccgcggcttccaccaccgccaacaacgttggtgcgttgaccgatctgtatggctccttcctcggtaagcccatcatcaagatcgcttccaccttctacgcgctgaaaaccacgggtcagtccttccttgcgaagaacgccgcgaaaaccaccgtcaacgacaccgccgagaagggggagtgatgttcaaacgcatcttctgggtcggcgtcggcgtggccatcggaatcgttgccgtcaccaaggcacaggcctatgtcaaggccaatacgcctgatgcggcacgccagttcctgcttggccccgatcaggacaatgtgccgatgaaaacactcgaagggttggtcaacgagttcaatgccacccgtcgagcccgcgaggctgagctcaaccgtcagtacatcgagcgcgccaactgacacgcgcatgccgccttgccatctagtcactgaatcagctagaacaaactaatcctcataatccagtcttttccaccaataccaggcgcaactgcgcccattacccaaacaaggagttcatccgctcatgcgcactgcggacatcgcaaagcgatacctcgattattttgccaagcacgaccatctcatcgtgccctcggcatccctgatttccccgaaccccaccacgcttttcaccatcgccggcatggtgccgttcatcccgtacctgatgggtgagcagaccccgccgaagcgccgcatggcctccaaccagaagtgcgtgcgtacgctcgacatcgacgaggtcggcaagaccacccgccacggcaccttcttccagatgctcggcaacttctccttcggcgactacttcaaggaagaggccatccactacgcctgggagctgctcaccacctcgcaggatgagggcggctacggcttcgaccccgagaagctgtggatgaccacgttcaccgacgatgacgaagcccgttccatgtggatcaacgagggcgtggaccccgagcacatccagaagatgggcatggaagacaacttttggaccaccggtggccccggacccggcggcccctgctccgaaatctacgtggaccgcggccccgccttcggcaaggaaggcggcccgattgccgacgagaaccgctacatcgagatctgggacctcgtgttcgagaactacgaggtcgacaacgtcaagtccaagaccgacctgcacatcgtgggcgagcttgagaacaagaacatcgataccggtgccggcttggaacgtctggcctacctgctgcagggcaagaacaacatctacgagaccgatgaggtcttcccggtcatcgaggccgccgagcagctctccggcctgaagtacggcgagaacgaggacgccgacgtgcgcttccgcgtggtcgctgaccacgtgcgctccgccctgatgatcatgtccgacggcgtgcgcccgtccaacgtgggccgtggctacgtgctgcgccgcctgctgcgccgcaccgtgcgctccatgcgcatgctcggcgtgaccgatccggtgctgcccaccctcttcccgacctccaaggccgccatggaggccagctacccggagctcaacgacaccttccatgaggtgtccgaatccgcgtatggcgaggaagacgccttccgccgcacccttgagaccggcaccacgattctcgacgtggccgtcaacaaggccaagagcgattccgccgagcccgtcgtggccggcgaggacgccttcaagctgcacgacacctacggcttcccgattgagctgaccctcgagatggccgccgaacagggcgtgaaggtggacgaggccaagttccgcgaactcatggccgagcagaagtcccgcgcccgcgccgacgccctcaagaagcgtcacaacgtggatctttccgtttacgacgacttcaagaagacgctcgtcagcccgatcgacttcctcggctacaccgacatgtccgcccgcgccaaggtgatcggcatcatgcaggaaggcaagggttccgtgcccgccgtgaccggcccggccaacgtcgaggtcatcctcgaccgcaccccgttctacgcggaggccggcggccagctcgccgaccagggcgagatcctgtccgacgacggcgccgtgctcgaagtcgacgatgtgcagaagcccatcaaggacctcatcgtccaccagtgccgtctgaccgaaggcacgctggtcgtcggcgccgaagtcaacgccaacatcgacctggcccgccgtggcgccatcgcccgctcgcacaccgccacgcacatggtgcacaaggcgctgcgtgaggagctgggcccgcaggccacccagcgcggctccgaagacgccccgaaccgtctgcgcttcgacttccagtggtccaaggccccggccaagtccgtgatctccgcagtcgaggagcgcgtcaacgacaagctgcgcgacaacctcgccgtgaccaccaaggaaatgaagttcgacgacgccatcgccctcggtgccatgcacctgttcggcgagaagtacggcgacatcgtacgcgtggtctccatcggcgaagacggctggagccgcgagctgtgtggtggtacccacgtggaccacgttggcaagatcggcatggtcaacatcctgtccgaagcctccatcggctccggcgtgcgtcgtgtcgacgccgtcgtgggccagggtgcctatgacttcaacgctcgtgagcacgcgctggtctcccagctgtccgacaagctcaacgctcgtccggacgagctcgccgagcgtgtgaacgccctgctcgccaagctcaaggaatccgatcgtcgcttggcctccatgtacgagtcccagctggccgcctcggttccggcgctggttgctgacaccaagaactccgcggccccggtcaaggtggccgtcaagaacgtgggccactttggcgcggtcgatgccctgcgcaagaccgtactcgacgtgcgcgcccagctcggtgaagacgcccccgtggtggtggcccttgccggcgtgaacgaggatgacaagccgatggtcgccgtggccaccaacgaggccgcccgcaaggccggcatcaaggccggtgatctggtgcgtggcgcagccaaggtcctcggcggcggtggcggcggcaagccggacttcgcccagggtggcggtgtcgatgcctccaagatcgacgaggccctcgaagcgctcaagcacgaggcgcagaaagcctgattccgccagtggtgtggttaggcgttgatttgggtaatgcccgggtcggactggcactgtccgacccggagcttacctttgcacatcctgctggcaacattcatgttgccggcgactatttctttgctattgacgaggtcctgaacgtcatcgaagacgaacatgtggaccatgtaatcgtcggactgcccctgcagatggacggtacagaaggcaaaagcgccaaaaaagcgcgcaggtgggcggccaatctggagaagaggctgcaagcagagagtgaagacagtgattctacggagtatcagattccgcaggtatcattgatagatgagagattgacaacagtcagtgcgcatcgtcagctgttcgaggcccataaagcttcgaacaagcacaggccggtggttgaccagcagtcggcagtggtgattttgcagacggcactcgaccgtacccgggagcagtgaggtatcggttatgaccgatgattttaacgagttctttgatgacaacacgcattgggtcgaacaggggtcagaaccaatgcgcggggctgagccgccagaaccgccgaaatcccgcaaggagatgcgcaagcgacgtgcacagcgcaggcgcaagcgtatcagtggcattatcatcgctatcgccatcgtcgccctgcttatcggcggcggctatttcggcgtaaccaagctcatcgcatggcgcgacagccggagcaaccagtcgacggccatcgcggactatccgggaccgggctatggcgaggtcgaattcaccgtgagcgagggccaaggcgcggcggagatcgccgataatctgctcaaggccgaagtcatcaagtctactgccgcgttcaccagcgtggtcaacgccaatagcgcgacactctatccgggaacgttcacattgaagaagcatatggccgcaatcgatgtgatcgccgttctctccgacaccaaccaggcggcgggcttcctcgaggttcgtcccggtgaacgtgccaccgatgtgttcgccaacgccgcgaagctttccggcattgcccaaagcgaattcgacacgattatcaagaacaagggtaaggatattctgcccaatgaagcgggcggtagctttgagggatggctggagccgggaacctacaacgtcaagagcatgaagagcgcttcagaaatcctcaaggccatggtcgatgagcgtatcgccaagttggatgaattgggcgtgccgaccggcagtgaccgcgaacgggtgatgatcatcgcctctatcgccgaggccgaggtcaacaaagccgattactacggcaaagtgacgcaagtcatcgagaaccgtttggagcagggcatgtcgttgggcatggattccaccgtggcctatggcaataacgtcaagcccgcgcaggtgaccaccgagatgacccaagacgagtccaacccgtacaacacgtacaagatctccggcctgccgcctacgccgatcagcaatcccggcgataacgccattcaagcggcactgcaccccgaaagcggcaattggctgtacttctgcacggtcaatctggacaccggcgaaaccaagttcgccgcaaccgccgatgaacatgaccagaacgtggccgaactacgcaagtggcaagccgaaaatcagtagtcatcccgttagcttccttcgcttggggaagctgatcggacgttagtctcttcattggctccctcgccgaggggagctgtccgcaaaagcggactgaggggagcactgcagggaatgtaacgctcaacttaagcccggggctcccgcgaagcggatggaagaaatctaggacaacaccccaacagccaccgccacaatcgcgcccgccaatatcaccggcacatacggcaccttgcccgcatgtgccggtgatgtgcgttgtgggtcgaatcgcgtccacaaggcaatccatgtgatgccggcaacacccatcgccagccaccagaccaccacaggcaacaggccaaacagtccgacagacaatcccataggtatcaaggcggtcacatcgccgaatcccaatgaccgaggcaccagcaacgccaacgcgaactggatcaggcaacatagcacggtgaacaacagcgcctgcaacagcacgaacaggtcgttcaccaccactccatacgcgaaatcggcggccagctgaagcaacgcgcccgcagccacccacgcgatcggcacccgccgatgacgaacatcctcaatggacagtgcaagcccacatagcagaccgggtagcgtgaacaggtatggcatggcttaacattaacccctagctagacgtacacatagacgtacacacatgaaacgagggaagttatgctgcattggcagacggcaggggagtctcacggagaagcattggtggccatgattgaagggttgccggccggcgtgcgtattagcacggacgatatcgtttccgcactggcacgccgtcgacttggatatggtcgcggtgcccgcatgaagttcgagcaagacaaggtccgtctgctgaccggtgtacgccacggcctgaccctcggctcgccggtggccatcgaaatcgccaacaccgaatggccgaagtggaccgaggtcatgagcgccgatgcactcgaccatgacctgccgcgcgaaggccgcaatgcgccgctgagccgcccgcgcccgggccacgccgatctgaccggcatgcgcaagtatggttttgacgacgcccgcccggtactggagcgctccagcgcccgtgagaccgcctcccgtgtggccttgggcgaggtggccaagcagttcctggatcaggcgttcggcatccgcaccgtagcccacgtggtggcgctcggtggcgtgcagaccaaccccgacctgcccctgcccacccccgacgatctggaagcgcttgacgcctcgcctgtccgtacgctggacaaagaggccgaagcccgcatcatcgaacgcatcaacgaggccaagaaggcctccgatacgttgggcggcgtgattgaagtgctggcttacggtgtgcctgccggcatcggcacgtatgtggagtccgaccgccgactggacgcggctctggcctccgcgatcatgggcattcaggcgttcaagggtgtggagatcggcgacggcttcctggaagcctcccgccccggttcgcaggcgcacgatgagatcgtggtcaacgccgacggccgcatcgaccgtctgtccaaccgcgcaggcggcattgaaggcggtatgtccaatggccaggtgattcgcgtacgcggtgccatgaagccgattccgtccatccccaaggccctgcgtacggtcgacgtgctgaccggcgaatccgcacaagccatcaaccagcgttccgacagcaccgccgtgcctgcggcatccgtggtggccgaggccatggtgcgtctgactttggcgaagtacgcgctggataagttcggtggagacagtgttgccgaaacacggcgcaaccttgagtcgtatctcgcctcgtggccggagcacatgcgctgaacgaagggcgtatggtttcgtgacgactgccgcggaaccatcagcaactgtactcaccaatcgtcgagaggattcgtagattatgaccgcacgcccccgcgccgtcatcatcggcatgatgggagccggcaaaacacgtgtcggtaaggaagtggcacatatgttgcgtctgccgttcgccgatgccgatgtggagatcgaacgtgaagtgggcatgaagattccctcctacttcgaggaatacggtgagccggcattccgcgaggtcgaggccgatctcatcgccgatatgcttgaggatttcgacggtatcttttcgctgggcggtggcgctcccatgacgccatccacccagcatgccctcgcctcctacatcgaccatggcggtcgtgtggtctaccttgatgccgatccggcggaagccatggaacgcgcgaaccgtgggggaggccggcccatgctcaatggcaacgccaactcccgttggaaaaaactgttcaagcagcgtgacccagtattccgcgaggtcgccaacgttcatgtccatacccgggggcttacgcctcagggcgcagcgaagaaagtgattgacatggtatctgagcgagcagtgcatgttaccggagcggcaattgagccgtatgatgtggtcattggcgaaggtgccatgaaccatctggtcgacgtgctgggacccaaacccgccaaaatcgcgcttatccacactcagccggtgcagcgacactccgatcgtgcccgcgccctgttgcgtcagggcggctatgaggtttccgacatcgtgattccggatgccgaacccggcaagaccattaccgtggccaacggcatttgggaacgccttggcaacgaaggtttcacccgatccgatgccgtggtggggcttggcggcggtgccgcaaccgatttggccggtttcgtggctgccacgtggatgcgcggcgtgcgctatgtaaactgcccgacctcgctgctggccatggtcgatgcctccaccggtggcaaaaccggcatcaacaccccgcagggcaagaacctcgtcggctcgttctacacgcctgccggtgtgctggccgacaccaagacgctggctacgctgcccaatgacatcttcatcgagggtctcggcgaagtcgccaaatccggtttcatccgcgaccccgaaatcctgcatatcctcgaagaccacgcagctgaactgcgcgctttcgacggctctacattcctcggctcgccgctcgaagacgtggttgccgagctcattgagcgcacggtaaaggtcaaggcctaccacgtctcctccgatttgaaggagaagggtctgcgtgaattcctcaactacgggcacacgatgggtcatgccatcgaaaagctcgagcacttccgctggaggcatggcaatgcggtggccgtcggtatggtgtatgccgccgagctggcccatctgatcggttacatcgatcaggatctggttgactatcaccgctcgttgctcgcttcgatgggtctgccgacgtcgtggaatggcggctcgttcgacgacgtactcgcattgatgcatcgcgacaagaaagcccgtggcaacgaactgcgcttcgtggtcctcgacgagattggtcacgtcgtacacctcgacaacccgcccgccgaagccgtagaagaagcattccgtcgtatccagcagtaattgaacggccgtaggccgtgccgttcgccatcccctcagaaaaaagtacttggctcccctctaacggaggtgccccggagtcggatctaccttctacctccctctgatgagggaggtgccccgaaggggcggagggagagaagcacaaacaaaaggagtcccaatgaccaaagtcatcgttgtcaatggccctaacctcggacgtctcggcgtccgccagcccgacgtctacggtcgtcaagacctcgacaccctgcgcaagctctgcgccgaatggggcaaggacctcggcctcgaagtcgaggtgcgccagaccgacgacgaagccgaaatggtgcactggatgcaccaagccgccgacgagaaaaccccggtggtcatgaaccccgccgccttcacgcactattcgtatgctctcgccgacgccgcgcacatggtcattgacgagaacctgccgcttatggaagtccatatttccaacccgtccgcccgcgacgagttccgcaagcgttccgtaatcagccctgtggccaccggcaccatcaccggcatgggtttctacggctacaagctcgcgctcgatgctgtggcgcacttgctgagtgaatagaaccaagccctccagccaatcccgggtagcagtcgacgttgcgcccgggattcctgttacctgaggaaaccataagcgtccaagtaaaggaagccatgactctcaccgccacggaacgtgatctcgtcgatgccgcgtcacgctggtttgacgcccaccgcgcacagttcgtcgatgagctgtgtgagctgctgcgctacccgtcggtttccgacgaatcggacccgaatcctcgtccgggcgcgccttatggacccgaagtacgccgtgtattcgaccatatgctggccaaggcaggacgagacgggctgcctacgcgcgactacaccggccacgtcatggaagtcgtttatccacaggagaacgtggagaccgaccgtgacatcgccttcgtcgaccacctcgacgtagtccccgccgacgacggttggacgcacgatgccttcgatccgcaggttattggcgatattgttatcggtcgcggctcattggacaataaaggcgtcgcgctgaccagctatttcctactccgtttcttcaaggaacacgaccaccgtttccgccaccgcgtacgtatactgttcggcggctccgaagagatcgcgctcaacgacatcaaatggttcgtcgccaacatcggcgcgccgtaccaggccatcgtcaccgatggtcccttcccggtgaacaatatccaaaaagggctgctcgatgtggatgtcgaactgccggtcgggccgcaattgcgcggttggcatgccggcaccgccactaacacggttcccggggccgccgcaatcaccctcaccggcgtcgacgaatctaccgtgcggcaagcattctgccagagcggcaacatcgctccagatatcgccgagcgattgcatatcaacgcaacagcgcaaggcgtcacgattgaggccaccggtgtcgccggtcatgcctgccagccgtccggtaccgtaaacgctatagcggtgctcactacggcgcttgcccggtccggtctgctcgaaggccgtgacctcactgcagcgcaggcgattgcccaatggacaaaagactcatatggcactggcttgggtatcgattgcgagaatgcggaaagcggaccgactaccgccaatggtggtctgattataccggcgaatgagttcgctgaagcagacaaggtattaggcgcggtatcaggtgagacttctgaagatgccatcgtattgcacttcgacatccgttatgcggtaggccaggcacacgaacaaatcatcgagcgtattcaagcacaagccgaagcggcgggcggccgcattgtcgacatccttaacgatgacccatactacgtgcaggctgacgacccgcgtgtccagttgctcaccgcaacctacaacgacgtgctcggttgcgaggctcgacccgtggctgtcggcgacggcacccacgcccgctttatcccgcgcgcactcaacttcggtcccgaattccatgccgaccatgtgccggcggtcgacggcatcgacctggagaccccgccattcatcgcaccaggtgccggcaacgcgcacggcgccgatgaatgggcctcgctgaaaaacctgaaaacagcgtttgtcctatatgcgttaggcctagtgcgtctcgaccaatacctgcaatagctggcggataagacgtttgacgtgattatgaccttgcgtatgctttttgacgagcctactattcgtattgttcaagtacgccatgtcggggccgacgcgtctggtgaacacgccgggtcatacacggatgatagagtgaaattccatggttagaagaacacatggtaattctcaagaacacgtcaccaagcatattttcgtcactggcggcgttgtctcctctctcggcaagggcctgaccgcatcttcgctcggtcgtttgctgcgcagccgcggtatccatgttctgcagcaaaagctcgatccgtacatcaacgtcgacccgggcaccatgaacccgttccagcatggtgaggtctacgtgaccgaagacggtgccgaaaccgatctcgacatcggccactacgagcgtttcctcgacgtcttcctgagccagaaggccaacgtcaccaccggtcagatctatcaggaagtgctgcgcaaggagcgcgccggcgaatacctcggccagtgcgtgcaggtcatcccgcacatcaccaacgaaatcaagtctcgtatgcgcgcccaggcttccgatgacgtggacgtgatcatcaccgaaatcggtggtaccgtcggcgacatcgagtcccagcccttccttgaggccgcccgcgaagtgcgccgcgatctcggcccggacaactgcatgttcgtgcacgtttccctggtgccgtacatttccgccgcccacgagctcaagaccaagcccacccagcactccgtgatgatgctgcgccagctcggcatttccccggacgcccttgtgctgcgctccgaccgcccgctcaatcagtccatcaaggacaagatctccctgatgtgcgatgtcgatgccgaaggcgtggtcaactgcgtggatgcgccgagcatctacgatgtgccgaagatcctgttcgaggagggcctcgacgcctatgtggtgcgtgagctcggcctgccgttccatgacgtcgattgggacgaatgggccgacctgctggagcgtgtgcaccaccccaagcacgaggtcaacatcgccatcgtcggcaagtacatcgatctgccggacgcctacctgtctgtcaccgaggccatcaaggccggcggctttgccaactgggccaaggtcaacgtcaagtgggttgcggccgatcgttgcgaaaccaccgaaggtgcggccgccgctctcgacaacgtcgacggcatcgtgatccccggcggcttcggcatccgcggcatcgacggcaagatcggcgctctgaagttcgcccgtgaaaccaagctgcctgccctcggcctgtgcctgggcctgcagtccatggtcatcgaatactcccgccacgtgctgggcattgaagacgcgaactcttccgagttcgagcccgattgcgccaacccggtgatcgccaccatggaagagcagaaggacatcgtggccggcaagggcgacatgggccacaccatgcgtcttggctcctacccggctgagctggaggaaggctcgctggtcgccgaactgtacggcaccacgcatgtcaccgagcgtcaccgccaccgttacgaagtcaacgtggcctacaaggatcgtctgcgcgaaggcggcctgcgcatctccggccagagcccggacggcgagctcaccgagttcgtggaactgccgcaggacgtgcacccgttctatgtggccacccaggctcacccggagttcaagtctcgcccgaccaagccgcacccgctgttcgccggcctggtcaaggccgcgctcgaccatcaggcggcgcgctgacgcactttcgtgccgtgcataatatcgtggcatgatgtgctggctgccgtcatcggcgtagtgcaagacatacggtaaagacgtggtggcgaaatatctaatgatgtttcgccaccacgtcttttttgttgtatgagcagcatgcagcatgatgtattggaaggcgacggtaaaaaattaccgtttctatggtgtgttggtagtatgcagataacgcttagtaggccatcgcagaaagaccgaccatgaccgaacaccttgatgactcgacccagcagtttgcgcctctgtttggtgcgaataatgccgtcagcggcactgtggcagacagtgtggatgctgctgcatcagattccattcagggcgatgagatgaggaggcgccgcatctggccgtgggtggtgattgcttgtctgctggttgccttgggggctgcctgtggcggcggtgtttggttcttccaagatcacgtgctgcctggcacaacgctatggggaaattcagttaccggcaaaaccgagcaggagattgtcgacctaatcaacgaccaggtcgacaacaccgcggtacgagcgaaataccaggggcagtcggcgacgttcacgctgaaagatctcggcatcgaagttgatggtgaagcaatcgcatccgatgtcatcaatgcccaacgcggtgacgcatggtggcaacagtatgcgttctggattacgcatgatgtggccccgcaaatcaatcccgagctcgctgatggcagtgtggtagataaggcgctgaacattgatgcacaagaacctgttgacgcgcaagtcgcattgaacgataacaacagtggcttcaacgttattgcgggagaaaatggccagggagccaacgccaccagcattgcgaagcaagccatttccacagtggagtcattgggcagtgtccagccacagaccgttcgggtggaactcgacgtaaccgaaccgacgattaccaatgcaattgccgatgaggcgaaaaccacgctggaaaccctagtgaacaatgccgtggccatcaaggtggcggataaagacatcgccaccgtgaatgcgtccatgctgggttcggccatgcgcatcgacgccaaccagcagtcaaagctgaaagacaatgaagtacgtaatggctacgtggtctttgatgccgataagctgcagcaatactatgacgagcaaatcaagccgaatctcaaattggaacgtgaagacaagaaggtcgtcgtcaataatgctggcgaggtgctgagcactgaaacagaaggccatgatggcattgtgattgccgatggcgcggatacggaggttggtgctcgcttggctcaggtgctggccacgggaactggctcagtgaatgtggacggcaaggtagatcccaaacaggaagtcaaggtcactcatcgcgtggcgattgacctgtccgaccgtaagctctatgcctatgagaatgacacggtggtcaagacattgaatgtcgtggtcgcggagggcaacgacaacgtcaccggcgaatgcgttggcatgatgtgtacgccgacaggtgacttcaacgtatggcaaaagttgcccagtcaagatatgagcggcacgctgaatcttgccgatggcacggtggaaacatgggatgtcaaagacgtgggcttcgtcaactacttctcctccggttgcgcaatccaccgtattgccggcggatatgtagcggatgccgtaatgccctccattgccaacggatctcatggttgcgtgggtatcggatgggatgtcgccgaatggttctacaactggtgcaatatgggcacgagcgtgcatatccaagtgtgatatgcaacagtgtgatatgtaacaaatacggcatgcagtggtgcgacacataatgccgcatacgcgatgttcggtgtgcatgggacaagcttgcccggctccaatatcgctgtatcgcattcgtgtaatcaagcccacagccaatatgcgtcagggcagctagtgtttgcacttgggttctgctaggttttcataggattaagtgtgatacaaggaaggcaggatggtgaccgaaaacacagcaccaaacgccgccgctgacgtggagatgagccagtatgtggctgatcgtacccgcgtcaacgaggacaagatcaagaaggatgacgagatcatcagccagttcggcgactacaactatggttggcatgattctgatgccgccggcgaagccgcaaaacgaggcattgatgagaacgtcgtacgcgcgatcagcgccgacaaaggcgagccgcagtggatgctcgacatgcgtctgcgtggattcaaggcgttcctcgaaaagcccatgcccgattggggtgtggatctctccggcttcaacgcagacgacttcaagtactacgtcaagccaatcgacaagcaggcgaaaagctgggacgaactgcctgacgacatccgcaacacctacgaccgtctcggcatcccggaggcggagaagaaccgcctcgtctccggcgtggccgcccagtacgagtcggaggtcatctacaactccatccaggaggacctgaagaagcagggcgtcatcttcgtcgacacggacaccgctgtgcgcgaataccctgaactcgtcaagaagtacttcggcaccgtcgtgcctccggaagacaacaagttcggtgccctcaacaccgcggcatggtccggcggctcgttcgtatacgtgccgaagggcgtgcatgtggacatcccgttgcaggcgtacttccgcatcaacaccccggccatgggtcagttcgagcgcacgctcatcatcgcggacgaaggctcctacgtgcactacgtggaaggctgcaccgccccgatctggtccgaggactcgctgcacgccgccatcgtcgagatcatcgtcgaaaagcacgcccgcgtgcgttacaccaccgtgcagaactggtcgaacaacgtctacaacctcgtcacccagcgtgcctacgtgcgcgagggcggcacgatggaatgggtcgacggcaacatcggttccaaggccaccatgaagtacccggcctgcatcctcgccgaaccgtacgccaaggcatccaccatgtccctcggcttcgccggcaagggccagtaccaggacacgggcgcgaagatgattcacctcgccccgcacaccagctccaccatcgtcgccaagtccatttcccgtggtggtggccgctccgcctaccgcggtctggtcaaaatcgtcaagggcgcgtacggttcgtccaactcgaccgtgtgcgatgccctgctggtcgacgacttctcccgctccgatacctacccgcatgtcgacgttcgcgaagacgacgtttcgatggcccacgaagccaccgtttccaagatttccgaagaccagctcttctacctgatgagccgaggtctcacggaggaagaggcgcgaggcatgatcgtgcgcggcttcgtcgaaccgatcagccgtgagctgccgatggaatacgcgcttgaactcaacagacttgtggaacttcagatggaaggatcggtgggctgattccgatgaccgacaacacaacacccgtcaaggaaatcaagattccggtcgccgaccccaacgacccgtacgcgattccggccgctatgccgtcctccgtggaccatgccgtgcgctcgttcaacgcaggcgactacccggagcccagccgcaagcaggacgaatggcgctacacgcctatcgagcgcatcaacgagttcttcaccgtgttcaagccttccggcgaaacgcagatcgaagtctccatgattgacggctcgccgttggccgaaggcgtgaagctcagccagatcaagctcggtgagggcctgtccggcactgtgtccaagcccaacgaccgcgtctccgcagtcgaatgggaatccggccgcaccgcaaccattctggaactgtccggtgagatcgcccagcccgtgctcgtcaaggtgcacggcgcgggggaggacctcgacgctttccatctggtgatcgccgccgccgacaaggctcatgcggacgtcgtcgtggaacacgacggtgacgcacgactggccgaaggcgtggaaatcaccaccggcaaggactcgcacgtctccaccacgttcgttcaggaatgggccaaaaccgccaagcatgtggccaaccaccgcatccacgtcggcgaaggcgcatccctgcgccactccgtcgtgaccttgggcggcgacatcgtccgcatccgcatggatcaggacttcggcggcgaacagggcgacctcaacatgctcggcatctacttcgtggaccccggcgagcacatcgaacaccgcacgatggtggtacacaaccacctcgactgcaagtcccgcgtggtctacaagggcgcgcttgacggcaagggcgcgcactccacttgggtgggcaacgcgctcatccagcccaccgcccccggcaccgactcctacgagctcaaccgcaacctggtcctgaccccgggcgccatcgccgattccgagccgaacctcgaaatcgaaaacggcaacatcatcggtgccggtcacgcctcttcggtgggccgcttcgacgacgaggaactgttctacctcgaatcccgcggcatccccgaaaccgacgcccgcaagctcgtggtgcgcggcttcttcggcgaactcgtcgaggagatcggcattcccgccatctccgaacatctgatgaccgtgattgaccgccgactggcccgtggtgaaaacgacgccatggcacaggtcctcgaagacaagtaagaacagcatttttaggagcacaacaatgtcaacactcgaaatcaaggacctgcacgtccacgtcgaaaccaaggaaggcatcaagccgatcctgaagggtgccaccctgaccgtccactccggcgaaacccacgccatcatgggccccaacggttccggcaagtccactctcgcctacacgttggccggccaccccaagtacgtggtcgactccggcgaggccctcctcgacggcaaggacatcctcaagatgactccggacgagcgcgccaaggccggcctgttcctggccatgcagtacccggtcgaaataccgggcgtgtccatgaccaacttcttgcgcaccgccaagaccgaaatcgacggcgaggctcccggtattcgccagtgggccaaggacctgtccgcagccatgaagcgcctcaagatggacccgaagttcgcctcccgttccgtgaacgaaggcttctccggcggtgaaaagaagcgcgccgaagtgctgcagctcgaactgctgaaaccgaagttcgccatccttgacgaaaccgactccggcttggacgtggacgccctgcgcatcgtgtccgaaggcgtgaaccgcgccaaggaagccaaccagttcggcatcctcatggtcacgcactacacccgtatcttgaagtacatcaagccggacatcgtgcacgtgttcgccgacggccacttcgtcaagaccggcggccctgagctggccgacgaactcgaagagaacggctacgaccagtacctgcccgaaggcgccgactccgagtccgcactggcctgagtccgtgaccgtgggagtctgacatgccctattctcgacacgctccgggccgcttaggccaggtctttacggtcgcgaacaggccatgtcagactcccactcgtttcgtacaattgttacgtaagtagggggaacataatggttgattttaaggcgattcgggcgcagttcccgattctggatcaggagattcacgggcacccgctcgtgtacctggattctgcggccacctcgcagaagccgaatgcggtgatcgacgccgaggcgaacttctaccgtacaattaacgccggcgtgcaccgtggtgcgcacgagctggccgcccgtagcaccatggcctttgaggaggcccgagccaaggtggccaagctggtcggcgcgaatgcggccgaaggtgaagaggaggtcgtcgtcaccggtggtgccacggccggactgaacctgctcgccaccgcattcggcaatgcatcgctggggcgtgggggagaagccgccaagcgttttgccctgaagccgggcgatgagatcgtcgtctcgcgtgcggaacatcattcggtgctgctgccgttccaggagctgtcctaccgtaccggcgccaccttcaagtggatcgacctgaccgaggacggccgtgtgcgtacggacaacctcgacgaagtcatcaccgagcgtaccaaggtcgtggccgtcacccacgtgggcaacgccacgggtgccatcaccaacatcgccccgatcatcaagcgtgcgcatgaagtaggttcgatcttcatcttggacgcttgccagtccgtaccgcacctcaaggtcgatttccacgcgcttgatgtggacttcgccgcctggagcgcgcacaagatgtacggtcctaccggcgtcggtttcctgtacggtaagcgcgacctgctcgaagccctgccgccggccaacttcggcggctccatggtcgagctcgcctacatggaccacgaggcccaatacatggcccctccggcccgcttcgaggccggcacccagccggtcgcccaagtggtggccgcaggcgtcgccgccgaatggatgatgaacatcgggctcgagaacatcgaagcccatgagaagaccatcgccgccgaactgctcaagctcggcgacgtcgatggcattcgcatccttgggccgcgcgaaaacgtggaccgcatcggcaccgtggcgttcgacgtggccggcgtgcatccgcacgatgtgggccagttcatcgacgcccagggcatcgcgattcgcgtgggacaccactgcgcccagccggtacaccgccacttcggcctatacgcatccaaccgtgcctcctccggtgtctacaattcggtcgaagatgcccaagcgttggtcgaagcggccaagggcatccgtaagttctttggagtggagtaaaacagaacaccatgaacgaattcggtatgagcggggatgacctcgaacagatgtaccaagaggtcatcctcgaggcgtcgaaacatccgcatggcaaggaatcctttgcgcccaacgcagcggtcgaacagtccgcggacgcagcggccaatgtcaccgtacaagccagccacgaatactgcacgcccggtgaatcgcaccagttcaacccgacctgcggcgacgaggcgaccatccatgtcgaagtctccgatgacgaaccgcacaccatcaagcgattggtgtgggacggccacggctgctccatttcgcaggccagcctgtcggtgatggtcgatctggtggacggcaaaaccgttgacgaggccatggatctggaacagacattccacaagctgatggaatcgcgcggtgccggtctggacgacgagaacctggaagaaaagctcggcgacgccgtggtattccaaggcgtgtcgaaataccctatgcgcatcaaatgcgctctgctaggctgggaagggctgaaggactccatcgccaaagccctcgctgcaaagaactgaggaaatatgtccaacgataatttggttcccgaaccacagccgtccgttttcgatgctgtcaacggcgtcctgcaggacgaggaggccgctcgccgcgtgatggccaacccggccttggccaagggcttcccgaacggacgcccgatcgagcactctgctgcgtccggcgatgacacctgtgcgtgtggcggtcaccacggcaaatgcggttgccaggatgacgaacagtccgatggcagcgagattccgatcaaggcgattgacgatatcggccgcgccactgccgaagacgtgcgcgaggcactgcatcaggtgattgatccggagcttggcatcgacgtgatcgatttgggtctggtctacggcattgagatcgatgagctaggccgcgccattattacgatgacgctgaccacgccggcctgcccgctgaccgaccttatcgaggacgaatgcgcatccacgctggccggtctggtcgaggagttccgcatcgactggacgtgggatccgcgctggaccatggagcgcatcacgcccgaaggccgcgaccagctcgccgccctaggcttcagcttcgacaatatgccaaagtactgatagcgcttagtaagttccctcatcagagggagctctatacgagaaaagccccgcatgatgcggggcttttccatgtctggactggtcaatcagtcatcgacgatggtgttcttcgggacaaccgtgatgccatccggcgtgacggtgaagccacgggccagatcgtgctcggtatcgatgccgacagtggagttctcggtgagcaccacgttcttgtcaagaatcgccttgtacacgcgggcgcggcggttgatgactacaccgtcgaacagcacggaatcgacaatctgtgcccacgagtggatacgcacattgggggagagcacggagtggtgcacttcaccgccggagacgatcacaccgggggagacgatcgaatcggtggcgtggcccagacggtcgcggccggcgtgcacgaacttggccggcggcaggttgccggacatcgtgtaaatcggccaatcctggttgtacaggttgaactcgggcacataggcgatcagatccatgtgcgcatcgtagaactgcttaatcgtaccgacgtcgcgccagtaagcgtgatcagtggccgtggagcccggaatctcgttcgagttgaagtcgtagacgccggcttcgttgcgggaagcgaagtacggggcgatgtcgccgcccatgtcgtgcttggtgtcggcagccttctcatcgagagccagagcctcgaacagggccttggtgttggcgacgtagttacccatggaggccagaatctggttcggattgtccggcagaccggtggtggtgggcggcttctcctggaagttcttgatcatgttcgggtgatcgggatcgacctcaatcacaccgaactggttcgattcctcgatgggctggcggataccggccacggtgaactcggcgccggactcgatgtgctgctgtaccatctgttcgaagtccatgcggtagacgtgatcggcacccacgatcaccacgatgtccggctggacatcctcgatgatgttgatggtctggtagatggcgtcggcggagccgagataccagtgcttgccgagacgctgctgcgcgggcacaggggagacgtacgagccaagcagcggggagaaacgccagacctgggagatgtggcggtcaagcgagtgagacttgtactgggtgagcaccacgacctgacggtacccggagttcaccaggttgctcaacgggaaatcgatcagacgatacacaccaccgaagggaacggcgggcttcgcgcgatcacgggttaacggcatcaggcgggtcccctcaccacctgcaagcacaatcgacagaatcttgggattcttggtcatcgtaactgtcctctctgttactgagcgtctttcgacaccgcactgccgggccggatgcttccttgcattcggtttacatagttaataattgcagaaaaaaacgaacatgcaaggctttcgcccccgcgtgccgtgaacttgcgatgaacagtttcgtagatttgttaaggatccggccttttcggagcgcgtgcgattccttagcgtgtcgcgtagaacgccactgcgctggatgccgccacgttcaggctatccacgccgtggctcatcggaatcttcacggtcaaatcggcgcgggcaatcgtatggtgggacaggccgtcgccctcggtaccgaagatcagcgcgagcttgtcgatatgcgtcggatcttcggcaggcgcgtgcagacggcgtgtcagttcgtccaacgaaatcgaacgatcctccaatgccatggccacggtggtgaagcccagcgacttcaactcgtcgatgccctggaacggccagtaatgcttgttttcggtgccgtcgtcgttgaacccggtgatacgggtccacggaatctggaacacggtgcccatcgacacgcgggcggcgcgtcggtacagcggatcaccgcaggagggtgtgaccagcacggcatccacatcgagcgcggccgccgaacgcatcagtgcgcccacattggtgtggtccacgatgttttccattactgccacgcggcgggcgctcttgcagacctcggctacggagggcaacggccagcgtcgcatcgcgcatagggcgccgcgatgcaaacggtagccggtcagacgcttgagctgctcaggtgaggccacgtagacgggaatatccgcgccccagcgcccgtcgatgaagtcgaaggtgtctttcatgccctccagccaaggttcctcgaccagcagtgacagcggttcgcggtcagcggccagcgcgcggtcgataaccttgggggactcggcgatgaacacgcccttggctggttccaagcgattacgcaactgcatttcggtgaggctcacatacgcttcgacgcgcgggtcgtcgacggtgtccagcgtgatgaactgcattggtggcctttcgtgtgtgcagataacgaaaaaccccttgcaatgcaaggggtttatctgtgcccgagacgggacttgaacccgtacgcctgtataaaataggcactagcacctcaagctagcgcgtctaccattccgccacccgggcaggtgtcgtttggacaacgagtagatagcttagcatgaaattacagggatgcaattcgcgcgtgtgcccggcgtgtcgcgtgtagccttgaagtcatgactgatgccctttttcttttcgacccgcaggtcgacgacgtcccggtgaacagcgacgaactccacgccggctggaagctaaccctgcccgctcacatcaagcgccatgccgtgcaggccatgcgactcaaggcaggggacagcctgcaactttccgacggcaacggcttgagaatccaggcagtgatggccgatcctgaagccggactggctgaagtcgtggaagtggggcgcgaacccgagccgctcacccgtttggcgctgattcaggcattggcgaaaaccggccatgatgagcaggccatcgatatggctactcagattggcgtcgaccaagtggtgccatggcaggcggaccgatccattgccaagtggaaggtcggccgtacagacaagaagtggaattcggtactggatgccgccaccgagcagtcgcggcgcgcctttaagccgcaactggaggcgtgcgcgtccagcaaggaggtcgtggccatctgccgcagggcctgcgtgcatggcgatgtggtgattgtgctgcatcaggatgctaccgatacgtggtccggcgtggaggagaaggttgcgcagttggtggaacgcacgctccaggacggccggccgcggactgtcagtgtggtggtcgggcctgagggcggcatcagtgagcaggaggtagctgatttcgtcaaggccggagcggtgagctgcgtactggggcgcaatattctgagagccgcgacggccggtcctgtagcgttgtcgctgttgtctcgggtgttgggacgttacgagtaacgcccacgcgctaagctggtgcgtagcaacatcaaaccaaggagcatgatgagcgaatccgacgattgcctgttctgcaagatcatcgcagggcagattcccagcagcaaggtctacgaggacgagacgacctacgcattcaacgacatcaatcccaaggccaaggtccacgtgctcgtggtgcccaagaagcactacgccaacgtcgccgaacttgccgccggtgacccgaccgagctggcccacatcgtctccattgcgcagaacatcgccgacaaggaatttcacggcgcctaccgactggtgttcaacaccggtctcgacgccggccagaccgtcttccacgtgcacgcgcacgtgatgaccggcgaaaagctcgacgagtagtaggggaatatccgcttcgtggcaacgactacacgtaccatcaccatcccgccccaacttgaccccgtcgccgtgctcggcccggttgacgaggtcattcgcgaggtggagcgcgcctttccggacctgacgattatcgtgcgcggcaaccgcgtggcgatcgtctcccgctccaagcagaccgaagcccaggccgcacaggccgaggatttggtcaataccatcatccaagccgcctacaccgcgcctatggacgccgacaccgtgcgtcgcatgctcgaccagaacgtgctcaagaaccacgtgcgcctcgaacatcccggtcacggcccggtgcgtgacaaactggcgcaatcgacctcaaacgaacgcgcccatgcacgttctgccggctcccacgacccgacgtaccgcaagcccacggttcccggcgtcatcacctttgctgccggcgtgccggtccgtgcgaaaaccgccggacaagtggcctacgtgaacgccatcgaatcgcacaccatcaccttcggcattggccccgcaggcaccggcaagacgtatctggccgtggccaaggctgtgcgtgccttccaggacaagcagattcgccgcatcatcctcacgcgcccggccgtggaggccggcgaaagcctcggctttctgcccggcacgctgaatgacaaggttgacccgtatctgcgcccgctgtacgacgcgcttggcgacatgcttggcgccgaccagctcaagcggtacatggacgacggctccatcgaagtggcgccgctcgcctacatgcgcggccgtacgctgaacgacgcgttcgtgatcctcgacgaggctcagaacaccaccgaacagcagatgaagatgttcctgacccgtctgggcttcaacaccacgatggtcatcaccggcgatatctcgcaggtggacctgaccgtgcctcgctcgggactggccaccatcgaacgcatcctgggcggcatcaacgacatcgcattcgtgcatctcaaaaccgaggacgtggtacgtcaccagctggtcggacagatcgtggccgcctacgaccgtcactccgccatcgccggcgaccaccgcgacatcgaacgcaagggccgccgcaaccataccgacttcgatgcccgccagcaagcggattcaaccaaccaaagcgagacagacgatgagcgttgacgtcaccaatgaaacccagtgggtcatcgaccccaaggtcttctccgatttgggtatttgggtactcgaccagatgcgcgtgagcacccagtccgacctgaccatcatgttcgtggatcccgatcccatcgccgaactgcacatgcgttggatgaacctcgaaggcccgaccgacgtgatgagcttcccgatggacgagctgcgccccggcgacggcaaaaccgtgatggaaggagtgctcggcgacatcgtcatctgcccgtgggtcgctgcccaacaggctgccgcagccgggcacagcaccatgcaggagatgctattgctcaccatccacggcatcctgcacctgctcggctacgaccacgtgacccccgagcaggagcgccagatgttcggcctgcagcgacagctgctgctcaccttcttcgccctacgccacgatgccaacgtgcaggccacgctgcccgccggcacacccgacgcgctggccctgtacgacgccgcgcacggtgccggccgcgacctcgattccaaataagctcccaaatcaatcacaccaaatccggattattcgataccgttcaaggacattcaaggacaccgaaaaatcattatggagtattccagtaccacgccgatcgccatcaccgtcattcttgtactcgtggcggccctgttcgtctggctctcgctgaccatggccgccgctgaaggcgccgtggcccgcgtaacgcgagccagccttaacaatctcatcctcgaggtgcagaccgactccgaagcaagccagtttctcaagatgaagaagatcgacaagattcatcgcgtgcaatggctcatcgccgaccgttacgccaccgccggcagctgtgcgttcttccgcatcgcctgcaatgtgctcgacggcgtactggtgtcttccatcgcatccctgtggggtgcggaactgtggattgaactgctctccggattcctgttcgcgattatcgtagccgtggtctccgtactggtccgcccgcgcaccgccggcatggccaagccggtcggcatcatgatttccaactcgcgcatcgtgtcgttggccaccaagctcacgccgttcgcacgcatcggtggcgacaagtccggttccaaggggccgggccgccgctccaaggactccgatctgtccgacgacgaggagcttgagaagattcagctcgagcagggcaaggccgccatcgaccgactggtggagtccaacgacttcgatccggaagtctccgaaatgttgcgcaacgtgctcaccctgtctgatacgttgactcgcgagatcatggtgccgcgcaccgatatgatctgcatggagcgcgactccacactgtcttccgcgctgaaactgttctcccgctccggtttctcccgcgtgccggtgatcggtgaggatgtggatgacctgatcggcgtggcctatttgaaggacgccgtgcgtgccaccgccttcaacccggcggccatggagcgcgcggtcgaatccatcgtccggcagccgctgcttgttcccgaatccaagccggtggacgacctgttccatgagatgcagcgttcccgccagcatgtggccgtggtggtcgatgagtacggcggcatcgccggcatggtgactatcgaggatgccatcgaacagatcgtcggcgagctggaagacgagcacgaccgcacccagcgtactgagccggagaaaatcggagacaacaagtggaagatgcccgcccgtacgccgattgccgatctggaggagatcttcgagatcgacattgatgaggacgatgtcgataccgtgtacggcctgctgaccaagattctgggccgcgtgccgattgtcggtgcctcggccgtgacgcgcggtctgcgactgaccgccgtggactccgccggacgccgcaagaaggtgtccaccatcgtcgtagaaccggcgcacgtcgagggcggcgaggaaaataacaagacccatgaggaaactgacggcgagcccgtcgaaggcgatgataccgccagcaaggagtgatatgaccgaccagaacaacagcacgaacgacgtcgatgacattgacgttaccgatgcttccgatgttgccggcgttgccgaagtcgacgcgaccggtgagacggagaacgtgaccaagcaggacgtgccgtatcgctccggattcgtggccgtggtgggccgcccgaacgtcggcaaatccacgttgatcaacgcgttgatcggcaagcagattgccatcgcatcctctcgcccggaaaccacccgtaaggcgattcgcggcatcctgaccgccgaccacgcgcagctcgtgctcgtggacacgcccggtattcaccgtccgcgtacgttgctcggccagcgtctgaacgacgtggtcgacgaatctctggccgatgtggacgtggtggccttcctgctgcccgccgatcaggaaatcggccccggcgacaagcgtattctctcccgactgcgtaccgacttcgccaccaagcgtgaggacggtacgttcaagtggcgcatcccgctgattgccatcgtcaccaagatcgacgagcttggccgtcagcaactcatcaacaagctcatcgaaatcaacgatttcgccgatttctcggacatcgtgccggtgagcgccctgaagcacgacaatctggctgaagtgaagaacgtgctcattgagcacacgcccgaggggccgcagatgtacccggacgatcagatcagcgaggagcgtccggaagacaccatcgccgaactcgtgcgcggtgcgttccttgagaccctggacgacgagctgccgcattcgctggccgtggtggttgattccatcgactatccggaagacaacgagaccggtcagggctatgacggcaaggcgcaggtcaacgtgtccatttacgtggagcgtgactcccagaagccgatcatcatcggcaagggcgcctcgaacctcacctacgtcaagaagaagctgcgcaccccggtcaaccgcatcgtcggccaaaaagccaagctcgacctccacgtcaaggtagccaaaggctggcagtccgaccccaagcagctggagcgcctgggcttctaaggcttatagacgaaaaaagctccctcgtcagagggagcttttgctatacggtttacttccgcttcgtgtacatctgggtgttgaggagggtggagtagcgcttgatgaccttgggacgaatcaccttcatggaagcggtcatcaggccgttttcctgagtgaactcctcgggcaggatgatgaacttgcgcacggactcggcgcgggagacgccctcgttggcctgatcgacccacttctgcacttcggcgcgcacggcggcgttcttggcggcatcctccagcggcatgttctcgtccaggcccttggcggccagccacgggcgcagcgactcctcgtccagcgtcaccaatgcggagatgaacggacgcttatcacccagcaccagcgcctgggagacgaactcgcaacgctgaatgacttcctcgatcgggccgggggagacgttcttaccacctgcagtgataatcagatccttcttacgaccggtgatgtacaggaagccatcgttgtcgatacggcccaagtcgccggtgacataccagccatcttcggtgaacgacagctcagtggcctcgtcgttcttgtgatagcgcgggaacacggcacgacccttgacctgaatttcgccgtcctcggcgatgcgcagggagaatccggggaatgcgatgcccacggaaccagcgtggaacggcgtacccagcgggctgaacgcgcacggtgcggtggtctcggtcagaccatagccctcgtatacaggcacacccgcgccacggaagaaagccagcagttccgggtcaagcggggcaccgccggccacaatccacttggcgcgaccgccgagcacttcgcgcagcgaagagtagacaatcggatcgaaggcagcgcggcgagtgcgggtcagtgcacctgccttgccattggcggagacctccttcatatagttctgcgcggccaccacggcggaggcgaacaccacgcccttggggccgtggccggccttctgggacgcggcgttgtacaccttctccagcacgcgcggcaccacgatcatgagagtgggcttggccacctgcagatcgctgatcagcgtcttgatgccggtggcgatgtagatgcggacgttcgaggagacgacgatgtagttgatggcgcgggcgaaggaatgggcctgcggcaggaacagcaggatggtgttcctcttgtcgtgcagcagatcgggcatgtaggccggcagattcagcgcggtctggcagtagtgctcgtgggtcatctccacgcctttcggcgcggccgtggaaccggaggtgtacacgatggaacacaggtcggtcttcttgaccgaatcgatgcgctcgtccagctcctcgtccgagaccgtggtgccgtaggccttgatctcgtccaagccaccggtctcgatggtgatgatgtgctccagggacgggcactcttcgacggccccatccgccttcttacgcatgtccgtgtcctgcacgatcagcagtcgggcatcggagttgttgacgatattgcgaatctgctcggcggaatcggtgtcgtagatggtggcgagcacgccgccgcaggccatgatcgccgcgtcggtcaggtcccagtcgtaggaagttcggcacatgaatgccacggcatcgcccttcttcaggccgtaatgaatcaggcccttggccacggcacgcacgtcagccaggaactcgttggcggtgacggtcacccaatcgttgccggacttgtaggtgtacagcggctcatcgcccatacgttcggcgcggtccgcatacaggtcgtagatggacgtaccttcgtccagcggcggattgccttcggtggaggtggtgagcaggccggtggcggggtcgatgtcggtgacggtcaggtggccgtcgtcccaatcgtcgctgtgaggcaaagcgatattggtctcgaccggcacgtcggcgttggacaggtaatcgggctcgtccggggtgtcgtcgtggaccgggtggacgaagtcggatcccaacctgagcgccttacgggtgagattgatcgtgtgctgcgtgaaggaattgataaccgacaagtcttgctcctgtaaacctttcagtgtcgtccagccatgaggcgaacgcttctcaaagttcaaattgtaatcgcccaaaccgaactcgtcaccttacgcaaccgtaggattctggcgggttaggggagtgcgtggcaaaatattgcacaggtcccgatattgttgagtaaccgtgagctgcgaaacggcgattgtcgataattattgagcggttggttgctgatcgatgccgggtgattgttggacggcttccgagcaattcatccgcaatgcacatggacacattcgtatttcttactaatttcgggttcgtttctatttcgattggcggaatctcaagtcatggtctttacctttcgactacacttaccatgcggataaccatgtccattttgaagtagaacaagaaagggctctcatggcgcaaaacccagaagccaccgtggtgttcggcgttttgaacgaaacgtccgaaacggaatcccgcgtcgcgctgacgccggatatcgtcacccggctgaagaggagcggtgtctcctcactgattgaagcaggtgccggcattgctgccgactacaccgatgaggattacgaaaaggccggtgcgaaggtgaccagccgtgacgaggtgctcgccgaagccgacgcgctcggttttgtggaccgaccgtccgccgagaccgtggccaagctcaaggccggccagtgggtcattggcatgctcggttccttcaccgatgccgattacgtggccgcgctcgagaaggccggtctggtgggcatcgccatcgaaaagctgccccgtaagctttccagcgcccagtccatggatgagatgacctctcagaactccgtgatgggctacaaggcagccatcaccgccgccgatgcttacggttccttcctgccgatgatgaccaccgccgccggcacgattcgcccggctaaggcgctggtgctcggtgccggcatcgccggcctgcaggccatcggtacgctgaagcgtcttggcgcggtcgtcaccgcgtacgacgtgcgtcccgcctcccagggcgaggtcgagtccctcggcgcgaagttccttgatctgggacttgacttctccaagggccagggcgagggcggttatgcccgcgcgctgagcgccgaagagcaggctcagcagcaggctgccgtcgacgaaaaggccgccggctttgacatcatcatcaccaccgccaaggtcccgggccgtaagcccccggtgctgctcaccgcagccggcgtcaagggtctcaagcgtggtgccgtgatcgtggactgcgcagcatccgacctcggcggcaacgtcgaaggctccgccgttggtgagcaggtcaccgagggcggtgtcaagctgatcggcgctccctacctggcctccggcgtcgccaccaccgcatccaacctgctttcgcgcaatgtggccgacatcctcgtgcacttcgtgcgtgacggcaagctcggccaggatctcaccgaagaactcgacgacgcgctggtggttgccggccgcgccgccgccccggcagctgctgccgatgccgagaagtccgagaagtaaggaagaaggaataccatgcctactctcgtcgtttccattaccctgttcgtcctcgcgctgctcatcggcatcgaggtcatcggcaaggtgcccgccaccctgcacacgccgcttatgtccggcgcgaactccatccacggcatcgtcatcgtcggcgttgtgatcgtggcagccgaagccaatagcccgctggcctacgtgttcatcttcctggccgctgtgctgggcaccatgaacgtcgttggtggctacgtggtcaccgaccgcatgcttgagatgttcaagtccagcaagaacgagaagaagggggagtcgaagtaatgacctccgcaaccgttggcgccatcgacatcgtcgcttggttcgtctacctgttctctgccgtcctgtttgtggtcggtctgcatttcatgaattcgccgaagaccgcccgcaagggtaaccagatctccgcgttcggcatggtcgtggccgtgctcatggcgttcatcgtgctcttcgccaagggcttcgtgaacattgtcgccgtggtggtgctggtcgtcggcatcctgatcggtgccgtggccggtgtcgtctccgccaagaaggtgaagatgaccgatatgccgcagctggtctccgtgttcaataccgtgggtggtggcgccgccgcactcgtggccctgaacgacatcctgaccaaggaaggcaccccggacatcgtggtgctcatcaccgctggtctcggtattctcatcggttctgtgaccttcaccggctcgctcatcgctgccggcaagctgcagggtatcaagtgggtcaagaagctgaacctgccgggcaagggcgtatggaacattctgttcgccgtgctgtccgtcgcctcgctggtcatgctgtgcgtccagcccgaacagcgtctgctgtggtcgattctgaccaccgtgttcgccctgtgctacggcttggtcttcgtgattccgatcggcggcgccgatatgccggtggtgatctccgtgctcaacgcctgcaccggtacggctgtggctatgtccggtctggcgattgacaacgttgccctgatcgtggccggcgcactcgtcggttccgcaggtgtgaccctgtccatcctcatggctcaggccatgaaccgcccgctgctctccgtcttggccggtggcttcggcggtggtgctgacgccgccgctgctggcgacggtccggaaggcaccatgaaggagaccacgccggacgatctggccgttcagctcgtctacgcgcagaaggtcatcttcgtgcccggcttcggtctggctcaggctcaggcccagcgcgagctcgccgacctcggcgaactgctcaagggccacggcgtggaagtctcctacgccatccacccggtcgcaggccgtatgcctggccacatgaacgtgctgctggccgaggccaacgtgccctacgaggagctcgtggatctcgatgagatcaacccgcagttcccgcaggccaacgtggctctggtcgtcggcgccaacgatgtgaccaacccggctgctcgccgttccggcaccccggtctccggcatgccgattctcgacgtcgacaagtcccagaacgtcgtggtcatgaagcgcggccgcggtatgggctacgccggcatccagaacgagctctacttcgaagacaacacccagatgctgttcggtgacgcgaagaagagtctgcagtccgtcatcgccgccgtcaaggaattgctcgcgtaaccattcttggctcccttctgtgaggggagctgtcgaacggagtgagactgaggggagtagcccatacacgggtgctcccctcagtcagcttcgctggcggctcccctcacagaggggagccgagctctatatctactacagcccaaacacccgcttaacaaagctgttaacgcgacgccaatagcggtccggatcggtgctggcgctcatcgtgtggtcggcgccgggaatcagcagcttctcgcggtcgatgctggcgcaggcgttgtaattgatgtccagatacttcggattgacaaaagtatccgctccaccatgaatgaacatcatcggaatagtcgcgtgccgtaatgccttcacacaggaggcgtcctcaaaccggtatccggccttgcgtttagacacatgactggccactttgaccagcagcgcggccaacgagtgcggcaaacggaacatctcctcggcattatccgtaaactgcgaaaccacggaactgtatccgcaatcggaaatcgcggcgatgacattgcgggggagtcgcgcatcgccggccgccatcatcaccgtggcggcgcccatcgaattgccatgcaacagaatgcgtgcatccggatcagctgcggtgataagcgaaacccagcccaacagatcgtcgctttccagcaatcccatacccacgtaacgcccttcgctcaactcatgggcgcgctgcgcgggtagcaggaccgtaaaaccgagttgcgcatagcgatgcgcccatttggccatttccgcgggctctccggcatagccatggcagcagatcgcgtatagatgcggctgtgggtcggaacaatccgggtccaacagccagccgtggagtttcaatccatcatggctgcgcagcgtgaccgattgcttggcctcctcgaaccaccgggcggcctcaagctgctcggacatgtcgaattcgatgcctttcggcgtctcctcgtgcggcatgttgaacatcgaacgtttggctttggtgtccagcgcgaacgtgaacatgacgttggcggccgcggctgtgacgccggctcctgtggcggctatcgcggcaagtgccgcagccatacccctgacaacgcgagtgtgtgtggcgatgacgtcatggccatcctcattgatgacgtcgtccgaacgagtcatatcaacctcccgatacggtactcaccatcgtacgttattttcgaaatcatccccaacttcgtgaaagaccgtacactgagtgtcgctgagcgtacgattttcacgaaatggcggacgatttcgtgaaaaccgtacgatgagaacgggtaagcgtacgttcttcacaaagttagggattatttcgcggaaaccgtacgatgacgtggctgggacggccgggatgcagtgtcatcgaagcatcaccgcgccaaagtccggagttggcgtatacttgacaattgttgctttggcgagggaagtgtgcgtgctgacacatgacacagcttccgttatcgactcggcgtatttcactccttgtagggtgtctttcggcgcgtcgtggcgtctgagcgagacagtacgaaacgaaactacaaggagtatccattatggctaccaccattaagcttgagggcgaggcccgttccgagttcggcaagggcgttgctcgtcgtctgcgcgttgccaacaagattccggccaccatctacgccggcggcgaagagcccgccttcgtgaccttgccgatgcgcgagaccaccctggccctgcgtcacaccaacgccctgttcaccatcgccttcgacggcaacaccaagatggccgtcgtcaaggacgtgcagaagaacccggtcaagcgcatcatcgagcacgttgacttccttgaggtcaaggccggcgagaagatcgacgtcgaggtgccggtcttcgttgaaggcaccccgaagggcgctgctgtggcattcgtcgacattcaggagctcaaggttcgcgctgacgtcgccaacttgcctgagaagatcgttgtgagcgtcgagggcctaaccgacggcaccaaggtgttcgctaaggacgttgttctgcctgaaggcgttgagctcgacgttgaggacccggaagagtccgtcgtcaccgttgaggtgccggaagatgcttctgagtccaccgccgctccggaagctgctgctccggctgccgacgctgctgctccggctgccgacgccaagtgagtcgatcgcttcgatagcgaacaattcagaacataactgaaacgtggaagcccgcagccgttgagaacggtgcgggcttcttcgtttttcaccatgtgaactctgccacacgagtaacacatgggtgtgcaaaagtatgcaacagagctcgcgccacaagcgcacagcacacaccccatatggtggctttcgggccgccaaagtcaagaagaagtagctagtaatgactgaaaacacgcaccacgatccggcagcgctcgacaagctcgccgaaccgttcaccgtactgccgaacgacaaccccgcatccgatgagaagcgtcagtccctcatcgacaagccggctttcggccaggtgttctccgacaacatgacccacatgacctggaccaagggcgaaggctggtccgaccgccgcgtcgaaccgtacgcaccgctcaagatggatccgggtgcttccgtgctgcactacgcacaggagtgcttcgagggcctcaaggcttaccgtcatgccgacggctccacctggctgttccgcccggatgcgaacgccgagcgtttccagaactccgccaagcgtctgtacctgcctgagctgccgattgacgacttcctcggttccgtggccgcgctggtcaagcgcgacgccaactgggtgccgtcccgccgcgagtacacgctgtacatgcgtccgttcatgttcgcttccgagccgttcctcggcgtgcgcgccccgcaggaggtcgactactgcgtgatcgcctccccgtccggcccgtacttcccgggcggcgtcaagccggtgagcatctgggttgaagacaagtggttccgcaccggccctggcggcactggtttcgccaagtgcggcggcaactacgccgcctctctgctcggcgagtacaagggtgttgagaatggctgcgagcaggtgtgcttcgtggacgccgccaccaagacctacctcgaagagctcggtggcatgaacatgatggccgtgcacaaggatggccacgtggagaccccgtccctgaccggtaacattctgccgggtgtgacccgtcgctccctgattcagctgctgcaggacaagggccacgacgtagtcgagaccatgattgccctcgaccagctgctcgaggacatcaagtccggcgaagtcaccgaggtgttcgcttgcggtaccgccgccatcatcaccccgatcggtcgcttcaagtccgagaagttcgatgtcaccgtcgccgacggcggctccggcaagctcacctgcgaactgcgcgacgagctgctcggcatccagctcggcgaagtcgaggacccgcacaactggatgtggaaggtgtgctgaactagcaccttttgtttctgactaagaccccttggaacagcaacaattccaaggggtcttggcgtgttggaaatgttcttggctagagagatacagatggatttagcaacattccgcaacaaataatatgatctaggtcttctgcacgttgcggggggtggttatggttcatccagatgagaacaggagcaaacctatgagcaagatgagtgacatgacggaataccatgcttcagcctaccgtttgccgtcaggcttcgaacactgctcgaaattgaagccggtggctgaggcagcgacggcgctggaccgggtcaaggccgtggtggatgtgctgtgttcgccgggcggctgcccgtgggacggcaagcagacgaacaagtcgctgctcaagaatctgctcgaggaaacctacgaatacgtcgacgcggtggagactcacgaccgtgacaacatgcgcgaggaactgggtgatgtgttgctgcaatccgtgtttcaggcgcgggtctgcgaatcggatactgaggacccgttcggtattgatgaggtcgccgatcggttggtgaacaagctcatcactcggcatccgcatgtgtttgcggctgatgatgccggcaattcctctgattcttctgatgcttttgatgctgacagtaacgacgggggagaagctgcccaacccgaatccccggaagctgtgctggctctatgggaaaagatgaaacagcaggaaaagcatcgtaaatccgtgcttgagggcatttcccgcgctcaaggtgcgttgcctcgcgcggccaaagtcgtttctcgcatctccaaatcgccgaatgctgatagattgttcgcggcgtttgatgagccggctgcggctgatgctcagcgagatgatgtacatcctcaagcggcgaaccaatccgaatcaagcggcgacaattccgctgaacgggagaaggccgatgcctacgccgatgaaatcctcgccgtcgtgcgcaaggcccgcgttgacggcatcgatatcgagtccgcactgcgcaatcgcttgcgtgatgtcgaagaaaaagtcgccttgattgaatcagaaatcaacaacgattaagtccatacatgttttttgattacagatcgtaaaacctagaggggctgagttgccaacgactaccggcaagctggcgtcattgccatcctattcacgtcttagtggccccttcctccccggccatactactcaggcaaggcctgttgtaggctcgggtacgacgggctgtagcgccgaataaggatgaacgggaacagaacgaagacggactgagacgaaccgaagcggtaccagaggggagtggctcatgcaggtggcgttggagaacaacatcgtttttgtggtcatcgagtatttagcaatcctgtgttggggattatcgggcggacttgccgccattcgcaagggctacgacatcttcaccatcatgctgtgcggatggcttaccgcactcggcggcggtcttgtgcgcgacgtgatgctcggtgccctgccgccggtcggcatcaccgacaaaggctatgtgctcaccacgctgttttccggcattatcgtggtggtggcccatccggagatcaccaaactcaaatggacgatgactgtcatcgatgctctgggcctcggactattcgcagtcagcggcaccgcaaaagctctggcctacggttcctcaggcatgacagccgtattccttggcatgttcacagcactggccggcggcctcattcgtgacatcttcattggcgacgtgccaatgattattcgagacaaacacctctatgctgtgccttcgttcatcggctgcatcctgaccgtgctggtatggcgcggcgtaggctacggctggttcgacatgcgctcggaaatgctgctcgacgtgctgatcgtcatcatcgtggtggcgctgcgactgctctcggtaggcttcaacgtcactctgcccggagccgtcgaacgtcatcgcgtctacctgcccagcgaaagccgatatctcaagcgcccggtcatccatccgcacgccgataccgtcgatcccggcgataccaccaaggacgaagaagacaagcctcaggatggttcaaggccgcctcagggctaactgtcttcaaagaggtacatctggccttctgcagaatgctaactgctttcaaagaggtacctgaagcacgaaacgctgagtataagtgttgcaatgatggcgtttatagttggtttttcccgtattcggtacctctctgaacggagatgtcatttcgcaagaccgccaatgtacctctttgaacggagatacaaaaagtcccgcaagccagatgacttgcgggactttctaaaaccttaagaggcttatgctcacagagcgttgatcgcaacagcgaggccggacttgcggttggcggcctggttcttgtggatcacgccagcgccagcagccttgtcgagcttctgggcggcaaccttgtaggcggcctcggcggcagccttgtcaccggcggcgatggcttcgcgggtggcgcggatggcggtcttcaggccggacttcacagccacgttgcgaaggtgcgccttctcattggtgagcacgcgcttcttctgcgacttaatgtttgccacgtttactccaaacgatgtgtgttataaggacatacaaaagttagaggatagcatgagccccggaaaaacccgcgcaatgccacgccgaatacagtccctcggctacactaggtgaagtttgagtatatgccaagaggaggaatgcgttggtcgtccaacacaatcagccgggttccacggatcagtcggtgattcgcaacttctgtatcatcgcacacatcgaccacggcaagtcgaccgtggccgaccgcatcttgcagttgagcggcattgtgcccgagcgagagatgcgcgatcgcttcctcgaccgtatggatatcgagcaggagcgtggcatcaccatcaaatcccaggccgtgcgcgtgccgtggacctttgacggcaccgaatacacgctcggtatgatcgacacccccggccacgtggacttcacctatgaggtgtcccgcgcactggccgcctgcgaaggcgcggtgctgctcgtcgacgccacccagggcatcgaggcgcagaccctgtccaatctgtatatggccatcgaccatgatctggccatcatccccgtgctcaacaaaatcgacctgccgtccgcagaaccggacaagcatgccgaggagatcgcaggtctgatcggctgcgagccgagcgacgtgctgcgcgtctccggcaaaaccggcgaaggcgtggccgacctgctcgaccagatcgtcatggacgtgcccgccccgcacggcgaccccgatgcccccgcccgcgcgctgatcttcgattccgtctacgactcctaccgcggcatcgtcacctacatccgtatggaggacggcgaactgcacgaccgcgaaaaggtccacatgatgggcattggcatgacccacgatcccattgaaatcggcgtgatcagccccgatatgacccgcaccaaggcactcggtgccggcgaggtcggctacatcatcaccggtgcgaaagatgtgagtcagtccaaggtgggcgacaccctgacttcggccgtccgcccggccgccgagccgttgcccggctatcgcgacccgaagccgatggtctacgccggtttgttcccgatcgacaacgcccagttccccgaactgcgtgatgcactcgacaagctcaagctcaacgacgccgccctgatctacacgccggaaacctccgtggccctaggcttcggcttccgctgcggcttcctgggtctgctgcacatggaaatcgtcaacgagcgactctcccgcgagttcggcctcgacctgatccagaccgccccgaacgtcacctacgacgtgaccgccgaggacggcagccagcatcatgtgaccaacccgagcgaattcccggacggcaaaatcaagaagattgtcgagccgatggttgccgccgacatcatcacgcccaaggaattcatcggtgcggtgatggatctgtgccaggaccaccgtggcattatgggcacgatggagtacatctccaccgatcgtgtcgagatgcactaccgcattccgctggcggaaatcgtgttcgacttcttcgaccagctcaagtcccgcaccaagggctacgcttcccttgattaccatgaggatggcgagcagtccgccgatttggtcaaggtggacatccttattcagggcgagaaggtcgatgcgttcagtgccatcgttcaccgcgataaggcgtattcgtacggtgtgatgatgaccaagaaactgcgtagtctgattccgcgtcagcagttcgagattccgattcaggctgcgattggttcgcgcatcatcgcacgtgagaacattcgtgcgttacgcaaggacgtgctcgccaagtgctacggcggcgacatcacccgtaagcgcaagttgctcgaaaagcagaaggctggcaagaagcgcatgaagatgctcggccatgtggaggtgccgcaggaggcgttcatcgcagccctgtccaccggcgaggactccaacgaccgcgacaccaaagacaagatccgcgccgctcagaagaccgagggctagtgttcgaggtctacatccacgtcccgttctgcttgcggcgctgcggttactgcgacttcaacacctacacggctacggatcttggtgcgggggcctcgcgcggcaactatgccaatatggtcattcgggaaatgaaattgaccaagcagtggcagctcgaccacggcatcgaggagccgccggtttccaccgtgttcttcggcggcggcacccccacaattctcgccgcccgcgatctggtcgccatgctcgatgccgtccgcaagatctggagcatcgcgcccgacgcggaaatcactaccgaagccaatccggacacggtcaacgagtattacatcaatgagctcgctgccggcggcttcacccgtgtttccttcggcatgcaatctgccgtgccgcacgtgctcaaaaccctcgaccgcacgcatacgccggccaacgtggccgtaggcgtcaatgcggcgaacaaggctgggctgcgctccagcgtggatctgatttacggcgctccgggggagagccttgacgattggcgcacctcggtcacgaccgccatcgatcttggcgtaaaccacatctccgcctacgcattgaccgtggaacccaccacgaaaatgggccgtcaaatcgcggccggcactctgcccaagcccaatgacgatgacgaggccgctaaatacgagatcgctgacgacctgttcgccgccgccggcctcgaatggtatgaggtctccaactgggctcgccccggatacgaaagccagcacaacctcggctactggcgcaacgttgattgggccggtctagggccaggtgcccactcccactacaacgcggtgaccgaggctgaccacccccagtcggcttcgctgacagcccccgctggcgggagcaagtccgaagccattgcctctgcctcagctgatggacaggccaacgccgaactaggtatgatcaacgcgcatgggaacaactcccaagaaattcatgcccccgctggcgggggttgtccggcggatgccggactgggggtggtttctgtctcacacggtctgcgcagctgggacatcgcgcacccgcgtttgtggggcacggccatcaacgagaaccgtgtgccgtgggccgatagcgagacgatcactcccgaggaaaacctcgaagagctcatcatgctcgggctgcgcctgcacgagggccttgacctcgaccgcatcaaccgcgccatcaacgatgcgggtatgagcagcacgccccagactctccgtaatgtttcccttgaccaactcgccccaatggtcagcgaaggcctgattaccgtatccgataatcatcgagtggtgcccactcgtcgtggccggttgctcaatgactcggtaatcgaacagttcttcgatttcgtcggtgtatgagtcggtggtatggtgcgcggcagtcgccattacctgttcgctagttgtggttacaccgtcagagggagctatttttgttttaccggcgggggagggaaccgcgtaggactacgtccggggcgctttgcacgtagatcaggcggttggcagtgccgccggtggcctccccgtcatcgcggttggacaggatgctgtccacggcggcctggcccatttcggccagcggcagatgcacggtggtcagtggcggaaacacgtcggcggagtaggggatgtcgccgaaaccggtgacgccgatttcccgacccggctcgatgccgttggcgcgcaacgcggtcatcgcaccgatggccatcacgtcgttgagcgcgatgattgaatcgatgcctttgccgtcgtacagtgcgccttcgcccggcttcagcagtccggatcgggccatttgcatgacggccgcatagccgtcggtacggctgaacttaccattcgccacggctttcggatccacggtgatgcctgcctcgtccaacacttccatcacgccggccagtcgttctttggaggagcgatgtgcgtcatcgcccttgagaatcgcagggcgcgtatacccggaatcgacgatcagctttgcgatggcgcgcgcgccgacatcgttcgccacgtccacggccgggaagggcaggttgcggttgagcacgaacacggcacgtccgccggatgcttcgtactgggtgagttccgtctgcaacgcctggcgttccggcgcgtcggtgtattcactttcggagatgatgatgccgcgcggcctggtggatacggacttacgcaccgcctccaactcttcgtgcggggtggctgccacgccgatggtcacggaaatgccgcgttcggccgccgccttgaccacgccttgcgatacggatgcgaagtagggatcggagatatcggagaccagcagcacgatgttcggtgcggtgcctttggccactgcctgagcataggcgttggggcgatagttgagcttggtggctgcttccatcaccttgacatacgattggttgcgtaccttgcgggtgctgccgttgagcacgcgggatgcggtggcgatggagacttgggcttctttggcgacatccatcaatgtcgctggcgattgcgccttatcgttctgtacagccacgatcgaatcgatccttttcttccctgaaacggaaaacgtgtctaaacgtttaccgcaacgatatcgcatttttgcttgcaatagtagcattgtggattggaaagcctgaattctgaacaaaaaaataatcacgcgaattacggaaaacgtttaccgtttcgtcgtgtcgtgcggtatgctcgaagcatgacgcgatacttatgcgcccctgactccttcaaagagagcctgaccgccatggaggcggcccgggcgatggctcaggggattgagaatgccgaccacgatgccgaggtccgttgccttcccatggccgacggcggtgaaggcaccgcacgcgcgcttgtcgacgccaccggcggatcgatgcgcgccgtgccggtccacgacccgctcggccggcctgtcgaaggccacttcggtctgctcgccgacggcacgaccgccgtggtcgagacagccgaagccagcggactggcactgcttgaagccaaagaacgcaacccgttgatcgcctcctcctacggcaccggcgaactcatgctcgccgccgtccgttccggagccaagcgcatcatcgtcgggctcggcggcagcgccaccaacgacgccggtgccggacttctgcaggccctcggcgttcgtcttctggacaagaacggtaacgacttggcacacgggggagcggccctcgccaatctgaccaccatcgatatcagcacgatggacccggctctcaagaacgtcgccatcaccgccgcctgcgacgtgaccaacccgctgaccggccccaccggcgccagcgccgtgttcggcccgcagaaaggtgcgtccaaagatgatgtcgccacattggacgccgccctcgcgcattttgcgcaggtaatcgacagccagctcggcgttgccgtgaacgacgtgccgggtgccggcgcggccggtggcatcggtgcagcgctgaagggcttcctaaacgccgaattccgcccgggcatcgccatcgtcatcgaacaatccggactcgatgcggccgcgcaatgggctgacgtggtgttcaccggcgaaggctccatcgacttccagaccaagttcggcaagacgccggccggcgtggccgaaaccgccaagcgccacggcaagccggtcatcgcagtagccgggcatattggcaccggcatcgatgagctgcatgaggtcggcatcgacgcggtattcggcatcgcgcccggagccgccagccttagtgagctgttggccgatgcggccgccaacgtgacccgcaccaccgaacaaatcgtacgaaccctacaactgtgagcaggctcccgctggcgggggctggcgggcttcgcccgactggggggcagcgctgagaaccaccctcagtctcgctatgcgagacagctcccgcagcgggagcgagtaccggaaaggaagacgtgcgcgccacactggaaaccgtgagctgcggcgaactgaccgccgtgtatcgcaaagatagcgacaccggcatcgtggaactggtatcatggatcgtcgacgcgagctcggtcttgtgacatgattggtggtgatggaatcaacgatgagtccaacaaaacggcaccgcctcccattgcgcaatatcgcgcgcaatattacgcagcgtattggctctccgaatgcgtgtctgctaaacctcgtgttgctctatcagcgagctttccgactgcgcagctcaggcaacatcacgacgaacaggatgaccgccacaatcgcggtcagcagatcggcgatggcctgcgcggcgattacaccctgatagccggccagccgggagccgacgaacagggtaatcgccagcatcacaccctgcctgctgatcgacagcacaaaggcgccgaccgccttgcctgcggactggaaggtgcaggtcgtgaccatcacgacggctacgcacaccaggctcagcagctgaacccgcagcatgccggcgcccagcgtgatgatggtggcgtcctcgatgaagaatcccatcagtagacggtcggacaggttgagcaccacggtcatcaccagggcgaacagggacaggaacaggtaggaaaaacgcagaatgccgcgcagtcgaggcatattgcgggcgccgtagttgtagccgatcagcggctgcgcgccgaacgcgaatcccacgaaaaccagcaccgcgatcatgatgactttcagcgcgatgcccatcgcggctaccgcgtcggtaccgtaggggagcaggaacaggttgatcatgacgatgccgacgctctgcgtgaggttcgtgatcgccgaggggatgccgatggcgaggatgctcccgacctcccgggccgtgaccgccagacgccggcgcgcgcggtcgatgacggtccgcgggtcgatggacaggttgctgctgtgacgcagcgtgaaccagacgaaataggcgtcggtgcagatgttggcgatcacggtggcaccggccgaacccgcagcaccccagccgaatccgtggatgaacaggggattgagcacgatgttgaccgccgtgccggccaccgaaccgatcatggactgcacggcgtggccttcggtgcgcagcaggttggacggcgtcatcgacacgatgatgaacggcgagccgacgatgatcagcgtgtagaagtcggaggcatactgccaagtgtcgtcagtggcgccgagcagcgcgagcatcgggtcgcggaacgccaggcccagcaccagaatcagcaggccggtggcgatggcggcatagaagcagaacgcgctgagtcgcttgccatcggcgaaccggtgttggccgaacaagcgcgagatgaccgaactgccgccgaggccgaagatgtcgccgagggcgatcatcacggtgaacactggcgcggtgagggagacgcccgccaccatatcggtgtttcccgtatgcgcgatgaaataggtgtcgaccatgttgtacaccaaggtgaccagcatgctgagcaccacgggcatcgccagcgagaaatacgcctccggaatcggagccttttcgaagagttcgttatccatttccgtcccttggtgtttcgttcttcagtcactgtgcaggatgccgttcggcgtgcatcacaggcattgtagaggcaacagtgtggacaacgggcgggggagtatctcatgatgcggtgagggcgttgatgatgacgcatcgtgtattggcggccgtgtgcatcgtatgtgaacctgtgctggcgcggcgtacgcacgatgggaaaagaaagaatatatggaccccgttgtcccggttattgttcagttttactgtgttgaattattgcgttattcaattattgtggtgtgccggccgattgcggcctgagggggattgccttcgtatgtgtcatgcaatctcatgaacgggattgttcgctagattcagcgagcgtccttgttggcggcgttgatgatgtcggcgaacatcttggagtcggcgtagccggcgcgggcgatggcatccataccggagagggcgagaccgcgaatcatggaatccttgagagacataatcattacctttcgtttgcgcatcgccgtgagcggctttgcgattgttgtttaagctttgttgttatggggtccgtggctaatctgattggattgccggaccggagccgatggttcagcgagcgttcttgttggctttgttgatcaggtcgacgagcgtgctgctgttggcgcgaccgcactggctcatggagctcaggccgtacacagccagaccgcgaatcatggaatccttgagagacatcatgtttcctttcgttggtcaaaaccttggggctttgagttttgtttatcggcttctttctgaaaccggtttcagaataacgcagtccgatgacaaacgcaaggggactattccgctctcggcgtttctggcggaatatcgccgttctttagataccattcggtagttaagaggttgtctagtcgaccttctgacggccttgttctgagcgtacggttttcacgaggtatggcctcatgtcgcggaaatcgtacgctgagtcgtcgtaagcgtacggttttcacgaaatggggtctcatctcgtgaagaacgtacgctgagtcgtcgtaagcgtacggttttcacgaaatggggcctatcttcaccggattttgggcacaccggccttgagcagcttggtctcaagattgatggggcgtagcagatcctcatagaacacatggacgatttcggtgacgccctgttcccggagatgccgatcacgtctgcggtcgtactccattttcgcctggaggcttgcgcgattcttgttgctgatgtcggcgtatttggccatgccgtcgtattctgccacgatgatgcggccgtctgcgagcttccaacagaaatcgacgcgatatgacattgcgggattgtcgggattcatgaactgcacctgcagcagggggatgccgaaagacaattcggtgatctggccacgcatcaatgattcgccgccgttttcgctcaggggatccgcgtacttcagcagcttggtcacggagacctcgtcgcagacgctttgaatcatcagcgactgcacctcttcgatggtcgtcagggactttctcagagccgaatcgtatatgggcagcgcctgtgggaatgggaatgccgcgcagtcgagcagcgttcgcgccggagtcgtcaggagaatgccgttatgcttccgcgtcggaatccgattgatatagatgcggttgagacgcgcctcgtctccgccgccgatgccggacttcgaggcgatgtgcactgtgccgtcgtgcagtgaatagttgtgctgcagtccgtatacgcacgccgcactcaaccccgcaaatacccactgagggtggattgcggacagcgcgcgtatgacctgcaatgactgttgctctctggtcatggtgttccaaagtgttcggtcggcgtacaggttcttatacggtgacaccagctccccggcatgcaggcgacgtttcagggcgcgtcgttgcgcatcactggtgccatagcagcagcgacgctcctgcttcgcctgctgcagcagtgcagaaacttccttgtgttctttcatatctcgacgctaagggtgattttgatcgttgcacaagctcaaccggcaaatgtggatactatgtcacgcgaattgttgctgtggataacttgaatcgacgtcgacggctttgccgacggtcttgtcggaggcgatattggcctaggataccttgctgcgccgccttccataccgaaaacagtcatcagtgacaccgagggcatcttcagcgtacgttcttcacgaaatcagctgccatttcgtgaaaaccgtacgctcagaatgactcagtgtacgttcttcacgagatgaggccccatttcgtgaaaaccgtacgttgacgacgattcagtgtacgtccttcacgaaattagggatgatttcgcggaaaccgtacactcaccgcaactcagcgtacggttttcacgaaattattgatttgggtataggttccccgtcatgaactacaatgaatcgcggcgaaaaacggagaaccgaagtcggagcgcggctgaacggatatgggtgtgactggatggctgtcatagtgatgccggttctctaacatacgcaataacaacaactgacaacaacaggggagacaaggatggcgagaagtgcgggccgcacccggccggtgatcaaggacgtggccaaactggccggagtctcggcaccgaccgtctcccggtatctcaacggcaccgtcaatgtcaccgaagacaagcgtgaacgcatcgccaaggccatcaaggcgctgggctacgagccgagcattgtggcgcgcgctctgtcgaaccgggagatggactccgtggtggtgttcgcggccaatccttccgccttctccacgtccgaaacgaaccatggggtggaggccgccgcccgtaaacgtcggttcctgctcaatattgtttctttggacgagtccgacatggactccgtcaaggctcgcgtgcgcatgggtttgtcgatcaggccggcgggcgtgatcgtctacgagtacgaccgggccggcattgccgcactggaatacattcccaaagatatgccgatggtcgtggtgggtggcagcttcggcgacggcgaataccaggtcatcaacgccgaaagggatggcggccgttggatgaccatgcatctgctggatctcggccatcacaccgtgttccatgtggggcgtccggaaggtccgaccgataacacccgcaccaatgggtggcgtgacgcgctcaaggagcgcggcgtcacggcacctgacccaatcatcgttcccgacgatgatttggaggagtcggtcaaggctgggcgcaccttgggccgtcgtggtgatgtgactgcgattttcgccggcaacgacgagaccgccatcgctgtgatccggggtctaagggaggttggtcgacgcgtgcctgctgacgtgagcgtcgtaggctttgacgaccgcaacttcggtgccatgtggaatccggcgctgaccagttacacccagaacttcctggacatgggggagcgatccttccgaatgctgttcgaacagatccaggccaagcgcgccggcgatgacgcgccgccctcgcaggtcgaggtggtgcaaggcaagccgtgtctgcgagcctccgaacgcgcgtacggcgacggcgaaatcgcgtagtcgatggggacgtgcgtatcaatcgatagtgactgtagcgcatccatatcgtgatgaggagtctctcatgccgaactgtaagcgcttaccttaagtagtttgtaatatggtttacgtcataaaaaaagatattctaaatcatagtgttttgcaagggcttttgcggaaaatggctatttatcaacagtttttgaaaagtccgcatgacgggcgactgtgagcacgctttatggaaccgctttccgtagtgttatcgttacagtatgacttttgaacaatcggcaactctgaagactcagcctcagacctcgggcactatctcagcggcagacgccgcgatgcaataggcccgcgacgaacgcatccccggcaaactcatctgtgcgatcatggccgtggtcattgttatcgtgttcgtcgccatgctccacgccctacgtaaccggaagtaggttgtaggcgggattggtctgactggtatccgccacagccgggttcggtagagcggctaccaatcggccagtgcctctatggcatcgagtcctgttctgcgatgttgttcgtcaaggttgttccggtaaggtgattcatcggtgagcatgtcgtacaggagcttgatacgtctgcgatccgtgtggctatgtagtcgttgagtttcggcgtcagggtcgctgatgagggatgcgggcattgcggcatcgtacagatgtctatctccatatccggcgtggtctgcttggtatgcggcgctcttaagaatcagcgcgccaaacagatccgcgtcggtagtgggacgcacgtcgagaccgcccatgatggcgtgcaactgcaccatgagaccgccggtgagcagtcatgattcggtaatgcgcccggccaccatgtatacgatattccacggctgagcgccgctggggattgcaatgcgggaaatcattgtccattttccttgttgtatgccgtgatgagttctgtaagggtttcgagccctgcgcgtcgttctctcgggtcgttggattcggccagatcagcggcgcatacgccgatgggcatgggcccctgcccggcgggcagaaaattagcgatatgccgtgattcggcgggaggtctcgtactggccccagcccttctgctcggtagtggtaccgctacaccgactctccccgacactccagtgccgccgatatcagtgaatgcccagcctgatgtcggtagagtaaaggctattggcttggtctcgacggtgagacttctccaatggccaatatgcactgttgcaaaggagtatgcggtatgcaaccaatcaaagccattcaatacggctgcggcaaaatggcgaagtacacgattcgctatatgcacgagaaaggcattcaaatcgtcggtgccatcgacgtgaacccggaagtcgtgggcatggatgccggtgtgtttgcaggcatcggccccatcaatgtgccgattcgcgccgatgccgaggctgtactcaacgagtgcgacgcggatatcgcggtagtcacgctattcagcttcgagaacgaaatcgccaccatgtgcgagcagtgcttggctcgcggcatcagcgtgatcaccacctgcgaggaatgcatctacccgtggaccaccgatccggccaccacgaaccgtctcgacatcatcgccaaggaagccggtgccaccatggtcggctccggcatgcaggacatctactgggtgaacatggtctccaccgtcgccgccggatgccacagcatcaagaagatcaccggtgcggtgagctacaacgtcgaggattacggcctggctttggccaaagcgcacggctgcggtctgaccgccgaggagttcgaggccgagctcgcgcatcccgaaaccgtggtgccctcgtatgtatggaattccaatgaagcgctggcccagaagcttgggcttaccatcgcatcgcagacccaggccagtgtgccgtatttcagcgatgtcgacgtgtattccgaaacgatgggcgagacgattccggtcggcaaatgcatcggcatgtccgccgtggtaaccaccgaaactaatcagggcatcacgttggaaactgcctgtatcggcaaggtgtacgggccggatgatggcgatatgtgcgattggaagatcgagggtgaaccggacgtggagttccacgtggtcaagccggcgaccgtcgaacatacgtgcgccacaatcgtcaaccgcattccggacgtgctcaacgcgccagccggatatgtgacggtcgatcagctcgatgagatttcgtatcttacgtatcccgccgcgctgtacgtggcatagccttcatattttcaaggatgaaggccggcactcataagggtgccggtcggtatcaggcggacagagtcgacgtgcgtggcatcacctggaactggatatggtcatgggtgatgtcatcgggccgttcatgccgtaggttcgactcgttcagcgtcaccatgcgatcgataaccgtacgagccattgcggggacgtccatcgccacagtgctgatgggtgggttggtgcaggcggagaaggggataccgtcgaatcccatgagccgtacgtcgtcgggcgcgtggatgccatgttcggtgagttcgcggagcgcgccgatcgctatggtgtcagacatgcacagttctcatgttcccgctggcgggagctgtcatgcgaagcatgactgagggtggtccacagccgccaatccgtaacatcacccaacgcagcatttcacgatacggacgtttccgtatcgtattttcgtgtggtcaaatagacatttcgagcgaaaaagttcgaaatacccccataactggccataaaaaaattgcttgagaatcactattgacttttatggcgactcggtatatggacacatgaaacgtaaatgacatggagcgacggtactgtgtcaacagcaatgaacgaagaggcatgattttcttacgtgcccacaaccaattgaggtgatttcggtgacattcaaagccccgctcgatctcacggtccacgctccggacggtatgtatgatcccgccaacgagcatgacgcctgtggtgtgggtatggtcaccactttgaacaagcgtcctgagcgcaagatcgtcaccgacgccattgaggtgctggtcaaccttgatcaccgtggtgccgtgggtgccgaggagaacacaggtgacggcgccggcattctgatgagcatgccggatgagttcatgcgtgccaccgtgcccgccgaactgccggaagccggtcactatgcggcaggcatcgccttccttgaccgcgacatcgaaacctccggtcagcaggaacaggccattgccaagatcgtgcgcgaggagggactcgaagtcctcgcatggcgcgtggtgcccaccaacccggacggccttggcctgcaggcccttgccgccatgccaggattcaagactctcgtggtcgcctctccggacggtgctctggccggcgtggacttggatcgcaagaccttccgcatccgcaagcgcgtcgagcatgaggtgggcgtctacttcgcatccctgtccgcccgtaccatcacgtacaagggcatgctcaccaccatgcagctcacccacttcttcgaggatctgaacgacgagcgcatgaaggccaccatcgccatcgtccactcccgcttctccaccaacaccttcccgagctggccgctggcccagccgttccgtctgctggcccacaatggcgagatcaacaccatccagggcaaccgcaactggctctccgcccgtgaaggccgcctgagcagcgaactgctcggtgaattcgagccgctgctgccgatcaccaccccgggctactccgattccggcaccttcgacgagtgcctcgaactgctgcacctcgccggccgctccctgccgcacgccatctgcatgatgctgccgccggcttgggagaagaacccggatctcgatccggacgtgcgcgccttctacgagtacaacaacacgcttatcgagccgtgggatggcccggccgacatcgtcttcaccgacggcacccaggtcggcgccctgctcgaccgcaacggcttccgtcccggccgctggcagctcaccgatgacggctacatcgttctggcctccgaggccggcgttctgccggagatcgcgcaggaacacatcgtgtccaagggtcgtcttgagcccggcgagatgttcttggtcgacaccgccgaaggccgcatcattcccgatgaagaggtcaagaggaacctcgctgcccagcacccgtaccgcaagtgggtggaaggcaactccgttgaaatgagcgacctgccccgccgcgagcacgtcagccactccggccagtccgtccagcgccgtcagcgcgccttcggctacaccgaagaggatctgaagctcctgctcacgccgatggccaacaccggcaaggaaccgctcggttccatgggtaacgatgcgcctatgcctgcgctttccagccgcagccgcatgctgttcgactacttcacccagaagttcgcacaggtcaccaacccgccgctggactgggagcgtgaggagatcgtcacctcgctcgaatccgccatcggccccgagccgaacctgctggccgattccgagctgcacgccaagaagatcctcatcccgctgcccgtggtcaactctgatgagatggcccagctcaagcgccttgacaaggcccgcatcctcggcggctactaccgcccgtacgtggtcaagggcctctaccaggtcgccggcggcggcaaggccctcgaagagcgacttgacgagatcttcgccgaaatcgacgaggccatcgccaacggcaagaacttcatcgtgctctccgaccgtgagtccaaccatacgtggggtccgatcccgtccctgctgctgacttccgccgtgcagcaccacctgctgcgccgccacacccgtacgcagatctccgtggccgtcgaggccggtgacgtgcgcgagattcaccatgtcgcgctgctgatcgcttacggtgccgcctgcgtgaacccgtacctggcattcgaatccgtggaagatctggcccgcaacggctacctcaaggtcgacgcggacaccgccgtgaagaacctcaccaaggccctctccaccggcgtgctcaagatcatgtccaagatgggcgtctccaccatcatgagctaccgtggcgcgcagctgttcgaggctgtgggcctgagccaagaagtcatcgacgaatacttcaccggcaccacctcccgtgtgggcggcgtgagccttgaagaaatcgccgaagaagtggccatccgccaccgcgtggcctacccgaaccagtggagcgcgtccccgcaccgcaacctgcgcaccggcggcgactacaagtggcgtcgcaccggcgaggaccacctcaacgatcccgaggccatcttcctgcttcagcagtccacccagcgtggcgactaccagatgttcaagaagtattcgcaccacatcaacgacacgtcgaaccgactcatgaccctgcgtggcctgatgaagttcaacaccaaccgcaagcccatcgacatcgccgaagtcgagccggcctccgagatcgtcaagcgcttctccaccggtgccatgagctacggctccatctcgcaggaagcacacgagacgctcgccatcgccatgaactcgattggcgcacgctccaactccggtgagggcggcgaatccgacgaccgtatcaatgatccgcagcgctacagccgcatcaagcagattgcgtccgcccgcttcggcgtgacctccgattacctcgtgcacgccaccgatttgcagatcaagctcgcccagggcgccaagcctggtgagggtggccacctgcccggagccaaggtcccgccgtggatcgccaaggtccgtcacgccaccccgggcgtggagcttatctccccgccgccgcaccacgacatctactccatcgaggatctgaagcagctgatcaacgatgcgaagatggccaacccgaaggcacgtatccacgtcaagctcgtttccgagttcggcgtcggcaccatcgccgcaggtgtggccaagtgccatgccgacgtggtgcttatctccggctatgacggcggtacgggtgcagccccgctcaacgccatcaagcacgccggcaccccgtgggagatcggcctgtccgaaacccagcagacgctgatcctgaacggcctgcgctcccgcatcgtcgtccagtgcgacggcgagctcaagaccggtcgtgacgtggtcatcgccgccctgcttggtgccgaggaattcggcttcgctaccgcagccctgatcgtggaaggctgcgtcatgatgcgcgcctgccagaagaacacctgcccgcagggcattgccacccaggatcctgagctgcgcgcccgctttaagggcaagcccgagtacgtggtcaacttcttcatgttcatcgctgaggaggtgcgcgagatcctcgcccagctcggcttcaggactcttgaggaggccatcggccacgttgagtgcttggatcaggacgaggccatcaagcgctggaagtccagcggcatcgacctgtccaacgtgctcaagcaggccggcccggtacccggcacgatcctgcaccagaccatcgagcagaaccacgagctggagaaggcgctggacaacaagctcatcgaacttgcccagccggccctcgaacacaaggaacccgtgcgcatcgaaatgccgattcgcaacgtcaaccgtacggtcggcaccatggtcggctacgagatcacccgccgttacggcgaggaaggtctgccggacgacaccatcgacatgaccctgcacggttccggaggccagtccatcggtgcgttcatcccgcgcggcgagaccatgcgcatctacggcgaagtcaacgactacgccggcaagggcctgtccggcggtcgcatgatcgtgcgcccggaagataacgtcaccttcgacaagcacagcaacgtcatcgccggcaacgtcaccggtttcggcgccacttccggccagatgttcgtggccggacgcgccggcgaacgtttcggcgttcgtaacggcggtgccacgtttgtggtcgaaggcgtgggcgaccacggctgcgagtacatgaccggcggcactgttgtggtgctcggccccaccggacgcaatttcggtgcaggcttctccggcggtaacacttatgtgcttgacctcgatatgaagaaggtcaacccgggtgccatcaagtccggtgcactgctcttcaagtcgcttgatgccgaaacctccaagctggtgtacgcactggtcaagcagcatgccgaagagaccggttctcagttcgctgcggctttgctggaggactggaacgagaccgtcaagcggttcactcacgtggtgccgaagcagttcgtggccatgacgaaggccatggaagaggccaaggccaacaatgtagatttcaatgcgcccggcgcctgggaaaaggtgtacgagcaggttatggaaggagcgcgctgacatgggcgacccgagaggatttctgaaggtccgtacccgccgagagctggctgaacgccccgttgaggaacgtatcaaggactggttcgacgttcacgccgaaaccggcctgcaaccgtggacccaagcgcaggcggcccgctgcatggattgcggcaccccgttctgtatgaccggatgtccgctgggcaacctgattcctgagtggaacgatctggtccgtcagggcaagtgggaggacgcgtacaaccgtctgtccatgaccaacaacttccctgaagtcaccggtcgtatctgcccggctctgtgcgagcaggcctgcgtgctcggcatccaccagccgccgaccatgatcaggcttgacgagcagaccatcattgaccaggcatgggatttggactacgtcaagccgctgccgccgcagcgtctgaccgaccagacggtcgccgtcgtcggctctggccctgccggcctcgccgccgcacagcagctcacccgcgccggccacaccgtcgtcgtctacgagaaggacgacgccatcggtggtctgatgcgttacggcatcccgaacttcaagcttgagaagggtctgcttgaccgccgtgtcaagcagatggaggccgaaggcacccgcttccgcaccaacgtggaaatcggcaaggacatcacgtgggatgacctgcgtgaccgttacgacgccgtcgtagtggccatcggctcccgcgtgccgcgcgatatgaagattccgggccgcgagctcgacggcatccacttcgccctcgacttcctgcccgacgccacgcgccgtatcttcggcgtcaagccggtgcacgacatcaccgccaaggacaagcacgtcatcgtcatcggcggtggcgacaccggttccgactgcctcggcacctcgatccgtcagggtgcgaaggacgtcaccgtgctacagatcatgccgaaagagccgtcaagccgtccggacaacagcccgtggccgaccttcgcccgcacctaccagaagacctcctccatggaagagggcggcgagtacatctactccaccgactccgtgaacttcgagggcaccgaagaggagaaggccaaggtcaccattgataactcgaccaccgccgaaggcttcgtggccgatgagcgtggtcatgtcaccggcttgaaggtcgtctccgtggctcccggcgaaaatggtccgttcactcgccagcctggcactgagcgcgtgctgcccgccgatctggtcctcatctccgtgggcttcctgcacccggacaccgagaccatcctcgaccagctgcccgtcgaactcgacaagcgtggcaacatcgctcgcaatgacaagttcgccacctcccaggatggcgtgttcgtgtgcggcgatgccggccgtggccagagcctcgtggtctgggccatcgccgaaggccgctcctgcgccgcagccgtggacgagtacctctccaaggaaaagagcgagctgccggccccgatcaaggccagccagcgtccgatgatgctgcctcgctgaatctctccgttgtggttccctttcacgaggaaacttacatacaacactagatagtcctcatggcccctcatctgaggggccgttttctatttagcagcggctcccccttcgactttctggcataagccggaagctgagtcgataatgccctctaagcaccatccggcaagattgcgtttcaactcggtagtgcccagcactgacaattcggtgtcggtaagcatcatgcgctcaaacgacaacgagtgttcccgccattgcatcagatgtttgttgccaagagccccgccaatgatgtgcacgtactcttgtgtcggtgcttccttgcgtatgagtgccagcataccggcggcgaagagttgctcggtggtataggagagttggaaggcgctcataccaaacactgcaatatccgtatatcatgtgggcggctatgtgcaccgtccacatgatatacctactcttcttgctgggtgagtcctctccgaaggaatctttctattgacgagatttcagggatgtggaatcttcaccaatcggtacagattaagaatctgtgctagttgttgggatgattaatccagtaggcgatttcgcttactgaatcttcggatggcacgatgctgacctgaccctcagaggcaccttccgttcgtatggtcagtgtttcttgcgcaatgtcgtccgtacaggagacggtgcaatcctcgtactgttctccgatggagaatgacgcgttgagcgtcccgctgcccatgcagtacaccgtgagctggtaggtgccggcatcccatggcgaactgtcagtatcaagaatggccatggtttttcgtttaccggtctcatcagtctgatagctgggacgtgcgttgaacgacgcgcggaacgattcgcgattgagctctacggcatcctgtacggcgttatcgagttttgtcacggagcgtttgtcgagaacatgctcggaaacgggtgccttagcaggttgcttcgaagccgcagaatcattgctactgccatgtggagtcatcatccatatgatgccgatggtaagagccaataggctgatcgcggcagcgatgattgcggcctttgtttttgttgccagtcgagtgttcataatggcctagctttcccaatatcggtaaccccatacgttcgcactgggcacgattgcgcttccagaagcgagcacttggacattgcatggagcgacaatggtggcttttttacgtttacctgggcaccgtagttgccatactgcatgttcccataacgaccaggagatatactccgcgaatacttgtaggaggtcgatctggaagaagatgttgagttggaaaatccggcggagattgaagccttaacaatctgcccagtcgtaatactggcagatacgttggatgtgactcccactgtgtaggtggctgtggttgaggcagtgattgtaccgcccggacctgatcggaagatttgtcctacgccgatatggtaattgttattaacaatagtggcgcttaccgaggtctgtccgacctctggacatgcacgcaactctgtgttgccattttttctatggagaaggcttgcggagcaatagatatagagagaagtaccaccataagcgaagcgaacatttttttggcggttctcatgataatccctttcagggggagaaagcgtcggctgattgtggtcacgaatatcgtcagttcgaaccgaacgtggacgacaacgttgtcgttggagaagtcttcaagaaatatgttgatacttaatagattacattgcatgaaccttttgcgcttcattgcaactcatacgaatggacagtgtttgcgatttctccttacaaaggtggtcctacttgttcggatgtagccaatttcagtgacttggttctgaaaatgtcgttagccgtcgttgtgagtaccgtcaccattcgtgtaacgtcctcgcaaattctccgtagccgcgtccccgaggatgtagaaactgattaattattccaaaaatacttgtaatgtctatatttcgagaatattgcatatatagttaatatgaagctcctatggtgtctttcgtcgccaaaaagatgacgccagaatatttgggagagattcatgaacacacgccatgtcacttcactggtcgcggccggtgcggcaatcgtcatgctgctcagcggctgcggatcgaccggtacctccaattccagcaatgcttcagattccaatatcatttccgtgtacggcagtgagccggcacacccactattccccggcaacaccactgaggccggtggcggcaaggttgtagaccagctgttcgcaggtctggtgacctacgatgcgaagggcggcatccacaacgaggtagcagacagcatcacctccagcgacaacgccacgcattacgtcatcaagctcaagagcggatggaagttcaccgacggcactccggtgaccgcgcactccttcgtaaacgcatggaattacaccgccaacagtgccaacaagcaggccagcgccagcttcttcagcacaatcgaaggctatgatgatctgcaaaagccggacgtggaccccaaggccacgctgagcggcctgaccgtcgttgacgacaacaccatcgatgtcaagctcagccagcccgactcggcattcccggtcaaggccggcagccacgcctacatgccgttgcccgaatccgcgttcaaggacccgaagaagttcggtcagcacccagtgagcaacggcccatacaagttcgtgtcctggcagcacaaccacagcatcgaaatggtgaagaaccctgactacaagggcaatcgtgtcgccaagaacgatggcctgaacttcaagatctatacctcgcctgattcggcatacgccgacctacgcggtggcaacctggacttcacgaacacgattcctgacaccgcacttacctccttccaatccgacaagtcgctgaaggcatacaacgagcccggtggcaatacgctcaccttcaccattcctgaatggctggaacacttcggccagaacgaggaaggcaacctgcgtcgtcaggccatttccatgtccatcgaccgcaagaccgtcgccgagaagatcttccacggcaccgccacgcccgccgtcgacttccttgcagccccaatcagcgcctactccaaggaactcaagggaaatgaagtactgaagtacaacccgtccaaggccaaggaactgtgggccaaggccaacgccatctccccgtggagcggtgagttcggcattgcatacaatgctgatggcactgcgaagaactgggttgaggcaatctgcaactacatcaagaacacgctggatatcgatgccaagagcatcccgatgtccacttccgacgaattcctgtccaatgtggattcaggcaagatgacctccgcataccgtagcggttggggccctgattatccatccgcggacaactatctggtacagctgtacgattccagttcggccgacggcaagggcggcaacagcggcaactacaagaaccccgagttcgatgccatgatggacaaggctctttccgccccgtccaccgaggaagccgacaagtattatcagcaaggtgaggagattctgctgcaggaccttccggctatcccgttgtggaaccagaatgccaccgcagccagcacctccgcaatctccggcgtcgcattcgactacggcggcggcccagtgttcaccgcactgaccaagaagcagtaagcagtaagtaataaacagacagcgctagccccccgctggcgggggctgtcggcaaagccgactggggggtggtctcaaacagcagaccacccctaatcttgttatatgagcgagctcccgtaagcgggagcaatcgagaacatacaggagcacattaactatggaattcaccgtatccggcactaccgtgcgattcgatgaacgaacgatgcagttcgcttttacgcgcgacggtgccgaatggaatacctgcgctgatttcaagccgaccctgcaatgcgcgcaaggcaccttcgcgttcgcggatgccacttccatcacccatgagcagcgtgaaaccggcacgggaaccggcattcgcagcatcttcaccggctttgggcacagcgcatactcctttgaaacctatgtatgggtggagcgtgcctcaggcgatgtgctcttcgaatggattccgctcaatgagcaaggcctgaacatcaccaatgtgacgtggcccgcagccatggacttcgattgcgccgacgaccatgacacgacactcatcacccatgagcaaggtgtgatgatccccaacacatggcctaccgccgtgagcaccaaagacatcgccttcgacggccgcttcgaaacggctggcggttacatgccgtggttcgcgcagctccgcgcagacggacacgggtatatcgccatctgcgaaactccatggaatgccggttacggcatcgaccatcccagcaatggcccgtacacccatatcaatacttggtttgagccaagcctcggcacaatgaattatcgccgcgtggtacgctaccagttcctcgaccacgccgatcacacggcggtgtgcaaggcctatcgttcgtacgtcaacgaacgaggtcgcctgcgtacgctcgccgaaaaggcggcgcgcaatccctccgtgcgtgacctgattggtcgctcgtgggtgcacatcggcatcaaaaccaaagtgcagcccgactcgtactactacgataaggaccaccccgagaaaaacgagtcgctggtcaccttcgcacagcgcgaaaagcaaatgcgaacactgcacggcatgggtgcaggccgactgtacatgcacttggatggttgggcacagcccggatacgacaacgcacaccccgactatctgccggcctgtcaggaggcaggcggctgggaaggcatgaagtcgctggtcgacgcctgccatgagcaaggcgatattttcggcacgcatgaccagtaccgcgattactacttcaccgcgcaaacctttgatgccaacaatgcgattcggctggcagacggtacgatgcccgaacacgcacgctgggcgggcggccgccagacctacctgtgcgccgagctcgcaccggactacgtgcgccgcaatttcgccgaaatcgccgcacacggcatcaagctcgactgtgcatacttggatgtcttcacctgcaacgaaggcgacgaatgctcgaaccccgaacaccgcatgacccgccgcgaatgctttgaccgccgcgccgaatgcttcgaatatctgctctcgcacggcatcctctcctcgtccgaagaggtatcggactgggcagtgccaagcctgatattctgccattacgcgccatacgacttccagatgcgctcacccaacgagccgcgccaaggtgtgccggtgccgctgtataacctcgtctaccatgattgcgttatcgagccgtggatgatggagcgtgtggtggacggcgacgattacatgctgtacgccttgctcaacggcggagctccatacctgattcgcgatgccgcatacatcggcgttgacggcgacatggacgacgaacagcgcgctcgcacggaaaacgacatcgaacgctgccatacggtcgctgcattccatgagcgggtcggcatgcaggaactggttcgtcacgagttcgtggatgatgatccgctggtgcagcgttcggtattcgcggacggcactgcggtcacttgcgacttccatacgcaaacctatcgcatcaccgactgcccgcatcactgactgaaaatacaatgacacacagtgggttccgatggactggtggcaaattgccgccgataagcgagtaatatagccaacagtgtcaccgtcgaaacaggagtagtgaaatgccgaatcgtgcagaacgccgtgcccaagccaaagcaggccgcaggggagtgccgtcgcagtatgaccagacccgtggccgtggccgttcgggaatgattgacgaataccagctgcagcagaagtcacagcgtctgcaggacggcaccgacggcaccgaatggaagcccagcggcggtacgattgcggacaccgaaaccctgctgaccactaacccgaactacacgaatccgaagatgttcaaggcaccgcattcgctgcgtcagtggttccgtgtgggcagctggacgctgatcgccatcgcgattatcgcgttcttcgtggttatgtggctgccaagccatccgatgtggctgatcatcaccgtttccgcggtgttcattgtgggtgtgctgagcctgttctttacggctggcgattccaagcataatccgaatttggatcagaacggcacggccgtctgatttttttgcctggtaaatccggcttgaaaagcaaaacgcacgacggaagttgtgcgttttcttgtatgcggtgccctaaagtaagaagtgcttgagtttctttctgacgcacgaaggagaggcagtccgatgaaagttgatattctaacccgcgaatacccgccgcatgtctatggtggggccggtgtacacgccgaggaactgtccaaggtgcttgccgagcgcatcgacgtaaccgttcgtgcgtttgatggcaagcgcaccgaggcggacattcctgctatcccgaatgctgccgatgctaagggcagcttgaaggtcgtcggctatgacacgccttctgagctggctgatgccaaccccgcattgaagaccttcggcgttgatttgcagatcgccaatgatgtggacgccgacatcatccacgcgcacacctggtatgcctgcttggcgggctacatggccaagatgctgcacggcactccattggttattaccgcgcactctctggagccgttccgcccgtggaagcgtgagcagctcggcggcggctacaatctgagctcctgggctgagaaggatgcttacgagcacgccgatcgtgtgatcgccgtgtccggtggcatgcgcaaggatattctgactgcttacccgaacctcgatccgaacaaggtggttgtggtgtacaacggcatcaccatggccgacttcgctaccccggcaccagacgatccgggttggaaggtgttcgagcgttaccacatcgaccgttcgaagcccaccctgctgttcgtgggccgtatcacccgccagaagggcctgccatacctgctcaaggcactgcacctgatttccaaggacattcaggtggtgctgtgcgcgggagcgcctgacaccccggaaatcgccgaagaggtcaagatcgcgttcgccaagctggatgaggaacgcggcaacatcgtctggattgaagaaatgctgccgaagcctgagctgaatgctttggaacacggctgtgatgccttcatctgcccgagcatctacgagccgctgggcatcgtgaaccttgaggccatggcctgcggtctgccggtcgtcgcatccgccaccggcggtattccggaagtcgtggtcgacggcgaaaccggctatctggttccgatcgaccagttgcacgacggcaccggcactcccaccgatccggacaagtttgtacacgatatggccgccgctatcgacaaaatcatggctgaccccgaactcgccaagaagatgggccaggccggctacgaacgcgcccgcgacgtgttcagctgggagaccatcgccgacaagaccgtggaagtctaccagtccgtgctcgacgagcagaagaagtaagtagcgctgcaacgagtgcccccctcagtccggctgcgccggccagctcccctcaggtaccggtttcttggctcccctctttgaggggagctgttaccgcaggtgactgaggggagtcgtcagaccgcgaatcataggtagtatttcactcatgaccaacaccgtcctccaactcgacaacgtcgaattccggcgcaaccgtcgtgtcatcatcaccgacgtgaacctcaccatcaacgcgggggagcgttgggtgctgttcggtccgaacggcatcggcaaatccaccgcggtcggcatgctggccacccgcaccttcccctcagagggccgcgtattcatcctcggccatcaactcggcaaatacgacgtattcaaactgcgcacccgcatcggtctcgcctcggccgacctgggccggcagttccccgagttcgaggacccgctggacgccgtggtcaccggcctgtccgccgtgaccgggcgctggcgcgacacctacacgcaagaggaatacgcccgcgcccgccagctgctgcgcgattttcacgtctcctatctggaaggcaaggagatgtggcgactgtccgaaggcgaacgcacccgcgtgttgatcgcccgtgcgctgatgggagatcctgagctgctcatcatggatgagccgaccaccggccttgacctgggcggccgcgagcaggtgatgcgcacattgagccgaatcggcgaagagaactccgagcgtgccgtggtgctggtcacccatcgcttggaggagattccggctggtttcgaccacatcgccattatgggacgcaagccgattcctgctgaggatgccaccgaagcgggcgtggattcaatgggtaatcccggtgctggcaccatcgtctacaccggttcgttggagaatggcctgaccgacgaacgcttgtcggaattgttcggtatgcccatcgaagtccagcacacccacggccgctgggccgcctacgccgtgtgatgcttgtaggtttttaggcgggattttcttcgccccctctggaggagctgtcagcgtaagctgactgggggaggtccaaccagttacgaaggtaaccatgacaaccaatagcaaactcgtattcatcgatatcgacggcaccctagccgacgaaaaccacgtcgtacccgaatctgccaaaatcgcttgcaaacaagcccaggccaacggccacaagctcttcatctgcaccgggcgttccgtgccgaaaatcgaacgcagcatcctcgacctcggtttcgatggcgtggtttccgtggcgggcgctcaggcgaatatcggagacaggctgctgttccagcatctcgtccctcctgaagcggtcgatgcggcgatggcgtattttgccaagcatcatatcgagagctaccaatggcaaggtgcggatggcatgtacatctcggaaggctaccgtcaacatctggaatcgaaaggcaagacctggaatcgtggcgaattcgcgcgattctggcacctgttggatgaggtggaggtgccggctggctcgactttgggacagacgattcgtgtgagcaaggggtcatacttcacctcgccgaatcctgacgtgactttcgaggagactcaacatgatttgagcccatggtttgagctcgtgcatggttcatatgacaagatttccccgaacaatggcgagttgctgattaatggcatcgacaaaggtaccgctgtgcgcgacgtggcttctttgctgggctatgccattgccgacaccatcgccatcggagactccgacaacgacaccgccatgctcaaggccgccggcacatccgtagccatgggcaacgccattcacggcatccaagccttctgtgacttcaccaccaccgacattcacgaggacggcctggccaacgccttcaaaacgttgggactggtgtgaggctatgtcgtttgctctcagacggaggaccctttcgtgctgtagtattgcgacgcggcacaacgtatgctgcgccgagcatagagaattatgaattcaaaatggtttgttcatcatgcgaagatagtggtcatctgtccgtcgcggttgcgcaatttacggtggcggaggaaccggaacggaatctggagatcatcgacggattcgcgcgtgatgcggcggcgggcgatagggaagccgatctcattactgctgagctgagtcgtgagtgtcttgattccgcgcgtcgaacattgccggtgttgcagaatcgccgttttgccgatccgcagttgtgtgactgacctctgaataactttactagcgctgttgataagggttctatgatgggaatcatgaccactactgttgatagctctgattcaatgccggaacgtctgcaagaggggagcgtggcgcccgatttcactctgccggcggttatacctgggtttacagagagcggatcaatcaacctgtctgacgtgcttgatgccggccgcagggttgtactgtacttctacccggccgcgatgacgcccggttgcaccaccgaggcctgcgatttccgcgacaatctcgcccgattggcgtcgaagaatgtcacagtgctcggtgtctccaaggactcgcgtgacaaactgcgcaagtttgcacagcgcgatcatctcacgttcccgttgctgtctgatcccgacctgaccgtgcacaagctgtacggcgcatacggcgaaaagaagctctacggcaaggtgcacgtaggcgtgatccgctcgacgctcgtcatcaatcccgatggttccgtggcgattgcgcgctacaacgtgcgtgccaaaggacatgtcgattcgctattaaaggcactggaaaagttggagaagctggagaagtagcgcgttctcgttgttcggacacagtggttcgtgcatagcagttccgtgcggtacgtgccgtatgaaccactgccgcatgagccaccggttgacttctcggactcaccggcaaatagtgagaccgtgggcgcgcagtacgtctatggctggcatgtaatcgagcgatgttgcggtgggattgagcatcagttcgcggatggcggcggatgctgaggactcgctcgtcttcgaggattctgcggccgggaagagagcgtcggcgattagggagatgatacgggaacgtgcatcgccggcattggcattgttgctgctgctgccggcgtcggtagtggcggagttgccaatagtagcggagctgttttgtagagtcgtatccaacgctgtgacaagcggctccaggttgttctttgtcgcctcggcaatgtcatcgagctgatcgaataaggcgaacagccatgcacgacttcgctcctcatcgttgccggtcgcaagcctttcattggtgacgcgcacgagttcgtcaatcggtactgctggcgtctttgccggatcgcgatgctcacggttgtcttcgatatcgcccataagatgctggatttcgcactcgtcctgcaatacggtggtctcggcaaatgcggtggcgatggcgtccgcatcgatgaacttgccaccttcggactggaagcgcacgcgcttgggctcactgtaataatgcgacatgccgaatgtgatgtactgaggcatctcatcctgcaattgcttgaccgcttcggccaccttgcgcatatctgccagatgttggtgcatcacgatgaaagcgagcactgctttggtgtcggtaagagtgagcggctgaccgatgctggctccatgatggtgctcatgatgcgcaaacatgttcttcagcgaatcaaacaatcccataatgtcctccttcggactggggcacagtagcttcatatctgtcgcttactgtagtcccgaatatgtgggaatggtccatggaacgccgaaggtgaatgctggttccgggcgatgctcgcagcaattgaaaatatcgcaggacatgacaaaaagcgggtgacaagcgttatcctgaaatacatagggcaaggaggccgtatgacagcagaagtggatgacggtttctttcaattgtttgaacgcaggatttttgtgcgtggagaagcttattacgatgccggcaaggttgatccgccggtcatgattgctgagaatctttggcataccgtggttcgcgggaatgacgactatcaagtggacattcgtttgcgccatggcaaagtgatttctgccgcctgcacatgccaatattcccaacgtgcaacgtactgcaagcatgtggctgcggtgcttatcttcatgcgtgagagccgacgtcgggaattagatgaatcgcaagaccaagtttcagagtttcctcatgaagcattgaattgtgtgagatggtatacgatgtatgaattcccgaaatatcgcggattgacagagggagattggcatgctgtcaagcgaatatttgaggtgttgtactgtatccccgaccttgatactacatatacacatgaggtaatggataccgtttggtgacatccatctcgtaggtaaacagttcgctgtggccaagacgctgagtctcagggatattctcgtccgcaccgagtcccactgcaatcacacgccaaccccgcacagcgagcatccgcgcagtcgccttgccgatgccgctcgtgccgccggtggtgaccaatgccaccggccgtccgtcatccttgattggttccatgtgtaccattatcgcgtggtggtgtcggaatcacggcatggtgatagcagccgcatggaacaagctacttgctaggcgaggcttgagcgtcgtcatccgtcttgcgagcattcagatgccggtgctcgtattcctcgaagtcatcacggacggctgccgcgggatacttgctcttggtctttgcgagcttgcccatgacgatgtcatccatatccacaccaagcgcatcggccatcatgatgcaatacgtaagcacatccgctagttcttccctgacatgtccctcatccacggatggcgactgcggcgtccactggtagcattccagcaattccgacgcctcgatgctgatggacttcgccaggttctcaggagtgtggtattggccccagccacgctccgccacaaaatcacgaatcgactgaatggtactgtcactgatcatgactgacattctaggacttgctgaatgttggtcatgtaccagagctcatgatggaccataatatgactatgaacagtgagagcttggcgccgtttgtcatcaacctgccatatggccaatacagtagggaagcttttgaaaaggcttttgacgaatccctcgagaagcagatggggcgcagtgttaatgattccgagctggaacatttcatgctgcgatatgtgttggcatatccaacggtttatgtcgtgtattcaggaaagaccaatcgctattcgatgaagaacgaatatacggtgtacgtcggtgagaccaacgatatacggcatcgtacattccagcatcttgaaagagatgctaaagaacgcgaggactggaaagctgtagctgatgctgtctcgcggaatgatgatgcatatcggcaatatgttatttcacatcccaaattcaataagtcgttaaccctggatgtcgaaaaccgtcttatgcactatatgtccagtaccgattcggtgaaaaggctcaacaatcgacggaccaatgcgcaaggcgattattacaccgcagaccagtttgatcggattttctcgcaaatctggttgagattacacaaggaagattctgacctgttcccggcggaggagatcatccgagattccgcgttgttcaaggcatcgccttttcataaactcagcgatagccagctcgaagccgaagaatctattttggtgcaacttgccgccttggttgccgatagccggcaacagaagaaagccgatgagcaatctttagaccgccatccgaaattaatctttgttcaaggcgctgcaggtacaggcaaaacggtcctgttaagccacctgttctacagaatcgcggctgaaatcggcatccaaggcgacacctattccgaagacgaagattatcctgagctgccacgaacggcgaatggccggctttcctcatacattcttgtcaatcataaggaacaggtgcacgtatataatcagattgccacgaaactgggtttgcagaaggaatctggtgaagtggtcatgctgcccagtcagttcatcaatcgattcagcttacgcaacgagcatggtcgaggcattccagaccagccgcaaggcctggcggacatcgtgctcatcgacgaggcccatttgttgatgacacaaggaaatcaggggtattccgggaagaaccatctgtatgacattctgcgcagagcccgggtggtgattgcggtctttgatcacaatcagattatgcagtccagccagcagtgggacccagcggtgctggaaaaacttcagctggactctgattcgactcagaccgcatgcgcgaccgggaaaatcggcgcattcaaagcggttgatttgggcgccgaatatcatctgccgtccatttccgtggacgttgcgcatgtccatttgaaaaagcaattccgtattgccgcgagtaagtcgatgattcagtggattgaccgattcgcttcggggaaaggtatcggtcctttgcccgttgatacgggcgagtatgccgcagatggtgaagtgattcgagaaccttatgacgttaaggtgttcgactcgccggttgatttgtttaatgccattcacgcgaaggcccagctgaagcccgatggttgggatggggctggactgtcccgtttgttggccacctatgactggaagtattcggcgaaatctgagaatcagaatgatccgcatggcttttggaatgtggaactgcatcgcgatacttccggcgtatggcgtatgggacttgcggatgaccatggattcgatcattccgcaataagttctgaccaattctgcaagccttggaacaatcagctcgaagattccgctccgaagagcaggaaaggcatcgacaaagaactggcttgggcggagaagccgtacaccatagatgagattggctccatcttcaccatccaagggtttgatttgaactatgccggtgtgatcattggaccctcggcgacgtatcgtaacggggaaatcgtgttcgatgcaaaggccagccaaaactatctggcaaccaataagcgcaaagatttaggagattttgccgaagaaaacttgaagcatgagttgaatgtcctgctcaagcgcggcgtccacggtctgtaccttttcgcggtggacgaaggcctgcagcagcgtttgaaggagtgctgcatccattaaggtatgtgacggaattactgtgctgaaaatgcacgcgaagcgcacgcaaatgatgttgaatgcgctgaaaatgcactcaacatgccgggtgtcgtcgttcgctgaatatttgacttgctgagcacgttggttattctggttcggcactgttattgagttgtctggttattgttattcggcactgcggttattgcggttcggcactgtgcgggttaggctcctttcatccatgcgatggtcacgtggacgaaaggagtgccaacgatggtacgcaggatcaaggcgaagctcgtgcccgggcttcgtgaccaagggctgtcccggaacacgatagccatgggctacggcatgtcgaagcacagcgtgatcaatgtgttcgacgccgccgaccggctcggtgtctcctacggtggtgtggaggacaaaaaccgatgacgaggtgtatgccctgctgtttcccggcaggggtgcgatcgagagtgcccacgagcagcccgactgggcgcgcgtgcacggcgaattgggacgtgtgggcgtcacgttgaagcagttcggggcatccgggcgcaccgcctttgacggcgagggattcgatgagctcggccatcatgccccgtcccttgcgccggtcctcgtgcgtgtaacaggagatgatcttctggtacacgccgtgctgtattgcttcaatgtttgttgggcgggttcggcagtgtttttccgcagtgaaaaaaatcagtgacgaaacacgaaacaccgacttgactaaatacaccttgttgtgtgaactccacggggttcatgtatccgagggtcgagtggagccgctggtggttgtaccaccatacgtaccggttggcgtccgagcgcagtcgttccacgctcgtgtagacgttgtcgcatatgggttccttcttgacgagcctgttggtggattcgaccaccgcgtcgtcgtaggggctgccgggattcgacaggaaacgcgtgatgccgaacacgtcgagcattcgttcgatgcgttccccggtgaactcgccgccccggtcggtgtggagcacctcgatgtcgcctgacgggaagcgcagcatggcgaatgcggccggcacgagatccgcgtcgcgccgcgtcccgacggcgtggcccgcgatctcgcggttcgcgagctcgccgggcaggcatatgcacgcccatgaactgccgaccccccacgtaggccgggttggcggcgatgtgcgtgtgcgggggcgtagccatcgaattcgcggccgaggatgttcggggccggatcgtcgttcggttttgtacgcaggaatattcaattttcatcccgtccggagttacccgttcaggtgagctcctgcggctgggcttgaaccagcgaccgtccgattaacagtcggatgctctgccaactgagctacgcaggaatattcaattttcatcccgtccggagttacccgttcaggtgagctcctgcggctgggcttgaaccagcgaccgtccgattaacagtcggatgctctgccaactgagctacgcaggaatgtctgctgtgtttgagatttctctcgcgcacaagtcacatatcttacatgcctgccacgaaaaagcaaattacatgcgtgtagggcatgtcgcgctgaattccgcagaatcggactcatcggatactatctcatacagccaaaaaccgaacgcggatatacactagcgactaacggtagaggagctggtgtctgcttggcaaatactggaatcggtgaaacggaacaaccgtctgagtatgcgaacccagtgggaacaatcacaagagttctgatgttccgctgtcactgcatggcagcggttgtgacatggatcggccgcggctgaaggtcgaacaacatgacgatgcggcgatactgtcacgcgaaatttcattgtggataacttcggaagctagaaccacataggtcgttttggctggacatcctgtttcggacccctcaaggtgggtatcaccggcaaagaagccggaatcacatcacactcacactatggggaggaatctcatgaatgcaccactgttgtttgattggcgtcgcgacgaagcccgacgtgccagccggcggcgtcagcaggcgcgtcagcgggctcaggaacggcaacggcgtatggatgccataatcgcgttggccgccgttatcggcctgctgcttgccttgggagtagggctggcatccacgcctcagcatgttgcgcatgcggatactgtggtgaccggagatgcggcatacacggtggaggatttcaccgatatgtctgatttggcgtggcgcaatggcaatcagtgcgaatcccgattcgactggccggtcgacgatccacaggtcgaacaacagttcgagcggccgatcaacccgtgggcaccaggtcatcgtggagtggatcttgttgcggagcaaggtaccgtaattctgtcaccacaggcagggaccgtgagttttgctggcaaagtagctggcaaagatgtggtgagtgtacggcatcgtggaggtgtcacgtcgacattcgaaccggccgttaccgagctctcagtgggggatgcgatctcccgcagacagcccgtaggcatcgttgaaggtagctcggaccattgcgaagaccgttgcctgcattggggcctcaagcgaggaacggccgattatcttgatccacagcaatatgcggggagtcgaaaaatcgtactgaaaccgtcatgatttaacggtgattgtcggccggaacagggccgtacggaagagacatcgcaggcggctagcggcgtgacgagtatgaatcacagaccggcatcggccaaggaaatatatccggggtcggtcagcgcggacttgagattgctggcgctgacagccagcaacggttcgctgatggtcgggatcttcttcacgccgcctacctcggagttcctgattgaaggcatggaattcagcgcttcgtccttgttgagcttggcgcaggcctgagcgatatccgtggcgatggtctgtctgtcttccatgccggtcatccattgcttgccattgacgatggatgggatgttcgagacatacgcgccgtatccggttactagaggccactgcgagtcacggtccttgtcggaagcggaggtgtcctcgtccgcatcgtcatcggaactggatgagtcgtttgcgttgtcgttttcaggggatttgatcgggtccggcacggcgtcacggctgagatccttcttgccggtgatattgccgacaatgcccgagatggtgatctgcggattgatatcggcggcagagccggtgtatcccagatcgtccaattccttgacgacctcggaggcgatgtagtcgttcatcgtgatgatgccgtcaatacgggtgagtgtggactgtccgtcggtttttgccagacgcttgtcaagcactttcgcagtggagccttcctcagcggcatcgtaggccacggcttgccaatcgttttccgtggatttgccgtccaaggtgcctgaagggctttccacaacgcccttctgatagtaggagcccagtacctgccagataccacggaacgcctcttgggcgaacgcggaatcgttggcgttgcctttttcgtccacggcggtgtatggcagcagcacctcaatgtatttggggttgtctttactggccttatccaacttgagtttggacaccatcttttccgcctgtagcttgccgatggtctgggcgtccgagaacttgacgaaggcgtccggcttatatccctcgatactgttgccgagcaataccacatgcatgccggactccttggccagtttgagcgatgagaccagccggtccacggcctgcgcctgctcgtccgatgcagtgctgtcgctctcagtgttggacgaatcgtctttggacgagtcgtctttggaagattcaccgtcagaagtagctccctcatccgtggcatcgttggtgctcaggttctggctgatgtaatcgccgtattggcgagtggaagcgtcggcctcgactactggagccacgagcaatgtcatgttgtcgggcgcgatggcaatgccggaatcgtccgtggtgttattcgaaagatgatcgaccacaaagtcttggatggcgcggctttgcttggccaacgagtcggacgtcgtatgatcgatatcgcctttcttgaaaccggcgtcggccagagccttggctaggtcaggcaccagcttcgcccacttgttcagtggcgtctgctggttcagcgtaatgccgtccgaaggtgtgaacacggccacgccgccggcagaattggacgtcaccgtggtttgaccatctacaacggtcttattgtctgaggtgcacgcggtcagtgacagcaccatcgcgcaggatgcgataatggcggcgagcagggtggttgagcggcgtgcgaacaccataagcggcgaaacctcctcaagcgggcgtgaaaacaagctgaatcacgattctagtaggccgtatacgaaaaagtcccggaccagtggacaaatcgccacatatccgggaacaattagaggtattacgtgcgtgcatcgaacaactgtcatgattatcgtgctgaggaacattccagatgaagcacgacaatcatgacagtttgcgacatgacatgacccatgtaggtccgcacgatgtgttcgatgatttactcggccagagccttggccaggttctcgtccagcgcgttcatgaagccgtcggtgtcgagccacggttcgtccgggccgatgagcatggccagatccttggtcatctgaccgccttcaacggtgtcgacgatgaccttctccagcgtcttggcgaagtgacggacttcgggcgtgccgtccagatcggcgcggtgcttaaggccgccggtccacgcgaagatggaggcgatcgggttggtggaggtcttctcgcccttctgccagcggcggtagtgacgggtcacggtgccgtgcgccgcttcggcctcgacggtctggccgtccggggtcatgagcacggaggtcatgaggcccagcgaaccgaagccctgggccacggagtcggactgcacatcgccatcgtagttcttgcaggcccagatgtaaccgccgtgccacttcagggagctggccaccatgtcgtcgatcaggcggtgctcgtaagtcaggccggcctcggcgtacttgtccttgtattcggtctcgaacacctcggcaaagatgtccttgaactggccgtcgtaggccttcaaaatcgtgttcttggtggacaagtacaccgggtaatgacgcatcaggccgtagttgaagcaggcgcgagcgaaaccgcggatcgaatcgttgacgttgtactgcacctgggccacgccgccgtcttcgccgtagttgtagaccacgtgctgaatcggctcggagccatcgtccggagtgaaggtgacggtcagctggccggctcccggaaccttgaaatcggtggccttgtactggtcgccgaatgcgtgacgggctacgacgatcggcttggtccagccgggcaccagacgaggcacgttgctcatcacaatcggctcgcggaagatcgtgccgcccaggatgttgcggatggtgccgttgggggacttccacatcttcttgagaccgaattccttgactcgggcctcatcgggggtgatggtggcgcacttgacaccgacatggtgcttctggatggcgtgggcggcgtcgatggtcacctggtcatcggtctcgtcgcggtgctcgatgcccagatcgtagtagtcgaggttcacgtcgaggtacggcaggatcagacgatccttgatgtccttccagatcacgcgggtcatctcgtcgccgtcgagttcgacgacagtgccttcgaccttgattttggccatgcttcctcctgatagatggtgtgaagatgatttagtcatagcgcatgtttgtaacgacttgaagcaatcgtccggtccgtgggaaacggccttgttggcgtcccacccgggcaataggctggaaaccatgtctcaggaaattgaaatcggtttgggcaaaaaaggccgtctcggctacgcactcgacgatgtggcgatcgtcccctcccgtcgcacccgcgaccccgaggacgtctccacctcttggcagatcgacgcctatgagttcgatgtgccggtgatcggcgcccccatggattcggtgaccagcccggccaccgccatcgccatgggcaagatgggtgcgctcggcgtgctcgatctggaaggtctgtggacccgttacgaggatccgaccccgctgttggacgaaatcgccggactgccggccgatcaggccaccgagcgtatccagcagatctatgccgagccggtcaagccggagctcatcacgcaacgtctgcacgagattcgcgccgccggtgtcaccgtggccggcgcgctctccccgcagcgcacccagcagttctactccaccgtggtggacgcgggcgtggacctgttcgtgatccgcggcactgtggtctccgccgagcacgtctcctccggccaggaaccgctgaacctcaagaagttcatctacgaccttgacgtgcctgtcatcgtcggcggcgcatccaactacaccgctgccctgcacctgatgcgcaccggcgcggccggcgtgctcgtcggcttcggcggcggcgcggtctccgccacccgccagaccatcggcgtgcaggccccgatggccaccgccatcgccgacgtggccgaggcccgccgcgactacatggacgaatccggcggccgctacgtgcaggtcatcgccgacggcggcatgggcgactccggcagcttcgtcaaggccctggccctcggcgccgacgcggtcatgctcggcgcgccgctggcccgcgccaccgaggcccccggcaagggcacccactggggttccgaagcccgccaccagacgctgccgcgtggctaccgcaccacggtcggcacggtcggcccgctcgaacaggtgctgttcggaccgagccaccaggcggacggcaagaccaacttcatcggcgccctcaagcgcgcgatggcctccaccggctacgtcgacgtgaagaacttccagcgttgcggcatggtggtcaacccgtattccgcacgataatcccgattgccccctgaaaatggggggtttgccctccatgcaggaggcttaacttgcccgaaggcgcgctcaagtagtttgacttggcgcgcctttcgtgatgttgtagtacagacgctcgccgatgatggtgagttgcaagggggcttgaagggggtcatcatggagtattcgggatttttccacggcacatatcagtacgggccgttgccgagttatgacggattcatcgttgtggagctgtcggatcgcccggtgcggtatcacatccaacccacattcataggcgggctgaatgcgaaggaatgtcattccatggccatggctgcatgccgcatcgcctgcacatcggcggacgcgatacgtggcaaactcagcgtcgcacatctcaacagagccatgacaaaaccatgcctggaccggctgcaaaccatgcaatacctgctcggcacccacatggtcactcatccggagctcaaagcgaaattctgctatctgcccactgtccccacattgatcgacggcatgatcaccggcaaggacacgctggaaatggcggtattcatgaccatcggccaggaaaatctgcgagtcaacctcaaactgaagtacatcggttctcgatggatgtgcatctatgccgatttgggctgaccagacggccccgcccgcacaccgattcctacgctggtagcggaagacggttctgccgtgtcataggctggttcgcctatagtagtgaccatgcgtgaacatgtagaagaacccagatatgtcaccaccgatgacgacaccgtctactcgctgctgtccaaacgagcagctcgcacgccggatgacatcatcgcggaatggcaggatgacaacacccaccaatggcgcagcgccacagctactgaaatgctgtcccgcgtacgcgaggtggccaagggcctgttgggacttggcgtcaaagccggcaccatggtgctgatttactcgcctacctgctatgagtggggtgtggctgatttcgcttgcgcggcaatcggcgctgtggttgtgcccgtctatgagaccgattccgcccgtcagaccgcgggcatcgtcgaggaagtcgatcccgccatcgcctttgccggcgacttccagcgcgcacagacgcttgagcagatccgtgtcaatcatccgggcatgaaatacgtgttcaatttcaaggccgatggccttgacgctgtcgctgacttcgggcatggcgtatccgatgagacgttggatgcggctatcgctcgtatcaaagccgatgatctgctcaccgtggtctacacctccggttccaccggcaagcccaagggcgcgatgctctccaaccgcaattacacgcacatcgtgcttaacggctacgagattctgcgtggcatgctgtacgacgacaaccgtctgctgctgttcctgccgctggcgcactgcttcgcccgctacatccagtacgtgtgcatcggtggctgcggcgtggtcggatacattcccgacgccaagcgactgctcgccgatatccgcagtttcaagcccacctacctgctgggcgtgccacgtgtgttcgagaaggtgtataacgcggcctcgcagaaggctggtgccggcatccaggggcatatcttcgcccagtcggtcaagcacttcgtcaagtggagcaaggatgagcaggccggtcgcggccattcgttcatcgagcgcatgcgccattcgttctacatggccacggtgggcaaatccattcgttccgctctcggaccgaacctcaaatggctggcctgcggtggtgcgccgctcaacgtggatttggcccactttttcaacggcatgaatgacatcaccttcatccagggttatggcatgaccgaaaccgccgctccgatgctcgtcaattgggaggacgacaacgaggtcggttcggtcggcaagcctgggcctggcatgggcgtgcgtcttggcgaagacgatgaaattgagctgaccggcccgaacgtgttccttggctactacaagcagcccgaactcactgcacagacgatgactgccgacggctggatcaaaaccggcgatctgggtcgtatcgacgaccgcggcttcaccttcattaccggacgcaagaaggacatcatcatcaccgccggcggcaagaacatcagccccgccccgatggaggatgccatcgacacctgcccgatcgtggctcatgcagtagtagtcggcgacggcaagccgttcgtgtccgcacttatcgagctcgaccccgaaatgctgcattcctggctggaaggtcagggcctcaatgccgacatgacactcgccgaggccagcgacaacgacgcggtgcgcgcctttatccagcagtacatcgaccaggccaacgccaatgtctcccgcgctgagtccgtgcgcaaattcgcggtgctggatgaggaattcagtcaggagcacggcacactcaccctgagcatgaaagtggtgcgtcccaaggtattgcagcgctacgccaccgtcatcgaagaggatctgtacgcgcccaagccatccaacaagccgctgcccgccactgccaagatcatcgacagcacgctggagaccgtcaagaaatcctccgaatcggtcaagcaggcgtccgaacaggtcaaacaggcctcggaacagatgaaaaccagcgtgtctgattcgattgctagcgtgtcggagaagatcaagaagtcgaaggccgaacccgaagagggcgagaccggcgattccgccgacaatgccgctgacaccggcagcaagccggaccagccggctgacgagaagaatgaggagtaacgagaagtggccatccgtgagatcagggtcgtgcccgacccagtcctgcgcaccccctgcgatgagatcaaggaaatcaccccggccgtgcgccgcctggttgacgacctgttggaaaccgtggacgatccgggccgagcgggcctgtccgccaaccagatcggcgtgagcctgagggccttctcctacaacatcgacggcaaggtcggctacgttctgaaccccgtactcgaggagaagtccggcgagcagtatggcgatgaaggctgtctgtccgtgcccggcttgtggtacaagacccgtcgtgccgactacgctcgcgtgcgtggcatcgacttggacggcaacgaggtcgtgctcgagggctccgggctgatgggccgtatgcttcagcacgaatgcgaccacctcgacggccacgtgtatttggatcgcctggaaaaggaagaacgccgcgaagccctgcgctacatgcgcaatcgtcaggcgaagtagtccatactcggctcccactggctggagccgtcgaacgtagtgagactgagggtggttctgccggtaccgcccgtgactcccctcagtcgcctacggcgacagctcccctcagagaggggagcctgtttttttttagtaccggctccgtgctattctcgaaactcgtgtgccacccggcaacggacgcagtcgctggtgtccagagccacccaatattgtcaaccggcacacaacaaattcgcgtcatgctcgcgacggcttgtgtcggtcggctgcacaactcgtgaaaccgggggagcagctgcacgcaggtgcgcatggccaggcaagaaccgacaatgaaaggtagtaataccatggctcagatcactatgagcgatatgctgaaggctggcctgcacttcggccaccagacccgtcgttggaacccgaagatgaagcagttcatcctcacccagcgcaacggcatccacatcatcaacctgttcaagtcgctcgacatgatcgacaaggcgtacgacttcatcaagaccaccgtggcccacaacggcaccgtgctcttcgtcggcaccaagaagcaggctcaggaagctatcgccaaccaggccacccgcgtgaacatgccctacgtctccgagcgttggctcggcggcatgctgaccaacttccagaccgtctccaagcgcgtcaaccgcctcaaggaacttgaggaaatggacttcaccgacgtgcacggctccggcctgaccaagaaggagctcctcctgctcgagcgcgagaaggacaagctcaacaagcagctgggcggtatccgcaacatgaaccgcaccccgtccgcgatgttcgtcgtcgacatcaccaaggaagccctggctgttgaggaagctcacaagctgggtatcccggttgtcgccatcgtcgacaccaacgccgacccggacaccgttgagtacccgatcccggccaacgatgacgccatccgcggcatcgaactgctgaccagcctgatggctgacgccgtcgccgaaggtctgctggagcgctccggcgccaacaaggccgagggtgaagccgccgagcagccgatggccgcttgggagaaggaactcctgaccaacgaggctcctgccgaggcttccgctgaagccgccgctccggctgccgccgagggcgaaaccgccgaggcccccaaggccgagtgatgctctacgatgggaagtgcctgaatgagcgcttcccatcgttcatgggtaagcaaaatttctcaaggagaataatcaatggcagcaattaccgccgcactgatcaagcaggttcgtgaagacaccggcgccggcatgctcgacgtcaagaaggctctgaccgaagccgaaggcgacgtcgcccgcgccaaggaaatcatccgcgccaagggtatcgccgcagccggcaagcgtgaaggccgcaaggctcaggaaggcaccatcgcctccaaggtcgtcgagaccgccaatggcgagaccggctacgccgtcgagctgaactccgagaccgacttcgtggccaagaccccgaagttcgtcgagttcaccgaggaagttctcggctacgccgtggacgccgacgccaactccgctgacgagctgctcgaggccaaggctggcgacaccaccgtcaagctggctgtcgaagaggccgccgccctgttcggtgagcacgtcaaggtcggccagttcgccaagatctccggcgagcacgtcgaagtctacgctcacaagaagtccgccgagatgccgccgagcatcgtcgccatgatcgccaccgacaaggccggcgccgccgtggctcacgaagctgctctgcagatctccgccatgggcgccaagtggctgacccgcgaggacgttccggccgatgtggtcgagtccgagcgtcgcgtggccaccgagaagtccctggccgagggcaagccggagaagatcgttccgaagatcgtcgaaggccgtctcaacgctttcttcaaggaagtcgtgctgcttgagcagccgttcgtcaaggacccgtccaagaccgtcggcgacctgttcaaggaagtcggtggcaacgccaccgcattcgctcgtgtcgaggtcggcaagggcgaagaggagtgagcctaaggcttactccacgcgcttagcgtaatttcaacgaaacgccatccggttattcaataatcggatggcgtttcgctattccaagggtgtcgttgctagggggtgtcgtcgtaaaccgatacgcttgtctaaggataatttcgcactttcggttttgagaaaggcacaatatgactgatagcgacaatccgcgcagagttctgctcaagctgtccggcgaagcattcggtggtggcaaggtcggcatcgatacccaggtgattcgtcgcattgccgaggagatcgttccggccgtacaacagggtgtgcaggtggccatcgtggtcggcggcggcaacttcttccgcggtgccgaactgcagcaggccggtatcgatcgttcccgtggcgactacatgggtatgctcggcacggtgatgaactgcctcgctctacaggactttctggagcaggaggggcaggccacccgcgtgcagaccgccatcaccatgggacaggtcgccgagccgtatattccgctcaaggccatccgtcaccttgaaaagggtcgcgtggtgattttcggcgccggtgccggcatgccgtacttctccaccgacacggtttccatccagcgttccctcgaaatccactgcgacgaggtacttatgggtaagaacggcgtcgacggcgtctacaccgccgacccgcgcaaggacgagaacgccaagcgttttgaaaccctgagctacaatcgcgccctcgtggacaatctggccgtcatggacgcctccgcactgtccatggcccgcgacaacaagaagcgcatccgcgtcttcggcctcgaagagccgggcaacgtgacccgcgccctcgtcggcgatgaaatcggcacgctggtctccaccgccgaatcgcgcgtggccgagtaagccgcaaacgcccacaatcgaatcaagcgttcatagacgaacaacactgacgaacaccaacacacaaggagtgaatatgtctcttatcgaccaggccaaggaacagatggccaagaccgtggaaaacaccaaggaaaacttctccggcatccgcaccggtcgcgcaaacccggccctgctcaacggcatcaccgtggactactatggtgcccccaccccgattaaggccgtcgcctccatcggcgttcccgaaccgcgcaccctgtccgtcaccccgtttgacgcttcccaggccggtgccgtcgaaaaggccctgcgcaactccgatctcggcatcagcccgaaccgtgatggcaacgtcatccgtctgaccatgccggaactcaccgaggatcgtcgtaaggaatacgtcaagctcgccaagggcaaggccgaggatggcaaggtcgccgtgcgcaacattcgccgtaagaccaaggaaaccatcgacaaggccgtcaaggacggcgagatgggtgaggacgaaggcgatcgcctgctgaaggatcttgacaaggtcaccaagtccgttaccgacgagatcgatactctgctggagaccaagcagaaggagatcatggaggtctgattcagaccaggtccggagaattatggaacgcaacgaacaaccccatgaagaggccgaggagacgctcgaccagatcaacaagaagaccggccgcaacatgccgcaggccatcgccacaggcgcggcactggtcatccttattgtcgcgtgcctgctgctcagcgtcgacctcttcgtgctgctggtagtcgtgttcatgattctggcgctgtgggagctcagggtggacttcgccaccgtgggcctgcacctcccggtgtttatgctgtggctgtgctcgtccttcaccctcattgccacctactattccccgtaccatctcatcacgatgtcgctgagtatcatcgtgtcgattattctggtcgccatcgcggccagcgtaaaaatcagcgtcggcaaccgcctatctctggcggttgccggcaaactgtccaacacggatgccagcgcgcgcctcgaatcctcgtttaatcatgagggcggggaacagcatcattcccggctcagccatgtggctgtgtccgtgcttaccgtgttgtatattccgttgttggccagctgcgtcatcatctcactgacttttaatgggcatccgattgcacacgccatcatgctggtgttcctacccgccctatccgatacgggcggtttgtttgccggtgcctggctcggcaaacacaagctcagcccgcgcatctcgccgaagaagtccgttgagggccttgtcggctcgatgctcttcgccatggctggcgcatttgccgtattcgcatgcacgtatgatgcctcgaaatgggccactcgttggtgggtgccgatcgtggcgggtattctcatcggtgccgtgggcacgttcggtgatttgtgtgcttccatgctcaagcgcgatatcggtatcaaagacatgggccatctgctcaaggggcacggcggtgtgatggatcgtgtggattccattttgatgagtgcaccgttcacctgcgccttgctgtggatcaccggactgtgattcgcatgtctcgtgcatgaacaatgtggcatcgtgtgtatatcgcacggtgccacatgccatatatggggaaatcatcgttcaatatgcgttcgctatgggctaagacatgggccatctgattcgtatgcggcacgccgtatggtggattctgatattactattgcatgtttgactattttctgatattgagagcgaagcgaacccatcatgaccacacagcatcctgacactccggaaaccggcattactcccggcggcacatcaggtgccttccgtgacgtgctatccaaggaccatgcccgccgtggtaagccgccgctgcactttgtggatatgacgcccgagcagcgcgtcgagaaagcggccgaactcggattgccgaagttccgagtcaagcagctcgccaaccattactttggccatttcgatgtgaatgccgccgaattcactgattttccggcagccaagcgcagcgaggccgccgccgcgtttttcccgcagctcatcaccgaggtgacccgccaagtggcggacgaaggcaccaccatcaagaccttgtggaagctgttcgacggctccctcatcgaatcggtgcttatgcgatacccgacccgcaccacgctgtgcatctcctcgcaggtcggctgcggcatgggctgcccgttctgcgccaccggcaagcttggcctgacccgtaacatgtccaccggtgaaataatcgaacaggtgcgtgtggccgccaagatgatgcgcgacggcgaagtggccgggggagagggccgcctgagcaacatcgtgttcatgggcatgggcgagccgatgggcaactacaactccgtgctgtccgccgtacgacagatttccgccatgcctcccgaaggcttcggcatttccgcgcgcaacatcaccgtatccacggtgggcgtggtccccggcatcaagaagctcactgccgaaggcattcccgtgcgtctggccgtttccctgcatgcccccagcgacgaactgcgtgacgagctggtgccgatgaacaagcgtttcaataccaagcaggtgttggatgccgcgcacgattattggctggcctccaagcgccgcgtcagtatcgaatacgcgttgatgcgcggcatcaacgaccaggccgagcatgcgcagttgctggccaagaggcttaaccattacggcgacaactgggcccacgtcaacccgattccgctcaaccccatcgagggctcgaagtggaccgcctccaagccggaagacgaacagcggttcctggagatcctgcaccgagcgggcatcaccgccacactgcgtgacacccgcggtcaggatattgacggcgcctgcggccagctcgctgccaaggagcggtagctacttcagcgcatccttgattgcgcccacgaagtagtccagatcgtcgggcttgcgggacgtgatgagcttgaagccgttggcgtcgtccacgtgcagctgctcgtcgacgtaatggccgcccgcgttctcgatatcagcggcgatatagcggcagggcgcggcggtcttgccagtcaccagacccgcgttgaccagcgccgcgcgccatggcagatcgcggcgatcggcttaccttcgtgcgcgaactcctgcgccagcgtgatcgcatcctcattgacgcggatacgatccacattgcaggtgccgccgggcaccaccagcaggtcgtagtcggcagcctgcacgtcggacaggcgcgcgtccggggtcagcgtttcaccttcgtagcggtcgtgctgcaccgtctcacacgggtccaaggtagtggcggcaagcgtcaccttggcgccggcggccttgagatcgcgcagcgggcgcgtcagctcggtctcctcgataccccagttgttgacgatgatcagtaccgtgctgttttcgacagccatgccaatctccttgattcggcggacaacttccacgagccattctctcacgccgagcggctgccatgtcggtgctcaatatgatgattctcatattccagaaacaggtgcggcgcatgtaacgggcggtaggtagtctgaaggactgtaatgcaaagccgaacaggggagtgaagcatgtcgttggcggtacgagtcatcccgtgcctggacgttgacgccggtcgcgtggtgaagggtgtgcatttcgagaacctcaaggacgcgggtgacccggtggagctggcggccgaatactaccgtcagggagccgacgagatcaccttcctggatgtgaccgcatccagctcccaccgcaacacgatgattgacgtggtctcctgcaccgccgaacaggtgttcatcccaatgactgtgggcggcggcgtacgcacgcccgaggacgtcgactcgctgctgcgctgcggtgcagacaaggtcggtgtcaacacggcggccatcaacgacccgtcgcttatcagccgtgtggccgatcgtttcggcaaccaggtgctggtgctctccgtggatgcccgccgcgaaaagggtgagcagcatacgcagtccggttttgaggtcaccacgatgggcggccgcaaatccaccggtattgatgccatctggtgggtcaagcgcgccgagcagcttggcgccggcgagattctgcttaactcgatggacgccgacggcaccaaggaaggctttgacctcgagatgattcgcgccgtgcgcaaggaagtcaagattccgatcatcgcctccggcggtgccggcaaggtcgaggacttcccgcccgccatcgaagcaggtgccgacgcggtgctggctgcatccgtgttccattacggcatcctgactatcgccgatgtcaaggcggaactcaagaagcacggctacaccgttcgctaaacgaatacaccttgctcccgctgggcgaacaatccagtgaattgttcgtggcaatgcgctatgcgcacgtcgcacataatccgggagctgtcagcgaagctgactgagggtggtccacaaaaagaagataggtatgacagacactacatacgacaattccactgaactcgatccccgtattgccgcacgcctgaagcgtgacgccaaggggctggtcgccgccgtcatccagcagtacgacacacgcgaggtgctgatggtcggctacatgaacgacgaggcattacgccgtacgctgaccaccggccgcgtgaccttctggtcccggtcccgtcaggaatactggcgcaagggtgatacctccggccatgtgcaatacgtcaagggcgtgtccctggattgcgacggcgacgcactgctcgtcgaagtcgaccaagtcggtgccgcctgccacaccggcaagcgcagctgcttcctcgaaggcggccccctgcccgtggtcgaaggccatcgcccggccgatcagtagaacgggctttcctgactgggggaagccgagcgaccgcgtactatgaaacaagacatcgagttgtaagcaaaggagcgaatatgagcgaatgcagcgtcaaacacctgaagtggggcgccacctggcccagtcgcgaacagttccacgaactggccgacgccggataccgtgtgattccgattgtgcgccgtctgctcgccgactcgctcaccccggtcggcttctacgagcgtctcgccggcggccgatccggcaccttcatcctcgaatcggcggaatacggcggcacgtggagccgttacagttttatcggcgtcaactcgatggcccagctgcgctccaacaacggtcaggccgactggctgggcaaggtcccggtcggcgtgcccgtcaccggtgacgtagtcgaagtcgctcacgccacgttgaagactctgaaggccccgcatgtggaaggcctgccgaacctgaccagcggtctggtcggcacggtcggctgggatgccatccgccactgggaaccgaccctgcgcgccgaagctccggacgagaccggccagcctgagaccgtgcttgccctggccaccgatatcgccgtggtcgaccacgtatccggttcggtatggctcatcgccaatgcggtgaatgtggatgataaatccactcgcgccgacgctgcctacaacgaggccgtcgctcgactcgaccagatgcagcgcgatgccgccaccccggctccggacgagtctcgcgtcaacatcctggacgaaacggtcgcccaacccgagctgcgcttccgcaccgagaagagccactacgagcaggccgtcgaacgagccaagcagtacatcgtcgacggcgacgtgttccaggtggtcatctcccagcgcctcgacatcgattcgcctgctgacccgttcgacgtgtaccgtgtgttgcgcacgctgaacccgagcccgtacatgtatttcatggcgttgaccgacgctcagggccgcgacttcaacgtgatcggctccagcccggaaaccctcatcaaggtggacaacggccacgcgatgaccttcccgattgctggatcccgccctcgcggcgccacccctgaggaagacgagaaattcgccaaggagctgcttgccgatccgaaggaatgcagcgagcacatcatgctcgtcgacctgtctcgcaacgacctgagtaaggtgtgcgtgccgcagtccgtggaagtcgtgcagctcatggacatcaagcgtttcagccacatcatgcacatctgctcgacggtcaccggcaaggtcgacccctcgctgaccgcattcgatgtgttcaagtccgcgttcccggccggcacgctgtctggcgcgcctaagccgcgcgcagtcgaaatcatcgacgagttggaaccggccgaccgcggcatctacggcggcaccgtcggctacttcgatttctccggcaacatggacatggccatcgccatccgcaccgcgttcctgcgcgaccatgaggcgagcgtgcaggccggtgccggcattgtgctcgactccgtgcccgccaccgaatggcaggagacgcgcaacaaggccgaggccagcgtcgagtccatccagatcgccgcccagttgcgcgaactgtaacgttcaacgcatagcgatgcccccgctgacagaagttgtcggcgggggcatcgctgtctgtacgttagtgggtttcgcccatgatgtcggtggcgtcggtttcggtgctcacagcggcttcgatggcagcttcgataccgtgcgccatggtcgcgatcaccataccgggcgtcgcattcttcaccttgccgatcagttgcgcggctgcgtatggacgcatgagcgtcggctgagcccggtcggcatggtgttcgctatgatggacagtcggactttggtaagagacagtattcgtaacaggcaagtaggttattcatggctattgaggtgcagggacttgaaattcagatcggcgcgcgcacgctgcttcaccccaccaacttccatgtggccaagggagacaagatcggtctggtgggccgcaacggcgccggcaagaccacgctgacccgcgtgatcaccggcgacatgctgcccaccgccggcaaggtgcgcgtctccggcaagctcggctacctgccgcaggacacgcatgcctccgatcccacacagaccgcgctcgaccgcatgatgagcgcgcgcgacatcgccaccatcatcaaccgcatccgcaaggccgaaaaggatatgaccgacccggatccggacgtgatgagcaaggccatgacccggtacgacaaggccatgcaggacttcgacaaggccggcggctacgcggcccagtccgaggcgatttccatggccgcctcgctcggcctgccgcaggaggtcatggagcagcagctcggcacgctctccggtggccagcgccgccgcatcgagctggcgcgcatcctgttctccaatgccgacaccctgatcctcgacgagccgaccaaccacttggatgccgattccatcgaatggctgcgcggctacttgaagaagtacgagggcggcttcctggtcatctcccactccaccgaactgctggacgaagtggtgaacaaggtctggcatctggacgcgcagctcggccagatcgacatgtattcgcttggctggaaggcctacctgcaccagcgcgtggtggacgaggagcgccgccgccgcgaacgcgaagtggctgagaagaaggccgaccgtctcatgaagcaaggcattcgactgcacgccaaggccaccaaggccgtggcggcgcagaacatgatgcgccgtgccgaaaagctgctggaaaacacctccgaggcgcagaaggccgagaaggtggcggacatccgtttccccgagcccgcgccctgcggccgcacgccgatcatggccaaggatatttccaaggcctacggttccaacatcgtgttcgccggcgtgaacctggccatcgacaagggctcgcgtgtggtgatcctcggctacaacggtgccggcaagaccaccacgctgcgcctgctggcccacatcgaggagccggacaccggttccgtggaatacggtcacggctgcaagatcggctacttcgcgcaggagcacgacaccttggatctgaacgccaccgtgttggagaacctgcagcatgtggcgcccgagctcgataacacgcaggcccgttcgattctcggctcgttcctgttctccggtgacgacgcgatgaaaccggctcacgtgctttccggcggtgagaagacccgtctggctctggccacgctggtcacctcgcgagccaacgtgctgctgctcgacgagcccaccaacaacctcgaccccgcttcccgtgaggagattctgaaggccattgccaagtatgagggcgccatcgtgctcgtcacccacgatgagggcgccgtcgaggcgctcaaccccgagcgcgtgctcctcatgcccgacggcgacgaagacctctggaatgattcgtacctcgaactcgtagctgaagaatagtagtaaactcgtagccgaagaatagtagtaggagaggtctgccatgccaaccacaacaggtaagaaaatcgccatcgtcaccggcagcgcgctgggcctgggctacgagctcgccagccagctcatcgccaacggctggctggtggccggcgtcgacttcaatgccgaacgtcaggccgaactgaccgcgcagtggcccgatgactcctaccgcgccttcgtcggcgacatcaccgacgaagcgttcgtgaaagaatccgtggcggatatcgccacgctcggccacatcgatttgctcatcaacaacgccggccagccttcgttcaaggtgcccactgcctacgaggccgccgacgtcgacaaatgtctcaagggactcaaaggcatgattctgtggacggtggaaaccctcaaggcctgcggcgaacagaatgtgaaaatcgctcagattatgagtacggccgccacgcgcggcaacgcgaacgaaagcgtgtactgcgccaccaagtggggcgagaagggctataccaagagtctgcaggccgcatacaagggcaccagtgtcaaggtggtcgccgtctatccgggcggcattgataccgctttctaccgtgacagtcgcgactacgtctccgaggccaagcagcacaccttcatgcagcccggtccgctggccgaagtcatcctcttcaacctgatcaacgaggccaacctcaccgtcaccgacatcgagatcaaccgcaacagctgagcctgctagtctgagatttcagcgccttggtacatacttggtgccaaggcatttcgcgtgtggagagcgaatgcacatcagtgacgatgagtttgaacgggcaattgaacaggtgttggatgatttgcctgaacggtttgcgcgggtgctggagaatgtcggcatcgtcgttgcggacgaacccaatgagcgcgaactggctacaatgagcaatccgtgcggtgaactgctcggactgtatgagggcatacccgtcacgaagcgaactacgggctacagcggcgtgatgccggacgtcatcaccctgttcaaggggccgcatgaacgcgtatgctcaacgcaggccgagctgcgccaacggatccgcaaaaccgtgttgcacgagatcggccattttttcggcttcgatgacgagtatctgcactcgcacggctactgaagcgatgctagtttcactagcggggagccgccatactgccgtatgttgccaggtctactgcaagtggtgcaacgcacggatgatggcgcaacggtcctcgacggttccctcgttggcgcacatggtggcgtaccaacgcggattgcgcaaggtctcggtgccggtggcctcatccgtggcgacgagcgtgtgcagatcgttggcgtactggaaatgcaggtggctgagcagcccgccctcggcgaacgccttgcgcgaaggcagcggattgatggcaagcagccagcggaacgggctgtcttcggcggccggatcggtggtgtggaacacgaaggtgggggagccttcgagaccgtgctcgatgacatggtcgatggtgtattcgtaggtgtcgaggctggtgtcgtcctcggcgaaccattcgatggcgagcgcggcatcgtccgtggagccggattcggcggccggctcgttcacacgccagtagccgatatggatgatgttctccgggctggtggtggagcaagccatcgaccagaacgtcctgatgccgcgcgcggccatcggggccatcttcgggttggcgagcaccgcctgctcggcggcttcccaggtctgctggatggcggcgtcatccgaatcaatgtaatgctcgaagctttcccattcaccgagccagtcggtgatgtcgaaggccgtggaatccgtggtgttgctggcggtcattgcgcgttcctttcatgggtggatgtggtggcgaaattggtagaggcattagggttggggctgctggcatctgggttactggcatgcgagccgttgttcccggaatcgtcggcgccaagattgacaatgcggtcgcaccagccggcggcgagctcctcatcgtgggtgaccacgagaatcgccttgccttggctcgccagttgccgcagcagttcgccgacctgctccatgtggtagcggtcgagtccgctggtgggctcgtcaaggatgatgaggtccttgccgcacatcaatgccgagccgatggcaacccgctgcttctgcccgccggacaggctcatcggatgccgttcggcgaacgctgcaaggtcaagatcggccatgacctgattggcttgagcggtgatgccggcatccgtctcgtcgagtccgatgagcagttcctcgcgcacgctgtcggagaacagttggtagttgacatcttgcatgaccaggaatccggcgcgggtcaggtcgcgcggtttcgcgggcacgccgttgagctcgatgcggcccgaaacaggcttgatgagtccggtcaacgtgcgcacgagcgtggtcttgccgcagccgttgttgcccatgagcccggtgatttcgccggcacggaaccgcaggtccgggatggcgcgggtgaagccgtccttgcctttgtatccgatggtgaggttatgggtgccgagcaatgccgaagtgcactcatccgcggccgggcttgaagccagcgtcgcaatccggtgccgatacggttgcaggtccaacgcccgcaatcccatggcggccacgcagccgggggagagggacaggaattcatcggcctcgtaatcctgcacgatatgcccgccgtcgaataccacgtaccggtcggccacgccgttgagccatgcgagtcggtgttcggcgattacgatggtgagcccttcgtccttcatctgctcgatcatggcgcgcatgtccgcgatggcgttcgcgtcgagattgctggtcggctcatccaataccacgagcctgggccccagcatggtggccgccgccacggcgatgcgctgcttttggccgcctgacaggtggaagatgctgcgatgcagcagatgcccaatgccaaagcgctcagccacggccgtgatacgacgattgatgtcctcggccggcagccctatgttttcggccgggaaggcgagctcgtcggtgacgttcgcgttgaaatactgggttttcgggttttggaacacgctgccgaccagcggggtgagccggtcgatcggcacggtctccacatccagcccgcacgtggtctggttgccggcgaacgcaccatggaagaatgaggggatgagcccgttggcaacgcgcgtatagctggttttgccgcagccgctcgccccgcacagcacgatgcactcgcctgcgggcacggtcaacgtgatgtcgcgcaatgccggctctgcggcatggtcataggtaaaggagatgccacgggaggcgatggttcccgcagacgtgtcgagtgggccacccttgccggtcccaataatggcagttgcattcggctgcgattggttgccacccatcagatcacccccgcgatatcgagcgcgagcggcaaagtgaccacaatcatgaccagccagtcgaccacggtcatacggatcagcgtgcgcgaggtgtgctcgccctcacgcccgagccccttggtcagtgccgccaccgacaggtcctgtgccacattggtggcgttcatcagcagcggaatcagaatgtattccaacgattgggccgggtgacgaaccagcccccagccgccggaggcgatgccgcgcaacgccatcgcattgcgaatctgccggtaatcctcggcgatggtcgggaagaagcggatgaccaccacacagggaatcaccacggcctcaggcacgcgcatacgccgcatcgcgcagatgaacgcgctcgcggacgtggtggtgaacgtatacgcgccggtgatgaaacagggcagcatcatcgtgacgcccacggccagcgcggagaccacatgcagccacggcagtcccagggcatcggggtcgagcattcccagcgcggtgagtactgcataggtcacgccgaagttcaacgcggttcgccatcgggcggccgccagcaggggcagcaggaacagcacgaccatgacgatttgcgtggcgagccctacgtggaagaacagcatgaggttcgccaccagcagaaggtagagtttcgcgcgcggatcgagcgtccggcgggcaggattcatcaggcgataccggccttgatgaagtgcttcttcatcatgcgctggccgaaccagccgccgagaaccgcgcacaccagaatcgcgatcatcgagatgaagaacgtgccggtgttgatgttgacgaatacgccgtcgatgtaggctgcgtccttgccgcgcgcctgcaggctcgccacgtaggcgtccttcatgaaccacaggggcaggatcgggccggtcaggccgtaggagaacaccacgtagctgacgagcagtagcgccttgctcttatacttgccggcgcgcgcgatgaggtcggccgccaccgggaacacgatgctggcgatgaacgaaagcacgaaatgcccggagatgaacaggaacagtccgatgatcacgcccatgacggtgatgccgccgaatttgccgaggcgtgcggccagcagcatgtacacgcagccggagatgagggccgtgatggcgggcaggaagatggagccgaagccgccggtgaacagggtgctcaccagtgtggcgatgcacaccatcacgaagtacagggccgcaaacacgccgatggtgatgaggtcggagacctccagtttgccggatttggcgggcttgttgagctggtcagaggtttcggcgggcgtgttcggtgcggtcacgatgttttccgtttcgtatgcattgacaatattcctctcgccaatctaacgatgatttcccgcaaaggcaatagtctgtctgtgatttttagcatggcttggcgcccctccctgtggggggcgaaggacgtggcgcgggcggggtgtggttcgcggctatcggctagtatggtgcggtcacgacagagggaggcatgctgtggccgatgtgatgcgggagctggaacggctgcgaccggtgtatgagacgggcgtcctgcggttgctgttgcgccagaacgcgatgctgtacgtgtcgctgctgcgttccacgttcgacccgctcaccggcgagctgccgcgcgagaccgtggaggagcggttcgcgcaaagtctgaacgctctggccgacgccggcgaatatgcgccgcgcgaggaccagaccttcgccgaggccgctcatcagatcctcgccgacctgacccgtgaaggcgaaggcgactacgcctggctcgccaactcgcatgatgcggcctcacaccgattcctctaccgtttgacggcccgcgcccaccgcgccatcgaggcgctgagcaggctcgaagacgaatcacgcgccctgtccggcgcgcaggccaacagcatcatcatggaaatcgagcacgcgcgcatgcagctgaccgccgaccccggcgagcgcatcaaactcctcaaccgtgaaatcaaggaacgcaagcacgagatcaaacgcatccaacagggcaagcagcatgccacgctgagcgaagcccaggtggaggacgtgatcgccgtgatccacaacacgctgcgcggcgtgcccatcgacctgcgcgaactcgtgctcgacgagcgggacaacggcgacgccttgcgccggcgcatgcaggccggcgacatcagcgtggacgagaacctgacccgctaccacgatgaataccgccgctcgttcagcgaatcagacagcggccgccgcttcgaggacgccttccaggtgatcatcaccgacgagggccgccagcaaatcgacgaagccctgcgcgccatcgccaaaaccccgtatctggccggcgaatccggcgtgctgctcggccagatccgcgacgaactggcccgcatctacgacggcatcgaagccgtgcgccgccagatgcgcgtctccgacgaggcgatcagccggctcgtgcgccagcaaaccgacactcgctaccgtacgatgctcacccgcttgaaccgactgtacgcgcgcctcaacgcggatgcgaaaacccatatgggagacgcctcgcgcccgtacgacacggccacctcggacgcgctgttcgcgccattgccgatgcgcccggccaaatccatgacccgcgccaccgcacccggcctgagcgacctcgccgccgaagccccgcagtcgactccggtggccgatctgcgggacatggtcaacagcggcggcccccgactcctgcgcatggtcagcctcatccggcgcaacccggtgaccgttgacaggtccgatggcaggcccggcgcaaccctcgtggacatcgccgccagcttcaaccggctgcccgaaagcgaacgccgcgaaagcgagatcgtcggcttcctgggcgggctgggagccgtaagcggcaacgccatcgccgacgagccgtccactgacggcgtcggcgtcggggtcgacagcgacatcgccaccgagccggccccggcgcagcgcggcgatactgcgacctggcattgcgtatcgattgacggcgagccccggaactggatcactagaccggtgctggccgacatggacgagctgagcatcattgtggaggaaggatgaccgtggccgaggaacacgaggaacacgaggaacatatggacaacgccaacccgtacgccctgttcgaaggcgacaccggcgacatgccggccgaggcacgcatggccgccatcgccctcaaacgcgaccgctatatcagcgggcccacctacgacaccgtgctcgacaaccgcgacgccgtcgtacgctccctgaacaacgacctgctcgacttggtgatcaacgaacgctaccgcatcatgtacgccacgcccgtggccggcgacgacgtgaccctgcgctcgctcaaaacccgtgtcagcctcaaacgcgaggaggccgcgctgctcgccttcctgcgcatccgcgtcctcgaatacgagaacgtgcacgccgaccccgccgactggctcgtcagctttgaggagatccgcgccgcgctcgccaccggcgccggctatctggccgcccgcaacgacgaggaaggcgtggcaaagcagatcggcgccatcgtctccgcgatgatcacctacgggtatttggtgcgcctggacgacgaagccatgtaccagatcacgccgctcgtgcccgtggtgctcgaccgcgaactggccgacacctggctcgacgtcgcggaacacggcgacggcgacacggaagatgacgatgacgacgagaagggagccgaatgatgcaggcgacagacgtgcagatgatcgcggaccggtggatgctggaatcccgacgactcatcaactggggctcctatgagggctaccacgaattccgcccctccacggaccacaagctgccggtgaccctgctcgccggcgccagcgaatccggcaaatccacgctggtcgacgcgcagatctccctgctgtacccaaccggtacgccgttcaacaaggcctcgaactccggccgctccgaacgcagcgactacacctacctgcgcggcatggtcggcgtgggcagcaccgaaaccggcgacgagccgctctacctgcgcggccgcgacgagaacggcgcaccgcaacccgtgtggggcgccatcgtggacacctatcgcaaccagaccaccggccaggtgctctcctgcgccaaattcctctacctgatgcccggcgacggccgcggcgacgtgcgccgacagtacgtggtctggggcaagcccgtggaccccaggcgcatggaccaataccgtgacgccccgttcacgccggcccagctcaaagccacctaccccgactgcctcacattccccagcgccgaagcgttccacacacacatctggagcgcaatgggcctgagcgaggccgcctgtcgactgctgcacaagatccagtccgccgacgcgccctcccggctcgacgacatcttcaaacaaggcgtgctcggcgtgcccgaagccctggacctggcccgcaccacggtcgaggactacgaacgttacgacgagaacttccacgccatggacgagaagacccgccgcatggacacgctgcgcggcatccaacaggcctacggcgaatacgccgccgcacgcggcaaggcccgcgccttcgaaccggtcaagccggccgtcgacggcacggtgccggccgtgctgcgcgactgggcattggcccgcatgcgcggcgaagtcgccgtccaactgcccgccgaccgcgccgaacaacagaacagcgaggcggaagccaagctgctgcgccgccgaaccgaagacctgcgcacccgtctcgacatgatccgcggccagatgcagggtctggacggcggcaacctgacccgactcgaactcgaactcgaccaggcccgccgcaccctcgaagacgtgcaagccaaccgaacacgaatcgaacaaacgttcgcatccatcggcgagacgctgcccggcgacgaacaagcctggaacgaacgccgcatcaacgccgtgaacttcaaacgcgaatacaacaaacgagacggcgaatgcgaggaagccctcaccgccgccatcaacgcgcgggccggcgcacgcggcgacctcgaacgactgcaacgcgacttcgaccggcaacgctcccagcgcacccgcatctcccagcagatggacgaaacccgcgccatgctctgccgcgccaccggactcgcccccgccgaactgccgtacgtggccgaactcatggacgtgaacgaacacgaggaagactggcgtctcgccatgaacgtcgcctacgcgcccatcgcccagaccatcctcgtcgacaagcgccacgaacagggcttcgccgccaaagtcagcaccatcgacccgcgcaccatgccccgacgcacctggcagttcgtggacaccgcacgccactacgacgacaccggcgcgcacgcgaacatactcaccggagaacaggacggcgactggttgtccggcaaactgcgctaccgcgacgactcgcccttcgccgactggctgcgctcgcagacccaggacgaacgattcgacgccctatgcgtcaccgccatcgacgacaccgaccgcaccaaccgtcaggtgcaggccgacggtcagatcaaatccggcgcacgcggccagcacggcaccaaagaccgcgcccaggtcatcggattcgtcaacgaaacctacctcaacgcgctcgcagcgcaggtcgacgccgcccgcaacgcgctcagccaagccgacaccgactacacggccgccaaaacacagtccgataacctccaccgcgaactcgaactggccaaccagctcgcctacacgtcatgggaacgcatcgacatcgccggcgcgcaacggaccatcacggacacgcaggacgccatcgcatccatcaaaaacgatcccaaactcgccgaactcgccaaacagcgcgacgaactgaacgccgaactcgaccgtgtggaacgccagcgcatcgaatccgaccaggccgcggcccgcgccggcagcgccgtcgaagcggcgctcatctggctgcgcgaccatgccgacaccggcacgacggacgccgccggtgccaccgccgacaatgacgatgacgccgcgtccggcccgctgccggacgaagtcacggcggcgctcgccgaatcctacgacaaccgattcgccggactggcggacgccgccatgcgcgcgcacatgatcatcggcgcgggcgcggcaggaacgcaggcgccgggggagagcttccccgaacgcaccatcgccggcatcggcaaggacatggcctcccgcatcaacctgctgaacggccaggccgatgccgcacgcaccggcgtcgaatcgaaaatgagcacctacatcgcgctctacgcggccgacgatgattcgctgaccgccagcgtggaggactaccggtactatctcgacgaactcgccagcctcacccagctggccgcggttgccgccaccgacgccgaataccggcgctgcctcgaacagctgctcaggagcttcctgaccatcaaacgcgccatcgacacggatgccagcgacatccacgaccagcttgaccgcatcaacgccatgctcaaaggccagcagttcggtcccaagcacggcagcctgtccctgcacgcggacgtgcgccgtcccgagcgcaccttctgggcgcagttcatccgcgtcatcggcaccctgaacgattggaaatccgccgacgtcaacgattccgacgcctcgcgcaaggctttcgcggcctgcgcgccgatggtcgggctgctgcgcgccgaactcgcgcaggtcaaggacgcgaacggcgtgaaaagctacggcgcccgcaacctcgacccgcgttgccgctcgtccttctacgccatcgtgcatcatgccgacggcccggatgaacgcatcacctccaccggcggccgttcgggcggcgccttgcaggagctcacctcattcgtatacggcgcggcgctcatctacctgctcggcggcggcctgaccagcgagccctcgtacaccacgctgttcctcgacgaggcgctcatcaaggccgacggccgttacacgcagcgcgccctcacggtgctgccgcgcctcggattccaggtcatcgtctccgccccggaaagcaagaccggcgaaatcctcgaggtctccaccaaggcctacgtgacctacaaggaccccgacaccggcctcacctccctgcgcgaggccgtgctgcatcagaatgacatggacgatgaatcatcgtcggatatattgaaggatgacggggttgccgaatgagcagtcctggcgtcgccggtattaagacgattcggttcgactcgacgatgttcgaaagcaggtgatgggaactgtggccggcatgaaagacatcgctgcgatcaccacatgcgtgaagaaacatatgcgttcacatatgtacgacatcgaaccggcatggccatttcccgtgccggtgggattgccggaccaagcatttttggaaaccaatgcgattgcggtgcatgacaacaacaatgagatacggcaatgggcaagcaagaatggttgcgaaatcataaccaagcatcgcaccataggcacctctgtcgagctgatctccaaagtcgtcgttcctgacgaatcaatagccatgcgtgtggttggtcgtacgctggcggcggaatgtcgcgaagcgcgccgccgcatagcatgtctggttgctgcttgtgacgttgctccggaaacaatcgaatcggccgctcgcatgacaggccatgaacagcctgacgacttcgatctgcttgtcagcgcagttcgatatttcaggcatcatgacgtgaccggtatgacgccgcgacagattccattgacaggattcagcggcaaatggctgaatgagtcaaaaaccaatcgtcgtaaggccatttgccgactgctcggtgtcgaaacgttgggtctgtcaaaacggccgaccgaactgcggttccgttatctcgatccggtccgcgacgatgctgagctcgaacgcatcatatggtgtccgtgggaaggcgaagcgttatccggcattaaatatgctgtcatcgttgagaacaaagacacgtatcagactatgccgccgattgcgcagggcatctgcatatggggttctggtcgcgctgtaagcgatgctgtacctgcggttcctgcactgcgtgacatgcgtatcgtgtattggggtgatatggatgcggatggactggaaatactttcgacattacgtgaatcaggtatcgaatgcgactccatcctgatggattgcgatgcatacgatcggtaccacagatttggtaccgatcgtactgaacgcagcgcgaagattgctatgcgggagcctaagccgacgcccggccttcaatcggcggagcgacgtctttatgaacgactgtgtgctgacaaaacaatcgcttatcggcgtatcgaacaggaacgcattcccatgcgtgatgcagttgacgaattacgcaagcttggcatccccgtggagtccattgaaaatcaggatttgccgatttaggctgagtgattggggatgttgccaagagctagaacggcttagctttttctcgtctcacattatgccttccgattaataatgcaacggcattgcatagctgcaaggtccggcactgctatccgatactatcgaactgttgttttgcgttgcgcgagaagggacaaacatggcaaccgcttggggtgacgagagtgtgcggaaaaccggagttccctcgcctatgtacttgatgggcgcatgcgtatgtgatgatacggaaaccgaaacaaggcaaagattggcgttgcttaagcccaaaggagcaaggaaattgcactggcgagacatgcggccatcattgcgtggcaaagtcgttgatgccatggctgcaatggacattgatcatgtcattgtggctgcggtaccaatgagccagtggaataccgccgaacgcgctcgccgtaaatgtttggaacgtcttctgcctctgctggaaacagaatacaacgtggacacgcttgtgcttgaacggcgcgagatttcataggacaggaacgatatccgtttcatcgatggattgagaagccgcagatttatcgggccaattcgtgtcgaactctgtgcaggggagactgatgcaaggctatggctccctgatcagctgctaggagcgtacggtgatgcccaggccggtactggaagatacgatgaattcctcggccatgttcgaacagtgttcatcgacagtgattgatgtcctaaaaccgtgtatacttcatggtaagccaaccccgctggggaaatggaagtgagagccggacgccccgagtatcttgggggccggctcttgcgtttcggtccactgatggtccggaattttgcatactatggttcggttttccggcctgacacgccatcgaacaagcgttcgaatttggtcgtgtgttcgggtatccttgggacagatttggcgcgcgcatgaccgtgcgcgcgggaacggtgagatggaaggtggggcgtggctgtggcggcaacgcggactggcgcaaggcgcgcaacaagcgcaacgggcgcgaaaaccggcaagggcaagaacggtgaggtcatcgtcgaaaaggtgatgaccagcgactccttcctgagccgggagatcaaaaaggcgccgctgatcgaacacgatggttcgctggtagctgatatctcgcacatcccgaacgatctcaagatcacgattcagggtgcgcgcgaacacaacctcaagaatgtcgacctggcgattccgcgcaatcgcatggtcgtgttcacaggcctgtccggttcgggcaaatcctcgctcgcgtttgacaccctgttcgccgaaggccagcgacgctacgtcgaatccctatccgcctacgcccgccagttcctgggtcagatggacaagcccgacgttgacttcatcgagggcctgagcccggccgtctccatcgaccagaagaccaccaaccgcaacccgcgttctaccgtcggcaccatcaccgaaatctacgattacctgcgactgctcttcgcccgcaccggcatccctcactgccctgaatgcggcgagcccgtcgcctcccagaccccgcagcagatcgtcgacacgctgctcggctacccggagcgcactcgattccagattctctcgcccgtggtcaagggccgcaagggcgagttcgtggacatgatcgagctgctgcgctccgacggctacgcccgcgcgctcatcgacggcgagatgacacagctgtccgacgacatcaaactcaccaagcagaagaagcacaccatcgaggtcgtggtcgaccgactcgtggtcaaggacggtatccgccaacgtttgactgattcggtggaaaccgccctcaagctcgccaacggcagcatcgtcatcgacttcgtggacgaggaggaaggcagcccggcccgccgccagccgttctccgaacaccgcagctgcccgaacgggcacacgctcgaactcgatgaggtcgagccgcgcaccttctccttcaacgccccctacggtgcctgccccgcctgcaccggtctcggcttcaaactggaaatcgacccggacctcatcatctccgacccggacaagtcactggccgacggcgtcatcgaaccgtggagcggcaccaagatgacctcccagtactacggccacatcctcgaaggcttggccaaggaaatgggcttctccatgaagaccccttggaaggacctgccggacgatgtcaagcacgacatcctctacggccacgacttcaaggtcaacgtctcctaccgcaatcgctggggacgcctgcgtgaatactccaccggcttcgaaggcgtgatccgcacgctcatgcgacgccacgacgaaaccgattcgcagtccatgcgcgaatactacgagtcgtacatgcgcgaagtgccctgccaggtctgccacggacgtcgtctgaagcccgaagtgctcgctgtcaccgtggacggcaaatccatcttcgacgtgtgcgacatgcccgtcgtacgcgaactcgcctggatcaacggcctgaaactcgaaggctcggcacagctgatcgccggcgaagtgctcaaggagatcaaggcccgactcggcttcctgaacgacgtcggcctcgactacctgaccctctcgcgcgcggccgccaccctgtccggcggagaagcgcagcgcatccgactcgccacgcagatcggctccggcctggtcggcgtcatgtacgtgctcgacgagccgtccatcggcctgcaccagcgtgacaacgaacgcctcatcgaaactctgcaccacctgcgcgatctcggcaacacgctgatcgtcgtcgaacacgacgaggacacgatacgccgcgccgactgggtggtcgacatcggccccggcgccggcgaacacggcggcgaagtcatctactccggccccgccaagcacctcatcgaagccaagcgctccatcaccggcgactacatcgcccaccggcgagagatcgccgtgcccgccaagcgccgcaagatccacaagacccaggtgctcaaagtcgtgggtgcccgcgagaacaacctcaagaacatcgacgtgagcttcccgctcggcgtgctcaccgtggtcaccggcgtctccggctccggcaaatcctcgctggtcaacacgatcctctacccggtgctcgccgacaagctcaacggtgcacgcatcgtacccggccgccacacgcgcgtggaaggcgtggaccaggtgcgcaaggtgatccacgtcgaccagaacccgatcggccgcacgccgcgatccaaccccgccacctacaccggtgtgtgggacaagatccgcaccctgttcgccaagactcccgaagcccaggtgcgcggctacggccccggccgcttcagtttcaacgtcaaaggcggccgatgtgaggcctgccacggtgacggcacgctgaagatcgaaatgaacttcctgcccgacgtctacgtggactgcgaggtctgccacggcaaacgatacaaccgcgagaccctcgaagtcacgtacaacggcaagaccgtggccgacatcctcaacatgcccatcgaggaggccgccgacttcttcaaggcgtacaccggcatctcccgatacctgaagaccctcgtggacgtcggcctcggctacatccgactcggccagcccgcacccaccctgtccggcggtgaatcgcagcgcgtcaagcttgccaccgagctgcagcgccgatccgacggcaaaaccgtgtacatcctcgacgagccgaccaccggcctgcacttcgaagacgtgaacaagctgctcaaggtgctgcagtccctggtggacaagggcaatacggtcatcgtcatcgaacataatctggatgtgatcaaggaggccgactggctgatcgatctcggtccggagggcggcgacggaggcggcaccatcgtcacgcagggcacgcccgaacaggttgccgaatgcgaagcctcatggaccggcaagttcctgaaacccatgctttagccttccattgcagctgacctcgggtgggttggggtgtttgttgctggacatgctccgggccgctcaggtcaagtctttacggtccagcaacacacaccccaacccacccaatccctgatgattggttttgcttaatagcgaggaggattatgacgaacgatattgagcggcatagtccggatgagtggcggaagactgcggcggcgttaatgtcggaaagcatagctgtgggtgccggggaaacgacggcgaaggtgaatgcgaatggggcacctttgctgggggattctcgcgacctgttccgacccaagacctcggatattcccgccaaacccggtgtgtacaaatggcgcgacggggaagggcgcgtcatttatgtgggcaaggcaaagaacctgcgcaacaggctcaccaattatttccagccgctgtatctgctgcatccgcgcacgcagaccatggtgctgaccgcacgcagcctggagtggacggtcgtcgccaccgaactggaatcactgacgttggaatacacgtggatcaaggaattcgacccacggttcaacgtgcagttccgcgacgacaagacctatccgtatctcgcggtcagcacgggggagcgaattccgcgcgtgtgggtcacgcggtcgcgcaaacggcgggatacccggtatttcggcccctatgccaaagtgtgggaattgcggcacagtcttgaccggttgctgcgcacgttcccggtacgcacctgcaccaccaacgtgttccataaggcgcaactgaccggacggccatgcctgttcgcttccatcggcaaatgctccgcaccctgcgtgaaccgcattgaagcggacgaacaccggaggctgtgcgaacagctggtcggcgtgatgaccggacgactcggacggccatacatcgcccagttgacccgcgacatgaaagaggccagcgccgaactcgaattcgagaaagccgcccgactgcgcgaccagatccaaatgctggaaaccgtggtgcaacagaacgccgtcgtcttcgaccaggatgtggacgcggacgtgttcggcttcgccagcgacgagctcgaagcctccgtgcacgctttttatgtgcgcgccggctcgattcgcggcgaacgcaactggagcgtcgaacgagttgaggacatcgatgacgccgacttgatggccgaccttctggtgcaggtgtattcggacgccgccggggacaatcacccccagtcggccgcgaccatctccactaatcgcgaggccatcggctccacgcaaaccatcacggccacggacgctgtggcacgcgcccaggccacccgagaacgcaacacccgtcaggagaccaccgggcgcgcggacctgctggcacccatcgcaccggtaccgcgcgaaatcatcgtgcccgtcgaaccggcccgccgtgaggaactcgaaggctggctgaccaatctgcgcgggggagcggtgaccatccgtgtggcctcgcgaggcgacaagaagcagcttatggaccgcgccaacgagaacgccagccaagcactgcaacgcagcaagatgagccgcatctccgacatgggcgcacgcacccaggccatgaacgatgtggccaaggcattgggactcgcggaagccccgctgcgcatcgaatgctacgacatttcgaacactgtgggcggtgccttccaggtggcctccatggtggtgttcgaagacgcgatcgccaagaaatccgaataccgacgcttcgccatccgaggcaaggacggcaaaggcgcggtggatgatctgtccgcgctttacgagacgctcacccgccgcttcaagcacggcaacatcgccggcgactccggcgaaagcatcgacgcggaacagcgtgtggcctcggccgccggcaagatgaccactgccgtggcggcggagacaatcgctgcgaacggtaacgacaatggtgagggcggttccgacatcagtggcaaggggcacgcggtgccggtcggagtgcagaacgatgcgcgggagtccccgcccgacatcgtccagcagaacacaaaccggcatcactttgcctacaagccgaacctggtggtggtcgatggcggcaagccgcaggtcatggccgccgccaaggcgcttgaggactgtggcgtgaacgacgtggccgtctgcggactggccaaacgcttggaagaggtgtgggtgccggacgacgactatccgatcatcctcaaacgccagtccgaaggcatgtatctgctgcagcgtgtacgcgacgaatcccaccgcttcgccatcacctaccaccgccagcagcggcgcaaaggcgccctgcgcagcgcgctcgacgagattcccggcatcggcgaaagctaccagaagcggctgctcaaccacttcggctcggtcaaagccatgcgcgaagccagtgtcgaggacttcgagaaggtcaaaggcatcggccacgccaaagccgaagcgctgtacaacgcgctgcacgagcagtgagccggcccggtccagcagcccagagtaaattttcggttgcggggcctgtggttgacatattcgaagcaaagtgtcggctagcatgggaacagacatcaaggaggggatatggccaatcatcgttgcgctgtactcggcaaacccgtcgcacactcattgtcacccgtgcttcacaacgcggcctaccgttcgctgaaactcgacgattggctgtacgacaagcacgaggtgggggaagacgacctcgacgctttcctcaaaggccttgactcgacgtgggctggcctgagcctgaccatgccgttgaagaagaccatccaaccgtacggtgttccggaaaatttgtgggccaaggaactgaaggtggcgaataccgcggtattcgactggagcgtggctgccgatgatcccgcttggccgaacggcaagccgggcatcaagctatacaacaccgatgtcatcggcatccaactcgccttcgaccatgccaatcgcgaactcggcgaacaccacaccgcgtcgagaagcggcaccgcgctgatcatcggcaatggcaacaccgccacttcggcgttggccgcatgctgcatgatgcccgaaatcggccatatcgtcgtcgccgcccgccaccccggaaaaaacaccgggcttaaaccagtggccgaaaagttcgtcaacgtgcataacccgtacaacgaaatcgaattaggcgacgatcaggccctgcttgaggcagcccgcaacgccacctatgtcatcaacacgattcccggacacgcggccgacaacgtcgcggatgccctcgccgatgccggaaccgagccattctccggactgctgttggacgtgatctacgatccacgccccaccaagctcatggaagcctggcgcgctcatggcggtcacgccatcggcggcgaagaaatgctgctgtaccaagctctcgtacaggtattgctgatgaccggtatctgggatgacgacccgcccagcgatgccgaccagcgtctgcaggacaccaccaccgaagacgaccagctggagatcgcgatgcgcaaagctcttgaggaggcgctgtaatgaatcaacagacaacgaaccgcgataccggcgaggcggccgccacgaatgcgccggcgaattccgcgacatccacatcgactccggacaaccagccgaccccgcttgatgccttcgaagtgctgctcatcaccggtatgtccggcgcaggccgctctcatgccgctgactgcgtggaagacatgggatggtatgtggtcgacaacctgcctcccaaactgcttatcccgcttgtcgacatgatgaccacctccggttccggatcggagtcaggcgtccacaagcttgccgccgtcatcgacgtgcgctccagctatttcgacgagctggccgccgtgctcggccatctggatgatctcggcgtcaaaacccgtattctgttcctcgacgccagcaacgaagtgctcatcaagcgctatgaatccgtgcgccgcccgcacccgctgcagcacggcaaccgactgatcgacggcatccttgaggaacgtcacctgctggaagacctcaaggaacgagccgactgggtcatcgacaccagctccctgagcatccaccagctgtccaccaaactctacgaggcgatgctcggctccggccccaccaccgtggcagtacacatcttcagcttcggcttcaaatacggtatgcccatcgacgccgatttcgtggccgacgtgcgttttctgcccaacccgttctgggtgcccagcctgcgcgagcttaccgggcacgacaagccggtcgccgactacgtgctttccagcaagggagccaaggaatttctcgacgcttatgagaaagctatcgagattgcgttggaaggatacgcccaggaagacaagcactacgtaaccatcgccgtcggctgcaccggtggtcagcaccggtcggtggcgatgagcgaagagctggctcgccgcttacgcgcacatgggctcaacgtaaccgtttccgcgagagaacagcacaagcgtcactcatcgtaagcaggcgtcgagcggtcatcgggcaagtgttcggtgaccacactgcgagaaagcagggcccataatacgtatcaaacgggttcgcttgtccaccagattaggtatcacagaaagccgatggcttccgaccgtgtgacagcagatgacggcacgaagcgcctgaagcattgagaagaacgggactgtaggaggtagatcttggctcttctggacgatgtcaaaagcgagttggcagcctttgaaggcgattcgccagccgcgatcaaggcccaagctgcggccatgatccgttttggcggcggtcttcgaccggtacagaatacatacgttatccaagccgtattcacctcgcttgacgttgcagaatggctgaagaacacgttgaggaacacgttcgggcacgaagccgaggtcaatcacctcacacgtcagaccccgaacggccctgtcgagacctacgtggtgctcgtcacccgcaacgtagtggccttggctttgcagaccggactggtcgaccgccgcaagcagcaggtccgtggactgccgtctgaagtggtcaacggatccatcgcccaaatcaaagcggcatggcgcggcgccttcatggcccgtggcttcctgtccgatcccggtaaggccagcttcctggaaatcgcttgccccacggaagaggccgccatggccctgtgtggcgtggcccgtcgtctaggcatccaggccaagcatcgcacgctgcgtagctccgagcgcgtgacactcaaggatcccgacgccatcgaacgcatgctcaagctcatgggcgccacccgttcggctcgcgaatggaccggcaagcgttccgatggcgaggcccgcggcaaggccaaccgtctggccaacttcgatgacgccaatatgcgccgttccgccaaggccgccgccgaagccagcgaaaaagtgcagcatgctttcgaagtactcggcgataacattccggacaacctccgtcaggccggccagctgcgcatcgatcacgtggacaagagcctcgaggagctcggcaagatcgccgaaccgcaaatcaccaaggatgcgattgccggccgaattcgccgactgcttcaacttgccgagaagacggagaaggctcgcgcagccgaaggcaagtaacccgacaatccgatttgccatgcctattcggcaaaacgcgacaacgatgtgacaaaacaccgcattcagtcagtagacgaatgcggtgttttgttccggaatgcctgtaatatgcaaagtggcaaaattggccactttgacgtgcgattcgtcaaggaaaggatattcatgaagacactcaaggaccttggagatctcaagggcaagcgcgttctggttcgcgctgatttcaatgttccgctggacggcaccaccatcaccgatgacggtcgaatcaaggctgctctgccgaccatcaagaccctgcgcgaagaaggcgccaaggtcatcctcatggcccaccttggccgcccgaagggcaaggtcgttcctgagctgagcctggccccggttgccgcccgcctcggcgagctgctcggcgccaacgtgccgctggccaaggacacctacggcgaggacgctcaggccaaggtcgccgccatgaacgatggcgacgttgtgctgcttgagaacgttcgtttcaacccggaggagacctctaaggacgccgacgaacgcgccgcttacgccaagaagatcgccgccctcggcgaggccttcgtttccgatggcttcggcgtggtccaccgcgctcagggctccaactacgacgttgccgccgatctgccggccgccgcaggcctgctggtcgagaaggaagtcaaggccttgtccaaggccaccgagaacccggagcgtccgttcaccgtggtgcttggcggttccaaggtctccgacaagctcggcgtcatcgagaacctgctcgacaaggccaactgtctggtcatcggcggtggcatggtgttcaccttcctcaaggccaagggctacgaggtcggcacctccctgcttgaagaggaccagcttgagaaggtcaagggctacatcgagaccgccgagaagaacggcgttgagctcgtgctgccgaccgacgtcgtcgtgaacgccggcttcccggccggtgacaccccggttgctccggaagtcgttgccgccgacgccatcccggccgacaagatgggtctggacatcggcccggagtcccagaagctcttccacgacaagatcgtcgactccaagaccgtcgtgtggaacggcccgatgggcgtgttcgaggttcctgagttcgccgccggcaccaaggccgtggcccagggtctggtcgacgccaccgcagccggtgcgttcaccatcgtcggtggcggcgactccgcctccgccgtgcgcaacctcggcttcccggaggacggcttctcccacatctccaccggtggtggcgcttccctcgagttcctcgaaggcaaggagctccctggcctgaaggtgcttgagtaatccattttctagctcccctccttgaggggagctacgtttttttttagaagggaaacatatggcgtccaaacgcattccgttggtggccggcaactggaagatgaatttcgaccatcttgaagccacttacttcgtgcagaagctggtatggctgttgcgtgacgctcacttcgactttaaacgctgcgaagtcgcgcttttcccctcgttcacgtcattgcgcagcgtgcaggtgctggtcgaagccgacaagctccatgtcgcctacggcgcacaatccgtttccgtgaccacccaaggtgccttcaccggcgatgtgtccgcggacatgatcgcccatcttggctgctcatacgtcatcgtcggccactccgaacgccgcaaataccatcctgaagatgacgccaatatcgtcgatcaggtacgtgccgtgctcgccgccggcatgcagccgattttgtgcgtcggcgaaagcttcgaggaacgacgtcaaggcattgaactcgatttcgccgtgggccaggtacgagacgtcacccgcgatctcaacgaagaacaagccgccaaactcatcgtggcctacgaacctgtctgggccattggcaccggcatggtggccactccgcaatccgcccaggatgccgcaaacgccatccgcaacgatttgaagaccacttttggcacgaaggtatccgatagcgtacgtatcctgtacggcggatcggtcacctcgaaaaatgcggcggaactcatttcccagcccgacgttgacggcttcctgatcggaggggcggccctggacgttgaggaactcgccaaaatcgctcgactggcactgaaatccacgaaatcacggaactaataccacggttttcccgtgtgtgcgctatgctggtcaacagtccaatcaatccggaggtaccctgtgaccgctcttaagatcacgctgcaagtcatcgtcgtgctgctcagcttcgtgctgaccctgctcatccttatgcacaagggcaagggcggcggtttgtccgacatgttcggcggcggtctgacccagaacgccggtacttccggtgtcgccgaaaagaacctgaaccgttggaccgttatcatcgctctggtgtgggtggccttgatcatcggcctcgacatgatgaccaagttcaacctcggctgatcggcttgcacgccatatagacttgtcgctcgcgacccatgaccgttaccgtcggtcatgggtcgtatgcgttctatcgagtattacgaaaggacatcaccatggtcactatgaaccgcaacaaagtcgttatcgtcggcaccggccgggtcggtgccaccgccgccttcggcatcgtcacgcacggcctgtgcaatgagcttgtgctcatcgactgttccgccgccaaggccctgggggaggcccgcgacctcgatgatggcagcgaattccaggaccgccacgtcaaggtgcgcgccggcgactacgccgactgcaaggatgcggacatcgtcgtcatcaccgtgggccgcaagccgccggccaactccaaccgcatggccgaactcggcttcaccgtgggtcttgtgggcgaagtggtcgacaacgtcatggcctccggttttgacggcgtgatcgtcatggtctccaacccggtcgacgtgatggcttggtatgcctggaaacgttccggtctgcctcgcacccaggtgctcggtaccggcaccgcgctcgacacctcgcgtctcaagaccatcatcggcgaagagaccggccttgacccgcgcaacgtgggcggcttcgtgatgggcgagcacggcgactcccagttcaccgcatggtccaccgtctcgctcggcggcaagccattcgcccgcttcctggccgacaaccaagaccgtttcgcctccgtgtccaccaccgaaatcgaagagaagacccgcacccgtggcaatgagatcgtcgcggccaagggcggcaccaacttcggcatcgcctccaccgtggccggcatcgtacagaccatcctgtgggacgaacgccgcatcgtgcccgtctccaccctgctggacggcgaatacggcgaacatgacgtgttcctcggcgtccccactgaactgcgcgccaatggtgccaacgagatcgtcgaactcgatctgagcgaggacgagcgggccaaactgcaccattccgccgaactcgtgcgtgaacactgtgaggggctgctgtgattctcgacgccatcacgccgaaacaaccccgactgctggtcgccgacctcgacggcacgttgctgcacgacgccgaggtattcgagggccggttcattacccagcgcagcatcgacaccatcaaccgcgcgcacgatgccggaatgcaattcgccatcgccaccgcgcggccggtgagtaccggtctccagttcgccgaaaaactgccggtggacgccgtaatctatctgaacggcgccctcatcgatttcgacccggcccactccgacttcgacctgctcacctcaggtgccacgccggccgatgagaaccatttgatcaagattggcttctcctcacggcgtgcctgcgaagtctgtctgtccctgctcgatcgcatgcccggcctgaagctcggcatcgtgatgaacgacgtgcgctacaccaacttcgatgtgcgcgtgtattggaaaactcaggccttccaatacacgaacttccacgacgtgcccgaaggcgtggcggacaaaatcaccatcttccccgaacctgaacagtggaacgagctgcgtgcgctgattccgccggacttcgacatctccatcagcgaaggcgtgatgtggatgctcatgaacccgcaggccaacaaggagcacgcgctgcacctgctgtgcgagcgactggacgtgccgcttgaacagacagccgccttcggcgacgacctcatcgatatcaacatgatgagcgaatccggccggggcgtggccgtggccaacgcgaaccccaaggtgttgtccgtcgccgacgagatctgcccgtccaacaacgaggacggcgtcgcccaatggattgaagcgcagttgggttgaaccggtcgagactcgagaacacgccaaaattgaacttgtgttgaaccgggggtatgctttgaaccgttgttcaaagaaagaaattgaactcccggttggaggcataaggatatgagcgtatcggtgtttgcggaacgtctgcgcaatgcgatgaacagcaggggactgaagcaggtcgatctggtgcacgccgccgaacatcgtggcgtaaagatgggcaagagccacatcagccaatacgtggccggcaagaccatgccccgcgaggacgtgctcgaattcctggccagcgaactggatgtcgacacgaactggctgcgcggcgaggaatccaccacgcaattgaactcggacgcctccaacagtgtcacggacggcgaacacgccgccacaccgcttgccacgggtaccgccaagccccagacggacagcgagattcccgtgggccgccgccgcaccttcggcaaatcgcacaagctcgacaacgtgctctacgacgtgcgcggcccggtcgccgacgaggcgatgcgcatggaggccaacggcacccacatcctgaaattgaacatcggcaacccggcacccttcggcttccgcacgccggacgaagtcgtctacgacatggcccaccagctcaccgacaccgaaggctactcgccgtccaagggcctgttctccgcgcgcaaggccatcatgcagtacgcgcagctgaagaacatcccgaacgtcaccatcgacgacatctacaccggcaacggcgtcagcgagctcatcaacctgtccatgtccgcgctgctcgacaccggcgacgaagtgctcgtgccctccccggactacccgctgtggaccgcctgcgtgaacctggccggcggcaccgccgtgcactacctgtgcgacgaacagtccgaatggtatccggacatcgacgacatccgctccaagatcaccagcaacaccaaggcgattgtcatcatcaacccgaacaaccccaccggcgcactttacccaaaggaagtgctccagcagatcgtcgacatcgcgcgcgaacaccagctcatcatcttctccgacgaaatctacgatcgcctcgtcatggacggcctgcagcacatctccatcgcctcgatggccccggacctgttctgcgtgaccttctccggcctgtcgaaatcgcacatgatcgccggctaccgcatcggctggatgatcctgtccggcaacaagcgcattgccaaggactacatcgagggcctcaacatgctcgccaacatgcgcatgtgttcgaacgtgcccgcccagtccgtggtgcagaccgcgcttggcggccaccagagcgtcaacgactacatcgtgccgggcggccgcgtgcacgaccagcgcgacctcgtctacgacatgctcaaccagattcccggcatcaccgccgtcaagccgaaggccgcgttctacatcttcccgaagatcgacgtcaaacgcttcaacatccactcggacgagcagttcgcgctcgacctgctgcatgacaagcacatcctcatcagccacggcggcgcgttcaactggcatcgccccgaccacttccgcgtggtgtacctgccgcgcatgggcatgctgcgcgaaaccatgggggagatctccgacttcttcagctactactggcagagctgatccttggcgcaaacgaacacgctcgattgtttcgtgatatgaaggagatcttatgccggtggtgtcgcgtcgtgcgcaggaagcgctgtatcccagcgatcgcgcgaactgcggcatggtggtccgcgctatgccaaggtgaaggcgatgacgaaggccgtggcggacagtgcggttgccaggagcagatagcacacggcggctgaatttcgagagccatcggcattggcagcgttaccgccgttatttgcgttgcgtgcagccaacgtgatggccgtaatcgccgaaagcagggagaacaatggcagcacgcacaacacgacggtcagcagtcccaaagcttcatggccgatgcaataagcgacaagacctgcattgtcagttgccgatagcgctgggcagaaatcggtgtgtctaccagtgttgtagctgtaggtaaagaacgtgatacctgaccagaacagggcaacgggaacagagcaattgcgtatggcggatgcgttgatgctgatggtgtggaacaggtcgtgcaaggaggtagcccgtataccactgcgttctggcgtgattcgattactgttgttttgcgagtcgatggtaagagaggcgcattgcaccagcgcatatgccgcaagtccaagtccgcaagcgatggttgcgccgccgctgaagttgacctcgtcggatactgaatattcggtgacgaataccggcatcacgccaatctgccatacgaacaacagtcgcgcgattcgtatccaaccgttgctcagatatgaggtggctatggcgtgcaccagccacgtcaccgcatacatcgcccacaacgttacaatcttggtattcgcactcaacaccaatatgatcgcaacagccactgccgcaataagaacactaaacaccgaacagagccgatggcgcgaaaagccctgtactcccgcaacagtcagacagagaatcgcgacaacactcagcgcagtcaccgtcataaaccacagtggtgaggtgacgcaggctccataatcgtcagttgcttggcccgagagatagtaggtcattctgccaatcgccggacaattcggatgcaacatcatgccgccccaaatgcgctcatataatggcgcgaacgatacaccggcaccactgagcgtcgcaacaaccgccatcaccatggccggaatcagcccaagctcgcgattccggccggtttccgctatctgtctatcactggtgtccatgactcaccccaccttatgctgttatcgccgtcgtcgatgatgctagtataactatggcagatgggcggagaccagcggcatacaggaattctgtatgccgctttataggagggatactgcggcagccgccatcaccgaccgaccgccagactccggcacagaccgggaagaactaccgtcgcggagcatcggcgataccaatggcaacaccgaggatagccgggaccacccagccgagctggtattgctgcaaaggcagcatagccagcgccgcgtccagccagccgatggaaccgccgaagacggcgaccaaactggagatgcaggtggtgaaggatgcgatgcccaccagcagcacggtccagaagtagacgcgcgggaatcgcgcgccgagcgacttgtgggtcagcgtcagcagtaccagcacgatggcgatcggatacagtgcggacaacaccggcacggaaaccttgatgatcgcgcttagcccggcattggacacgatgaaactgaacacggtgaagatgacctgccaggtgcggtagctcaacgttcggccggcgacggtccggaaccgagtatggaagtaggtggcgcaggtgccgatcagtccggtgcatacgttgaggcaggcgatgacgaacacgatgccaaggaacgcggtaccgaacgtgccgaacagggatgaggtgaggttggtgagcacggtcgcgcccgtgtctttggtggggtcgatggtgacgatggctccggacaccacgcccacgtagcttagcgcgccgtaaatcacgatcagcagtacgccggtgccgagcccggcatacgcggtctccttctgcacttgcgattcgtcatcgacttgttgggcgcggatattcgcggagatcacgatgccgaagtagagcgcggcgagcaggtccatggtctggtagccgtcgaggaagccgcgtgcgatctggtttgtggagtagtcgcccatcgggttggccggggtgccgatgccgtggatcaggcaggcgatgaacaggacagcaatgagcaccagcagcaacggtcccatgaatcggccgagcactttggagagtttctcgggatgctgggcaaacaggaacgccagcgtgaagaacacgagcgagtagatgagttgggccagccagccataggaggacggtacgaaaggagccaccatcatttcgaatgaggtggtcgccgtacgcggaatcgcaaagcacgggccgatggtgagcatgatcgccacgccgaggaacaaggcgaatttgggggagacccggctggcgagtttgtcgaaaccgccggcgaaggtgaccgccagcacgccgagaatcggcaggccgactgcggagacgatgaaaccgatggccgccggtatggtcgcggaaccggcctgcgcgccgacgaacggcggaaaaatcagattgcccgctccgaagaacatcgaaaagaaggtgaaggtcatcaccaaccgctggcgtgcgacaagtttgttcattacgattcggcctttctctcatatgctcgtaccactgtagcaacaaacgaaagaagccccgaccgttggggtcggggcttctgtgagctaatcaactagtgcgctaaacacgcatcagtcgtcaaatctcaggcgttcacgcggtcgatgccggactggacgtcagacagcacggaatcccaggacttgatgaaggcagcgacaccgtcggcctccagcttgtcggtgacgtccttgaggttgatgccgagctcagccagcttgttgatgatggcgtgggactcttcgtaggtgccctcgatggacggagcgccgttgccgtggtcggccagagcgttcagggtcttctccggcatggtgttgacgatgtgcttggcaacgagctcgtcaacgtacttgcagtcggagtaggcggcgttcttggtgccggtggaagcccacagcggacgctgaaccttggcgcccttggcagccaggtcggcccaacgcggatcctcggcgaacttcttctcgaagagttcgtaagccaggcgagcgttggccacagcggccttgccctccagagccttggcctcgtcggagccgttggcttccagcagcttgtcgacagcggtgtccacgcgggacacgaagaaggaagcgacggagccgatgtgcttcaggtcgtggccgttggcggcagcctgagcgatgccctcgatgtaagcgtcgatgacctgctcgtagcgctcgagcgagaagatcagggtgacgttcacggagatacccttggccagggtggcggtgatggccggcaggccttcgagggttgccggaatcttgatcatggcgttcgggcggttgaccttctcccagagttccacagcctgcttggcggtgttctcggtgtcgtgggccagacgcgggtcgacctcgatggagacgcggccgtcgacgaagtcggtagcctcagcgatctcgcggaagatgtcggtggcgttgcgcacgtcggtggtggtgagctcgcggacagcggtctcaacgtcaaccttgccgagctccttgagctgagcgtcgtacgggccgacctggctcagggccttctggaagatggacgggttggtggtcacaccgacgacgttcttgttggcgatgaggtcctgcagggagccggactcgatgcgggagcgggacaggtcgtccagccagatggaaacgccgttgtcagacgtacgctgagttgcttcagtcatttatttttctccttatattccgtattggaacaaatctttaagtagaccccctctaacgagagggccgatcaggtggagtcttgagtacaagcctccctcgtcagagggaggctaggggactcacttggcggcttcgacttcggcgatggaggccttggcggcttccaccacgtgctcggcggtgatgccgaggtcgatcatgttctgagcgccgtcgccctgcaggccgaactgctcgatggagacgggcttgccgtaggagccgaggtacttgtaccacggcatggcaacgccggcctcgacggagacacgagccttgacagcggccggaagcacggcctccttgtactcggcgtcctgctcctcgaaccattccatggacggcacggacacgacgcgagccttgacgccctcgccggccagggtcttggcggcagccacagcccactggacctcggaaccggaagccatgaggatgacgtccggagtgccctcggtgtcgaccagaacgtaagcgcccttcttgacaccgtccttggccttggcggcggtctcggcaagaaccgggacaccctgacgggtcagaaccatggcaccaggcagggtgttcttcttctcgaagaagtaacggtaagcctcggcggtctcgaaggcgtcggccgggcgaatgacctcaagctgaggaatcgcgcggaaggaagcaaggtgctcaaccggctggtgggtcgggccatcctcgccgacggcgacggagtcgtgggaccagatgtacaggttcggaatctccatgagggcggccagacgaacggcggaacgctcgtagtcggagaacatgaagaaggtgccgccgaacggacgggtgtgggagcccagcaggatgccgttggtgatgcagcccatggtgaactcgcgcacgccgaagtgcagctggcgaccgaactcgttgcagttcggccactgcttggtggcgcactcggccggggcgaaggtggcagcgcccttgagatcggtcttgttggagccaccgaggtcggcggagccgccccagagttccggcatgacagcggcgatggcgttgagcacggagccggaggcgccacgagtggcgacacccttgccgacttcgaaggtggcctcaaggtcgtcaagagccttgtcgaagccttccggcagttcgccggccttcagacggtcgtacagggcagccttgtccgggttggccttgcgccaagcgtcgaacttctcgtcccattccttgtgggcttcgagaccgcgctcggcaaccttgcgagcgtgagccagagcctcttcgtcaacgtggaagttctcttccggatcgtagccgagggcttccttgaggccggcaacagcctcggtacccagcttggaaccgtgggaggacgggtcgttggtcttgcccggggtcggccaagcgatcagggagtgaaccttgatgagcttcggctggtccggagcggccttctcggccttggcgatgacgtcagccaagccctcgatgtcctccttgtaggagccgtcgggctggatgaagctgaactcgtcggtgtaccagccgtaggcctggaagcgcttgagcacgtcctcggccagcaccaggttggtgtcgccttcgatctggatgcggttggcgtcgaagatcacggtcaggttgccgagcttctggttggcggccagggaagcggcctcgccggagatgccctcctcgatgtcgccttcaccgcagatggcccagatcttgtggtagaacggggaatcttccttcggggtctccgggtcaagcagaccgcgctggaaacgctcgccgtaggcaaagccgatggcggaggcgaagccctggcccagagggccggtggtcatttcgatgcccggggtcaggccgtactccgggtggcccggggtgcgggtggcagcgccgccacggaagttcttaaggtcgtccagggtcacgccgtaaccggagaagtacagctggacgtactgggtgagggaggcgtggccaccggaaaggatgaagcgatcgcggccttcccagttgggatcattcggatcgtgcttgatgaagtgctggtacagcgtgtaggcgacgggcgccagggagatgggggagccggggtggccggagcctgccttctcaaccgcgtcagccgaaaggaccttcgccatcttgatggcgcgctcgtcgagctcggtctccttgaattcggtcatggattactttccttccaattggtcgggccgcgtatccggcttgtgccgggcgcttgacgccctcacattgcgattaccatgctagcgtcggtttgcgacgttgtggagcaattttggcgtgttttggtagtttgtgttctgttagcgttcacagtgaacattgctacgctgcaaacgaacgcattagcactcaagcctaaggagtgctaatacaatgttctaaggtgaagtgcgccacctgcacgtggcggagccaagaaagaggcaatatttctgggttcccgcgtgtcgcggcgtggcgaaccgaccgtcggggtacgccctgagtgaaccgtgactgatatgaatatgtatgcatatataaggaggcgcgcatgacgcaatcaagacgcatgctggtgctgcgcgccgtggtggaggattacatccgttctcaggagcccgtgggctccacttcgctgacgcgcgaccatgatctcggcgtcagttcggccaccatccgtaacgatatggccgctctggaggacgaaggctatctgattcagccgcacacttcggccggtcgcgtgcccaccgaaaagggctatcgatactttgtggaccgacttgctaccgtggtgccgctcagcgaggcgcaacgccgcggcatcaacagcttcctgtccggatcggtgagtctcaaggacgcgctgcaacgttcggcacgactgctgtccgaaatcaccggtcaagtggccgtagtcgcctcgccatcgctggccaaggccacattgcggcacgtggagatggtgcccgttgccatgaccacgttgctcgccgtggtgattaccgacacaggccgcgtggcccagcacggcctgaccatcgcatccatgcccgccgtggacgagatcaaccggctctccaacaccgtcaacgagcaatgcgacgggctgtccctatcgaaatccgcggagaccgtgcgatccatcgccgccagcgccggctacgagtcggtgcgtggcgtggccgacgcgctggccgacgccttcgaatcgatggcattggacgaacgcgcgaacgaactgtacatgtccggcacctcgcacctggcccactcccggtccctggccgatctggccccgctcttcgacgcgctggaagaacaggtcgtgctgatgaagctcatgagcaacctgagcgaggagacgaatgcatccggcgtgggcgtggccatcggctccgaaatgcacacccccggactactgcatgcttccgtggtcagcagtggctatgggcgcagcggagcggcgggcgaaccggcggggaacgatcccgtaggcgaacccgaaaccgaatccgagacggagagccagacgaacgacacggaacccatcgccttcgttggctccatagggccgacccacatggactacgcggccactatggccgccgtcagggccgtagccagatatttgaccgccttcctctccgagggccggactcaagactgaccgccgtctgtggcacaatgacccgcagaccaaacgaacacaaaggatcaatcaagtggcagattattacgagacgctgggtgtggaacgcggcgccagtgacgacgagatcaagaaggcataccgcaagctcagccgtaagtaccaccccgacatcgcgggccctgagttcgaggacaagttcaaggaagtgaacaacgcctacgatgtgctgtccaatccggacaaacgccgtatgtatgattcgggagtcgacccgaacaacccgaacgccggtgccggcggcttctccggggcgggcttcggcgatatgagcgacgtgttctccacgttcttcggttccgcgttcggcggtggctcacagggcccggtgccgcgtacccagcccggccgcgatgccttggcctcggcgtccatcgatttgaagacggcggtgttcggcggcaccgcgcatgtcaagatcaatacgttctccctgtgccaggagtgcggtggctccggtgcccagggcggcgcacagccggtcacctgccccgactgccacggacagggattcatgcagaaggtcgtgcgcaccatgctcggccagatgatgacctccgccccctgtgaacgttgcgagggccacggtaccatcatccagaacccgtgccccagctgcatgggccacggccgtgtgcgcaccacgcgtaccgtgggcgttaccgtgcccgccggcatcaacgacaacgcgcgtctgcggttggccaaccagggcgaagtgggtgagggcggcggcgctgccggcgacctgtacatcgacatccgcatcaaggcggataagcagttcacccgcgatggcgacgacctgcactgctggattcaggtgccgatgagctgggccgtgcttggccacgatctgtccattgatacgttcgatggtgagaagaccgtgtccatcccggccggctgccagactgaggacacggtgacgcttaagggactgggcgtcacgaacatccgcaacaaggacgagcgcggcaacctcatcgcccacgtcaatgtgcttatccccaccaagctcaacgaaaccgagcgtggcctcatcgaacagttcgccgcctcgcacgattcaggcgccacgcacgtctcccaggcatcccgtccacaggccggtcaaaagaaaggtttcttcagcaagttgaaggacgcactgagctgagagcggatgcgttcttggctccccctctgaggggagccaagtctgttacttcagcagggagcggcacatggagcggtattcgttgacgtagccgccgccgaagaagacgcagtggccggcgatggggtagagctgccagagcgtgatgcgctcctgccatccggccttcaatggatgtacggactggtagccctcggtgatttcgctcagatagctcataccgaacaggtgcagcatagccagatcctcctcgcgatgaccgccatgtgccgccgggtcgatgagcacggcctcggactgcccggaatcggcggtccacatcacattgccgctccacagatcaccgtggatgcgcgccggcttgtcggccgcggcgcggcccatcagatccggcagcgcttcaatcacacgctcagtcaactcgacatcgcgcttatccagctcgccacgtttcacaccaaggttgaccatcgggcgcagacgtccatcagcgaaatagctgatcgggtcggtccactcgccggtatccattttcaccgggtcctgcaatggtccgaaatagcatgtgccgttatatccgtcaggcgcagacccgaaatacttggcacccgcatcatgcatacgggccagagccgcgccaaaagctcgtgccgcctgaggcgtgggggacgcgctgcccacacgttcgatatccagataatccttgccccagccgtatacctgcaccacgcgcgggccgccttgcgcatgagccgctcccaaccattcgagtcctcgaccctcgcattcgaagaatccttccggtgcgaatgccctgcttttgcgatacgtggccataatgctcccttcgtcgcttacgtactatatccactttcattgtagaagccgcggatgttaccgattcttagtgttgttctacacccccttgggtagggtgttcatcgtcataacacatcaaatacttagaaatcacgaggggttatgaattttttccaagcgatcattctcggcatcgttcaggcgctgaccgagtatctcccggtatcctccagcgcgcatatccgtattttcggcgatttgatgctgggctctgatcccggtgcggcgtttaccgccatcatccaaatcggcaccgaacttgcggtgattctgtatttccgtcacgacatcatcaatatccttactcactggttcagctgcctgttcggcaagaacggcaaggattggaaggcccgcatgggccgcggcgacaattacgccacactcggctggaacattatcgtcggctcgattccgattattatcctcggcttcactctgcagaacgtcatcgaaacctcgttgcgcaacctgtggattacggtaaccgtgctgttggtattcggcattctgctgtggatggtggatgccaaggctcgccagaacaaaaccatgaatgatatgacgtatcgtgatgcattcctcttcggtttgggccagtccatggcgctgattcctggtgtgtcccgctccggcggcaccatcaccgtcggtcgcgcactgggctacacgcgtgaggccgctgtacgtctgagcttcctgatggccatccccgcggtgttcggctcaggtttgctcgaagccatcaaggccgtgaagaactacaaaaccgatgcgatgttccccggctgggggccgaccctcgtagccatggtcatcagcttcgtactcggctacatcgtgatcatcggattcctgaagttcgtatcgaacttctcctataaggccttcgccatctaccgcatcggtttggctgtggtcgtcgccttgctgctgattgtgggcgtgctgccggccatcgatccctccgtggtggctgcggcataagacgggtcgataggcgactcaatataatggtgctcccgccggcgggagctgtcagcgaagctgactgagggtggtcactggaatatgccagcagaaccaccctcagtctcgctacgcgagccagctcccgtcagcgggagtattgtgtgtatagggctaattgcccatctggcgtagaaacgcttccgcttctttgaccagttgttcagcctggggcgctcccaatgaagcctccgcctcggctttctgctgcaagtcgtagtcgtgctccaaatgctccacataatcatgaagctggtcattgcaacgaaccagtatcgatgcctgcgccttccactgctcggctttctgcttcaggtctgccgtatcgaaaatgaagccgatatacttgcccaacgcatccagcaatcgtatagtgccggcagagcattcgtcgctgcccaaatattgggggatggacacccacatcgaggaatgagcaaatccttgttgtgcggcagctacatccagaacagtaggaatgcccaccgggccgttatacgaccggtctccttcgcattgacagtctccgtcgctgacggcgatgggcaacggacgggtatgcgggcaatcggagaacatcgaacctaacgtaatgatccgattgacatccagctcatcggcaatggccagactctggctacagtattccttccaccgatagtttggttcgggggcgatctgcgcatagatacgcttgcctgcgtccaacgtgatgtcgtagaacgtggtctgtggccagataagattggtgcgacccgaaacatggcacagcataggacgggcaacctgatagtcatagaaatcatcacatctaatatgacgaatctcgcgggactcatatcgcttgaccagatggcgcaccgcgttcgtcgccgcctgacaggcatcattccatccctcgaatgcggcgatcaatactgcgccggtgtccttcgctgcttcactcatacctctagagtaactggaattcattgcccgaagcgcacgctttagccataagcgagagtatgcaattacaggcgacacgccgcagctggacgaactacacgcatgtgagtatagtaaacactcgtgcttcggtagggagacctcgccaaggaaacacacgcggacatagcttagttggtaaagcgcaaccttgccaaggttgagaccgcgggttcgagtcccgttgtccgctctaggtccgtgagttgacagaccttacggtgggttagccaagcggttaggcagcggcctgcaaagccgtatagacgagttcgactctcgtacccacctctcagaccagcgaagcaattcaatgggatgaaatatgacccgggcggttggcgcagtggtagcgcacttccctgacacggaaggggtcacaagttcgaatcttgtatcgcccacgaaagtcgaagcaattcgactggatataactgaagaaccgagtattcgggcgattggcgcagcggctagcgcacttcgttcacaccgaaggggtcgtaggttcgattcctacatcgcccactggattccgcttctcacggcggattcctttgcggacatagcttagttggtaaagcgcaaccttgccaaggttgagaccgcgggttcgagtcccgttgtccgctccacaacgaaacctcgcttcggcgaggtttttttcgtattggttcagatgctggtggtatttgtcgcacgcccaacctatcgtgtcctacgttgattaaccagtccaggcctgcacattagtaccgtgggccccgatagcaaaggacaaatcatggcgcaagctaccatctccataaccgtcaacggcgaagcgaaggaggtggaagcaaccaccaccggcgtagaactgttcgcggaagacaagaacatcatcgcggtcaagatcaacggcgagaaccgtgacctgtacacgccgctgaacgatggcgataccgtcgaccccatcgccctcgactccgaagacggcctcgcaatcatgcgtcactcggccacccacgtcatggcccaggccgtgcaggaagtctacccgaacgccaagctcggcgtcggccccgtcatcaaggacggcttctactacgacttccaggtcgaccagcccttcaccccgaacgacctcaaggacatcgagaagcgcatgcagcgcatcatcaagtcctcccagtccttccgccgccgttccgtgaccgaggaagaggctctgaaggaagaggccgaccagccctttaagatcgaactgatcgaagacaaggaagcacacctcgacccggccgccgccaccgagatctccgaaaaggagctcagcttctacgacaacgtagaccgtgatggcaatgtggtttggaaggacctgtgccgcggtccgcacctgccgaacacccgctacatcaaggccttcaagatcgagcgttccgccgccgcctactggcgtggttccgagaagaacccgaccatgcagcgcatctacggcaccgcatgggccaccaaggaagacctcaaggcctaccagacccgcctggaagaagccgccaagcgcgatcaccgcaagctcggcgccgagatggacctgttctccttcccggatgaaattggccccggcctggccgtgttccacccgaagggcgccgccgtgatcaacgcgatggaggactactcccgtgagatgcaccgcaagcaccactacagcttcgtgcagaccccgcacatcaccaagggcggcctgtacgagacctccggccacctgcactggtacaaggacggcatgtacccgcccatgcacctcgacgaggagaaggacgcggacggcaacatcaccaagccgggcgccgactactacctcaagccgatgaactgcccgatgcacaacctcatcttcaagtcgcgtcagcgctcctaccgcgagctgccgctgcgcctcttcgagttcggcaccgtgtaccgctacgagaagtccggcgaggtccacggcctgacccgcgtgcgcggcctcacccaggacgactcccacatctactgcacccgcgagcagatgaaggacgagctcaccagcctgctcaccttcgtgctgaacctgctcaaggactttggcctgaccgacttctacctcgagctgtccaccaaggacccgaacaagtacgtcggctccgacgagatctgggaggaggccaccaacacgctcgccgaggtcgccaaggaatccaacctcgagctcgtcgacgatccgtgcggcgccgccttctacggcccgaagatctccgtgcaggcccgcgacgccatcggccgcacctggcaggtctcgaccatccagctcgacttcaacctgccggagcgcttccagctcgagtacatcgcgaaggacggcacccaccagcgtccggtgatgattcaccgcgccctgttcggctccatcgaacgcttcttcgccgtgctgctcgagcactacgcaggcgccttcccggcgtggctggcccccgtgcaggtgctcggcgtgccggttgccgacgagttcgccccgcatctggccggcttcgtcaagtcccttgaagatgagatggtccgttgcgagatcgactactccgacgatcgcttcggcaagaagattcgcaacgcctccaagtccaaggtgccgttcatcctcatcgtcggtgaggaagacatgaacaacaacgcggtcagcttccgcttccgcgacggcagccagctcaacggcgttccggtggacaaggcccgcgagcagatcctcaccgtcatcaagaagcgcgtccaggtgaactccgccgacgacttcaacgccgctgtggctgagtgatgtgaatggtactggctcccctctctgaggggagctgacgccgtaggcgactgaggggagtcctgcatggctcgcactcccttcagtccgtttcacggacagctcccctcagagaggggagccaagaaagggtgcgaaaatgactgacgtgcgtgtcgataatccggcggactttccgcctcaggaggacacggtcgaacgactgtggactccgcagcgcatgacctatgtgctgcgcaacagcgaggatcgcccaaccaagcccaagacgaaggaatgcccgttctgcgccggacccaaaaaatccgacgaagacggcctcatcgcctggcgtggcacgcacgtgttcgccatcatgaacctctacccatacaatgtcgggcatctcatgatttgcccgtaccgtcacgtcggattcatcaccgaactcgacgatgccgaactgttcgaattcgagaaggccaccaccctcgccatgaaggtgatggagaccgtctcccgtccggacggatacaacatcggcatcaatcagggcgaggtcgcgggtgccggagtcgccgcgcacctgcaccagcatgtggtgccgcgttggaatggcgatgcgaacttcatgcccatcgtcgcccagacgcgtaccatgccgattctgctgtccgaccagcgagacgcctatgcccaggcattcgaacagctggccccgcagtatcatttgccgcttgcctgaccgggtgcggcacccgcgcaaccggttttatcggtacgcgcaataagacaatcatcggaaacattacgggtatgtctgattaacggcctacaatcgtttcgtttgacatcatccgtttcaataattgctaggagcattatgtcaggtcattccaagtgggcgaccaccaagcacaagaaggccgccatcgacgccaagcgcggcaagctcttcgccaagctcatcaagaacatcgaaatcgccgcccgcctcggcggcggcgacccggacggcaacccgtccctgtacgatgccatctacaaggccaagaaggcctccatgccggccgacaacatcgctcgcgccgtcaagcgtggtgccggtgctgaagatggtgccgccaactacgaagacatcgtctacgagggctacgctcctgccggcgttggcctcatcatcgaatgcctgaccgacaaccgcaaccgtgcggccgccgaagtccgttccaccctgaccaagggcaacggctctctggccacctccggctccgtgtccttcaacttcgagcgcaagggccagattgtggtgccgtccgagggcgtggacttcgacaagctgttcgaaaccgccgccgaagccggtgccgaggacgttaccgatgacggtgaagtgttcaccgttgtgaccggtccgtccgacctgttcaccgtgcgcaaggctctgcaggaagccggcttcgactacgattccgccgaccaggtcatgcagccgaagaacgaggtcgagttgagccttgaggatgcccgcaaggtgtccaagctcatcgacaacctcgatgacctcgacgatgtgcagaacatctactccaactggaccgcttccgacgaggtgatggcccagctcgacgaggagtaatcctcgtgattatccttggcgtcgaccccgggctcacacgttgcggggtcggcgtgatcgaagccggcgagcaccgccggctttcgtttattcacgtggacgtggtgcggtcctcaccggatatcacccaggatctgcgtctactggccatctacaacggcctgtccgagaaaatggaccgattcgcgccggacgcggtatctatcgagcgtgtgttcgcccaatccaaccgcaacaccgtactcggtaccgcacaggccgccggcctcgccatgctcgccgccgcgcaacgcaatattcccgtggcgttgcatacgcctaccgaagccaagctggctatcaccggtaacgggcaggcgcagaagattcaggtggagcgtatggtgacacgtattttgaacctcaccaaaatgccgactcccgccgatgccgccgatgccttggctttggccatttgccatgcgctgcgcccggcaggcgcattgcagggcggcgaacgcgaacaacatctgaccgccgcgcaacgccagtgggctgaggccgcacagaactccacgcgccgccgcatcaaccacgaccgaggcatgtagtatactttcgaacagttgttcgagtcttgaatcctggagcgctgaaggagtacctgtatgatcggcatgctgaccgggcgggttgaatcggtcgaaaccgataccgcattgattgatgttgggggagtgggctacgaagtgcgcatgtccgccaccgacctgagccgtctgcacgccgggcaagacacccgcgtcttcacctatatgaacctctctcaggatgccattaccctgcatggattcctggatcgggacgccaagaaaaccttcctacaactcatcaaggtctccggcattgggcctaaagtggcccaatcgttactctccacactgacgccgagtcagttggcccacgccatcgccgacaacgacgccaccgcgctggccaaggctccggggctgggtaagaagggcgcacagaagatcatcctcgagcttaagggctctattgatttgagtcagatcgagggtgcttccgctcaggcggcaacatccaagtctccggtggataccggtacggaacaggttgtcgaaggactgatttcgcttggctggcgtcagcaggacgcccagcaggccgttgccgaggcttgcgccgaaaacgacattcccacgccgcttgccaccgacgatgtgccgcgtgtgctacgtctggctttggcgctgatggataggggccgctgatgagcgagacaacggattacggagcctccaacaccggtgccaacgaagagtcgctgcgcatggtctcctcccagccgatcggcaacgagccggtcagcgacgaggagctgcgcccccatgttctcggaggctttatcggacagccacggctcaaggcccagctgcaactgttcctggacgcggcccgcaaacgcgatgtgccaccggaccatattctgcttgccggccctcctggcttgggcaaaaccacgttggccatgatcgttgccaatgagcttgaagtgccgattcgcgtgacttccggccctgcggttcaacatgccggtgatcttgcttcgattctgagctccctcgacgtcggcgaagtgctgttcatcgacgagatccatcgtctgccgcgcgccgccgaagagctgctgtatatcgcgatggaggacttccgcgtcgatgtgatggtcggcaaaggcccgggcgcaagctccatcccgctgaccctgccgcgattcaccgtcatcggtgccaccacgcgcgaaggtatgctgccaagcccgttgcgcgcacgctttggcttcaccgcacatctcgacttctatccgcatgaggagttggaaaagctcatcgaacgttcggccaacgtactgggcgtaaaccttgatgcgggttccgctcatgagcttgcgttgcgttcgcgcggcacgccgcgtatcgccaaccgattgctacgccgtgtacgcgactgggccatcgtccacgacctgatcgtggtgcggccggacgacgtcaaggaggcgctggccctgtaccagatcgactccgaaggcctcgaccggctggacatcgccgtgctcaatgccatcgtgcgcaacttcaacggtggacccgtgggcctgaacaatctggcggccatggtgggcgaggaatcggaaaccgtggaaaccgtgtgcgagccgtatctcgtgcgcgaaggttttatgattcgcacgcccaaaggccgcgtggctaccgagaaggcatggcagcatttgggaattacgcccaaagatgatgtcagcaagctcttctagactttctcctgtttgcacactcggcagcgtttcgtcaatgtcgctcgtttgaaggagttgtttcgtggaacaacagtacattatgctcatcgtgatcgtcgtcgtgttcggcggcatgatgtggtggcagtccaagaaggccaagcagcaacagcaggagaagcaggacttccgtcgcaacctgcagcccggcaccgaggtcatcaccatcggccaggtgatcggcaaggtcgtcgaagtcgacgagcagtatgaggagatcgtcatcgactccgaaggctccaagctgcgtttcggcttcaacgccatcgcccgtgagtacacccgcccggcctatgtgtccgatgatgaggtcgacgagaacggcaacccgctgcccgacgaagacaccgaggctccggctaacgatgaggctggtcaggttccgatcgaggcgtccgtcgtgtccgaggaagacaccgctgacgagaccggtgacgacaacgaaaccaagacgaagtaagctgttcgattcggtagcaccatccgcgtatcgcatcgcaaaggcataaaaggggcgagcactatggcacagtcggacatcaccatcgacgcattgagcaaggtagggcaacaggacgccgaatatctggtgtccttggtgcgttccgtaccggggtttcccaaggaaggcatcatcttccgtgatttcatgccagtgctcgccgaccccaagggcttgaagattctgctcaaagcacttgaagaggccctgccggtgtccccgagcgaattcgactccattgccggtctcgaatcgcgcgggttcctgttcggcccggccatggccgcccatttgggcaagggtttcatcgccgtgcgtaaggccggcaagttgccgcctgaaaccatcggtgaatcctatgacctcgaatacggcacggccagtgtcgaaatcgaaaccgacgccgtacaggcagggaagcgagtgctcatcgtcgatgacctcatcgccacgggcggcaccgccaaagccgccaccgaccttatcgaaaaggccggtggcaccgtggtgggcttcagtttcgtgatgcggctcgatggcctcgacggtctggataagctcgacggcaagcccagcagctcgctgatcgcgatgccggcctgagatttcgtctcacccaacgtacagtcagttttcaaggtccggcatgtactgtgtacagttacatgccggaccaattacatagtcagggaaggatcgatggatctttacgaataccaggcgcgtcagctgctcgaggaacaggacattcccaccccggacgccatctttgcccagaactcccatgaagtcgctgaagcggcggacaaaatcggctatccctgcgtaatcaaggcgcaggtcaagatcggtcatcgtggtcaggccggcggcgtcaagatcgcccataaccgcgacgaggcgattcttgaatccgagtccatcctgccgatgaccatccacgggcacaaggtttccggcgtgcttgtagccgaagccaagaacatcctgcacgaatactacgtgtccatctccgtggaccgcacctcgcgcgacttcgacgtgctggccaccgctaacggcggcaccgaagtcgaggaaatcgccaaggaacatccggaggccgtcaagcgcctgcacatcgatgcgctcggtgacttcgacctggccgctgccaccgaaatggcacagagcatcggcttctaccacgcggacgtcgatcaggccgcacagattctgctcaagatgtggcgctgcttcaaagacaacgacgccacgctcgtggaaatcaatccgctcgccaagatcggcgacccggatgacgaatccaccaagcagctgagcgccttggacgccaagatctccttggatgacaacgcctccttccgccatgacggctgggcgcgtttcgtggatcccatcgttcccgatcccttcgagcagcgtgcccgcgaacacggcctgcactacgtgcacctgcacggcgaggtcggtgtgatcggcaacggcgcaggactcgtcatgagttccctggatgccgtctccggcgctggcgaggaacagggcaccaacatcaagcccgccaacttcctggacatcggcggcggcgcctccgcagccgtcatggccgaaagcctggagatcgtactgtccgaccctcaggtcgaatccgtgttcatcaatgtctatggcggcatcacctcctgcgtggaagtcgccaacggcatcctcgaagcggtcgccaagctcggcggttccaagccgatcgttgtgcgcttcgatggcaacgccgccgccgagggtctgcatatcctcgcctccgccaataacccgaatatccatgtgtccgagaccatggaaggcgcggcagccaaggccgcgcagctcgccggtgaggcgacccagtccaaggaggttcgctgatgctgttcatcgaagacggcgctcccgttatcgtccagggcatgaccggccatcagggcatgacccatacggctcgcatgctcaaggccggcaccaatatcgtcggcggcgtgaacccgcgcaaggccggcacatccgtcaccttccccggtgccaagaacggtgccgacgcgaacatccccgtgttcgccacctgcggcgaagcacgtgaagccaccggcgccaaggccagcgtggtgttcgtgccgccgaagttcgccaagtccgccgtggtcgaagccgtcgaagccggcatcgaactcatcgtggtcatcactgaaggcattccggtggccgattccgcatacttcgtcgaactggcgctcaagaagggcgtgcgcatcatcggaccgaactgccctggtctcatcacgctcggcaaccccggcgtcaatctgggcatcatccccgacggcatcgtcggccgcggcccgctcggactggtctccaaatccggcaccctcacctaccagctcatgggcgaattgtccgatatcggcttcaccgcatgtctcggcgccggcggcgacccgatcgtcggcacgacgctgctggaagccctgcaggcattcgaagccgaccccgacaccaaggctgtcatgatgatcggcgaaatcggcggcttcgccgaacaggacgccgccgcatgggccaaggagcacatgaccaagccggttgtcgcctacatcgccggtttcaccgcccccgaaggcaagcagatgggccacgccggcgccatcgtctccggaggcaagggcaccgcccaggacaagaagaacgcgctcgaggcggcgggcatccccgtgggcaagaccccgggccaggccgccgaaatcatgcgtgacgtactcgccaaggccaacatcgactgatcggttccaaccaatcgtgatgaaagccgtgattcgccaatgggtgcggggagccatagtcgccctcgcatccatggccatctatgccgttgcattaggctgctatacagcgctgatgttattggtcgtctctatggaagagggcggcgacaatctcaccgtcggcacaacctcgctgacacaggccgttgtgcttctgagtgagggatcgggctttagaaccgattcgttcaccctcaccattacgccattgctgttgaccatactgctgatatggctgatcaatgcactcatcatgcgaatcaaagcatacgggccgcatgcgtatgttgccggattgattgtttggctcgggttgaacgaggcattccggcaatccgtgcacctaggtcttgtcgatgaccagtggctggtgttgctgaaagcagccatcgtattctcgatcggtttcctatgcgcagccgtaccggaatcagccaaaatgcgagcattcagggactggactcgcaagcaggtgccggcggacatacgccactgcctgaaaatcggcgtcgccttggccgtcgcgatactgagcatatatctggcaattggattgattaccgtcatcgtatggtcggtacgcaaccatgccgctgtcgtatcgttgttcgaattgtccgggatggaaaccggttcacgaattctcaccaccgtcgccatgctgatctggctacccaacgtcatgctctgggctgtttcctggctcttcggcggcggattcgccatcggtgatttggccagtttcacattatggctcggccaatccaaagagcttcctgcaattccggtattcggtattctgcccgaaccggtcagcagcgaactatggcgtaccgttgccttgaacgcgcctctcgccatcgctgcgctcgtgggcctgctggctgtattcctaccgcaaggattcgcctgcagaccgttgaatatacggaatacgtccacccgcggcccagtactggtttcgctgatctactccgccggggcattctgcctgagcgcgatgctgatctcactggcatccacattgctgttcgctctgtccaatggatcgcttggcgatcatcgtcttgctcacataggcgtcgacgtcatggcctccaccagagtcgtcggtcattcgaccgcactgggacttaccgcggcgtggctgctcgcgctgattggcacagcgctcgtttttccgatagtctggttggttgagagaatcaaggattcccgcaccaccgccgcgacctcgaagaccgccaccgttcgtcaggcgcggttcctagcgtcacaaccacaagaatccaaggaggaacaggatgacaaacacgaaccgaccgatacgtcgagcactggtctcggtctttcataaggaaggcatcgaagtactcgcggaagcgttcgtgaaggccggcaccgaagttgtttccactggttcgaccgccaagaagcttgccgaactgggcgtcaaggtaaccgaggtgtccgatgtcaccggattccccgaatgcctcgacggccgcgtcaagacgctgcacccgtacattcacgccggcattctggctgatatgaccaaccccgagcacgccaagcagctcgaggagttcggcatcaagccgttcgacctggtggtcgtcaacctgtacccgttcgccgacaccgtgcgctccggcgccaacgaggccgataccatcgagaagatcgacatcggcggtccctccatggtgcgcggcgcggccaagaaccacgccaccgtggccatcgtcaccgatccggccgattatgcactggtcgcctcccgcgtggccgacggcaccggcttctccttggacgagcgcaagtggcttgccgccaaggccttcgcgcacaccgccgcctatgacgccaccatcaacgagtggaccgccaagcactggcccaagccggcctctctggacgccgtcgaggtggacaaggacgatcagggcactgaagtcgattccgccaagttcccggcccagttcacccgcacctgggatcgtgcgcacaccctgcgctacggcgagaactcccaccagcaggccgccctctacatcgacccgctcaaccagaccggtttcgcccacgccgagcagctcggcggcaagccgatgagctacaacaactacgtggatgcggacgccgcctggcgcaccgtatgggatatggctcccgccattgccgtggccgtagtcaagcacaacaatccgtgcggtctggccatcggcgcgaccgcggccgaggcccacaagaaggctcacgcctgcgacccgatgagcgcctacggcggtgtgatcgcctgcaactccaaggtcacccttgagatggccgaaagcgtgcgcccgattttcaccgaagtcatcgtcgcccccgactatgagccggccgcgctcgaactgctgcagaccaagaagaagaacctgcgcatcctcgaggtggccgagccgccgaagggccacgaggccatccgccagatcgatggcggcctgcttgtgcaggacactgatctgatcaacgccgtcggcgacgatccggacgcctggaagctcgtggccggcgaggccgccgacgctgacacgctgaaggacctcgtgttcgcatggcgtgcaatccgctgcgtgaagtccaacgccatcctgctggcccacgaccaggccacggttggcatcggcatgggccaagtcaaccgcgtggactcctgccatttggccgtcgagcgcgccaacacgctggccgatggtgccgatcgcgccaccggtgcggtcgcggcatccgatgcgttcttcccgttcgccgatggtgcccaggtgcttatcgacgcgggcgtcaaggccatcgtgcagcctggcggctccatccgcgatgaggaggtcatcgaagcggccaagaaggccggcgtgaccatgtacctcaccggcacccgccacttcttccactgatcgggactctctgaggggagcagctcagccaaaacgcacaaaggtgggattccgcctgacccgtcaacgggtccaagcggaatcccacctttgctattcgcctgctattgtggtcacgtaaccgttcgacagaaggaatcgcaacatgcacaaccatccctatgtatccgaagcacatgagggcaagccatggtttgaatggtgcgtactcggcgtcgtcgccgtcatcacactgctggttgctttcggatatacgatggccgccacggtcatacttgccgtgacggccatcatcaccgggcttgttcgcctgattcttcaggacagaagcccatggaaagtgcgctcagtggcgttcgactccttcatcggcatcgccttgggaatcggcctgctgattacctacttcagcttctttggactcttcggcaacatctttttccgctgaatcgccatcagacgaggcggcctgatcgaagaattcgccatcgtcgagcgtgtccgcgtttgcatcggcatccgtctgcggaagatcggcggcagccggcactttgggagtggtcatcatctgcgcgatgatcatgaccaacgccaccacagcggcggccaagaccgggctaatccagaatacccacagctgctgcagcggattttgcgtaagaccctcattcatcgcggccagtgcgatgccggtggaacgggcgggattgagaccggcaccggtaaccgggtagctgatggcggtggccagaccataggcaagacccatggcaatgacatgacggtccgaggactcgtcgtgatcacccagagaagacatggcggtggcaacgacaatcagagaggcaacgacctcgacgacaatcgccagcgtaatcgagaacgtaatgccatactgggtcagcagcgagtaagacacggagccgttttcgaaaccgttaacggccggagtcagccacactttggcagctacctgctcggatgtgggcagcagcttgaccacggcgaagccggcggcgatggcaccgatgacctgagcgatcacatagaggatgccatccaggattttcgtcttggaaaccagcacagaggctacggtgatggccggattcagctggccaccggacacgcgggagaagatggcggtgactgcggcatatgccaagccggtagccaacgcgaagaacacgatattgatgccatacacggccgaaccccatgtggagaaggcgtaaatggcaaagcacagcaggaagctgccggccaattcggcgcacacgcgcagagccagcggctgttgattggtttcttccatgattgttcattccttttcatctgtcggaagacgggcgaacccgcacaaacggttgccagtctagcagcagtcctacgttgcggtatgatatataggttgggattggctgggattccagtccgccaactctgaagtatgtatacaaatcgacagtctctgcgatgacagaatctgtccggccacgttgggagaacgatgccaaacgcatattcccgcgctgcgaaagcgcaagacgattccaattccattcgactccagaagctgcttgcccaagcgggattcggttcccgccgcaagtgcgaggacatgatcaccgaaggccgtgtcgaggtcgacggtgaactggtcaccgagctcggaactcgcgttgaccctcataagcagcaggtgcgcgtagacggttcgcgcgtacgcgtcaatccgaaccacgtcactctggcactaaacaagccccgcaaggtgctctccgccatggacgacccgaagggccgctacacgctgcgcgacatcgtgggcgacaagtacgagcgcatcttccacatgggccgtctcgactacgattccgagggtcttatcctcatgacgaacgacggcgagctctcgcagcacgtcatgcaccccaagtacgaggtcgagaagacctacgtcgctacgctggaaggcaagatctccggcaccgtgtgccgtcgactcgtgaccaccggcgtgcagctcgacgacggctggatcaagctcgaccactgcgcgatcatcgactcctcgcgtgaccacacgatggtcaaggtcgtgctgcactccggcaagaaccgcatcgtgcgccgtatcttcggctcaatcggcttcccggtcaagcgcttggtgcgcacccagatcggcccgatcaagctcggtgatttgaagcccggttcctaccgcgtgctgtcccagacggaagtccgttcgctgtccaaggaggttggtctgtgattcgcgttgccatcgacggccccgccggcgtgggcaagtcgtccacgtccaaggcgctggccaagtatttcggatacgcctaccttgacacgggcgcgatgtatcgtgcctgcgcttggtggtgcctgaagcagggcatcgatctggacgccgaaaccgtggatgagcgtgtcatcaccgaagcggtgggcgagttcttcaccggcgaccatttcgatatctccgtggacccggacaacccccgcgtattcgccgacgacgaggacatctccgaggccattcgttcctccgaagtctccagccatgtctccaaggtgtcgaacgtcatcccggtgcgcaacgtgctcatcgccgcccagcgcgcctacatcgcccgcgaagcgtcggccgactccttctccgggggtttgggcatcgtggccgagggccgcgatatcaccaccgtggtgtccccggacgccgaggtgcgcgtgctgctgaccgcccgtgaggaggtccgtcaggcccgtcgcaccggccaagccgtcaagggcgtgggtgctgaggatgtggccgcgcgcgacaaggccgattccaaggtcaccagcttcctgaccgccgccgatggcgttactaccatcgacaattccgatttggacttcgcccacacgctcgatctgctcatcggtctggtcggggacgccatcgagaaccaggaatacgagcagtatgccgccaatctcgaaggctatgagctggacgaaggcgatgaggatctgatttccggccgcggtttcacggaaggcgcgcgcaaggccggccccaagccggtgggtgtgctggctgttgtaggccgtccgaacgtgggcaaatcatccctggtcaaccgtatcctcggccgccgtgccgccgttgtggaagacacgccgggcgttacgcgagaccgtgtgagctatgacgcggaatgggccggcaccgacttcaagctggtggacacgggcggctgggaagccgacgtggaaggcattgaatccgccatcgcctcacaggcacaggttgccgtgaccttggccgatgctgtgatattcgttgtcgatggtcaagtgggcatgaccaccaccgatgagcgcatcgtcaagatgctgcgtgccgccggcaagccggtcgtgctggccgtcaacaagatcgacgaccaggccagcgaataccttgccgccgaattctggaagctcggtctcggcgaaccatactcgatttccgccatgcacggcaggggagtgggcgacctgctggacgtcgcgctcgacaagctcaagcaggccgagaagacttccggctacctcacgccttccggcctgcgccgcgtggctctggtgggccgcccgaacgtaggcaagtcgtctctgctcaatcagctggcgcgcgaagaacgtgccgtggtcaacgatttggccggcactacgcgcgaccccgtcgacgaaatcgtcaacatcgatggcgaggactggctgttcatcgacacggccggcatcaagcgacgccagcacaagctcacaggcgcggaatattattcctctctgcgcacgcaggccgccatcgagcgctgtgaattggcgctgatcctgtttgatgcttcgcagccggtatccgatcaggatttgaaggtcatgtccaccgccgtggatgcgggccgtgcgattgtgctcgtgttcaataagtgggacgcgatggacgagttcgacaagcagcgtctcgaacgcctgtggaacaccgaattcgaccgtgtgatgtgggccgagcgtgtgaatctgtccgccaagaccggctggcacaccaaccgtctgacgcgagccatggataaggccttggaatcctgggatcagcgtattcctacaggcaagctcaacgccttcctcggcaaaattcaggccgcccacccgcacccgttgcgtggtggcaagcagccgcgaatcctcttcgccacgcaggcatccacgcgcccgccgcgtttcgtgatcttcgccaccggcttcctcgagcacggctaccgccgctacatcgagcgttccctgcgcgaggaattcggcttcgaaggcacgccgattcagatctccgtgaacatccgcgagaagaagaagcggaagtgacacgcgcgtaatttgccagatttcatatatctggtagattatctactcggtgcttttgcaccatcgggccgtagcgcagtttggtagcgcacttgactgggggtcaaggggtcgcgggttcaaatcccgccggcccgaccgattagcctcggaattccgccacttttgagtggttgtcttccggggcttttccgttttcagacaacataacgacggacttacctttgtaagccattcgtaatggattaaacacggacttcatcttggcgtgttattggaattatcaccgacaattcaccgcctccgcaccccccgtcgtatgcgtttgccccaaacagggactagacttgttcctattgatttgacgaaagggacccgaattgaccgaaataaacgataaggcccaactggatatcaccgccgccggcgacaccgacgccgtcacctcggatacccccgaagaaaccgtaaacacccccgaagtggatgagactttcgagctttcggccgccaagatgcgcgagcatggcatgagcgaaaccgccatcaaccagttccgccatttgtatgacgtatggcgccatgaagaagcctccagctggattcgcgaggacgacatcgagccgcttggccacgtgcccagcttccacgacgtctatgagaccatcaaccacgacaaggccgtggacgccttcgccaaaaccgcattcctcaagctcaatggcggtctgggcacctccatgggattggacaaggccaagtcgctgttgccggtgcgtaggcacaaggccaagcagatgcgcttcatcgacatcatcatcggtcaggtgcttaccgctcgtacacgcctgaacgtcgagctgccgctgacgttcatgaactccttccacacttcggcggacacgatgaaggtgctcaagcatcatcgcaagttcagccagcatgacgtgccgatggaaatcatccagcatcaggaacccaagctcgtggccgccaccggcgaacctgtgagctaccctgcgaacccggagctggaatggtgcccgcccggccacggcgacctgttctccaccatctgggagtctggtctgcttgacgtattggaggagcgcggcttcaagtatctgttcatctccaattccgacaatctcggtgcgcgcccctcgcgtacgttggcccagcacttcgaaaacacaggtgccccgtttatggctgaagtggccatccgcaccaaggccgatcgcaagggcggccatattgtgcgagacaaggccactggtcgcctaatactgcgtgaaatgagccaggtccatccggacgataaggaagcggcccaagacatcaccaagcatccttacttcaacaccaactcgatctgggttcgcatcgacgctttgaaagacaagctcgccgaatgcgatggtgtgttgccgttgccggtgattcgtaacaaaaagaccgtgaatcccacggacccggattccgaacaggtgattcagctggaaaccgccatgggtgccgcaatcggtctgttcaacggttctatctgcgtccaagtggatcgtatgcgcttccttccggtgaaaaccaccaatgatttgttcattatgcgttccgatcgcttccacctgacggacacgtatgagatggaagacggcaattacatcttcccgaacgtcgaacttgatccgcgatactacaagaacatccacgatttcgacgaacggttcccctacgccgtgccatctttggccgcagccaactcggtttccattcagggcgactggacattcggacgtgacgtcatgatgttcgccgacgccaaactggaagataagggcgaaccaagctatgttccgaacggcgaatacgttggcccgcaaggcatcgaaccggacgattgggtgtgatttacaacacggtcgaacgataaaaaagatattatttttgtgaaatggcgctcaagtgcggaaaaagcctctaagatagagtgagtgtggggaaactcatacgcacttataacgaaacagtaactatacgtgaggactaatggcagagggcacaagcggacgtcggcgtttttccgacaaatggggcaagcacgagctggacgtactggctgtgttgtcatccgcgttcccgcaatggctcacatcccgccaaattgcgcagcgcgtcaaggcttacgccgactcgtatggagagctggcagatcaggccgccaaggccgcgttcgccaagcagttccagcgtgatcgcgccaagctcgccgctatgggcatcgccatcgaatcacggcagcctgagtattcgtccaagtcggaaggccaggacttcgcgtcctaccgtctgcagttgggcgacgaaccgcgcgtccgtctgatgttcgagccggaagatatgccggtgcttgccgccgccaactatctggctcgttcgatgtcgatttcctccgagccggatcagtcccagctcgcccaacatgcgtcgcgcaccacgccgcgtgtgccgcagacccctattcccggtctcggtttggattcgattgcgcctggcttgggcacgcagcccattccggactcgctggtcaaggttatcgattcgcgtcgctttgccgccaccgttgatgtggacggcgaacacctgaacgtggcctacaccgattccgacgatttggccatgtttgtgctggagcatccgggtgccacgattgtcagcccgcaggaggctgtggacgcctatcatcgccgcctgcacgccgccagccgattcactttggccgacgaatccgccagccctgtaagcgcctcggtggtttccccgtcgattagtcgcgatgttcgtgagccgggtgatcccgagtcgatcaaggcccagaacaagaagaacggatccgctttccaaacgggcagcgaggtggatcgtcgcctgcgtctgatgctgttcctctccgctcacctgggtgaggaattctcgatgagcgagctggccgagcgctttatcggcaaaccgaagaacgacgacgagctcaagaaattcgtcaacatcattcataaggacatcaacaccctgaccaccgtttccgacgatggtgagatggctggcagccagttcttcgatatcgactggccgctgctggatgccgagggtattgtttccgccaccaattcgttgggtcttgaacgtcttgccggcatttcgccgcaatacctcagcatgctcaccgcctcggtcagctacttggcgcattcgccgttactgccggacaagcagcgtgggcaggccgaatccctgtatgagcgtttgcgccgccatgtcagcccgggccagaccccgtggctgagcctgaccggctatgagctggagccccgaagcttctccatcgtcaagcgcgcgatcaacaccgattcgctgttggacatggagtactccgacggtaccggtagtacccgtcgcaagctggtggcccccgccaagattttcatcgacgaaggcgtgtattatgccgccgtctacacggatgtcggttccgccgcccctaaggacaagaaggcctacgtctccaaagacaagaccatcgacaaggcgaacggcaagccgcgcatctggcaggtgctgcgcttggcccgtatcgaaaaggcggaactggtcaagcccaccaagcagatcaacattccgaacatgccggtgagcgaattgcgcaagtggagtttcgacaacggtaccgacgcggtgttcatcaccgatcagcgcgatctggcattcatcaagacattgccgggcgctaccgtcgaacaatgcggtgccggtgaaaaggtgcatctgaccgtttcctccgattcctggttcgtggccttctgtattgcccacgcgcgtcatatcacggcggtcgccccggaaacgttgcgcaccatgatcgtggcacgcgccgaacgcgaactgagcatcagcgagaacaagtaaggagcctttcatgccttggtggatatggctgattctggccctgttcatgctggccatgattgttgccggactcatctatgcagcccttcatggactccgtgccttgaaagacatgtccgacatcggcggccaactcggtgaacgtgtggccgcgatgggggagcccgtcacttctgccgacaccagcgagccgcctctgttcactcagccgctcagcgtggcacagaatcgttatgccgaggcccatgcggacgtgattcgcagcaaggccgccaagcgcgaacgccacacccaggcatgggcccgctggaagcgattcaacaactaacggaaagcagcaatggcacgtcaccaacaccataagggtaatgccgattcccagacgctgagcccttcgcagcggtacgcatcattccaaaaagtccagcgccatcgggcgtccgcagcagcacgattcgccgaatccctgcccttcgaactggacgacttccagaccgaagccaatgacgcgctcgaagccggcagcaacgtactggtcgcggccccaaccggtgccggcaaaaccgtagtggcggattttgccatttacctcgcccaggaacgcaacgtcaaagccttctacaccacaccgatcaaggcgctgagcaatcagaaataccatgatctggtcgacgtgtacggcccggacaaggtaggcctgctcaccggcgacacctcgatcaactccgaggcggacatcgtggtcatgaccaccgaagtgctgcgcaacatgctctacgagcgttccaccacgctgaacgcactacgctacgtgattctcgacgaagtgcactatctggccgaccgattccgcgggcccgtgtgggaggaagtcatcatccacctgcccaagacggtcaagatcgtcggcctgtccgccaccgtgtccaacgtggaggatttctccaactggattgcctcggtgcgaggcgacaccaaactggtgatcagcgaacaccgccccgtgcctttggaacagcacgtcatcgtgcaggcggacgaatacactgagcccgaggtgctggatctctatcgccgcgacggcaacggcgagcaggccaccaagctcaacgccgaactcatcaaccggctcgaccagttggaccgcaaggccgcacgccggcgcggcgaggaacgtcccgataagcgcaagggcttcggcagaggccgcggcggcaaaggcgccaagggccatgccccgaaagcggaacgccacaccccgcgccgctgggccgtggtggacgagcttaacttcctgggaatgttgcccggcatctacttcatcttctcgcgcaacggctgtgaccaggccgtggaacagtgtatcaatgctggactggagctcaccaccgatgaggaagtgaccaagattcgccgcatcgtggatgagatggtggaggggcaactcactcaggaagacctgaaagccctgcagttctccaagttccgctttgcgttggaagaaggcttcgcttcgcatcatgccggcatgattgccctgttccgccagatagtcgaacgattgttcgaagaaggtctggtcaaaatggtgttcgccacggaaacactggccttgggcatcaatatgccggcccgctgcgtggtggtagagaaactcgagaagttcgacggtactggtcatgtgggcctgacgcccggcgaattcacgcagctcaccggtcgtgccggtcggcgcggcatcgacaccatcggccacgccatcgtggtcgaccatcacggttttgtacccgccacggccgccgcgctgtcatccaagcgtgtctacccgctgcactcgagcttccgacccacgttcaacatggccgtgaacctgctcaactccagcgactacgagaccgcgcgcgttaccctggaccagtcgtttgcccagtgggaggccaacgaatcggcctggcagctggaatcgcagatcaacacactgaagaacgcactggccggatacgaacaggcgttcgcatgcgaacacggcgacttcaaacagttcatgaccctgcgtatggagctgagcgacatcgaaaaggaaggccgccgcaaactgaagcacgaagtgttcctgaccgatcaggagcgttcacgcgccttccagaaccttgaccagcgcattcgcgatttgcgcaaggcggaacacgagcacccatgccgcaactgcccggacctccagcaacacctcaagtggggccaccgctgggcccgcgagacccgcgaactgcagcgcgtcaccgatcgctacgactcccgtaccgggtccgtggcccgtcagttcgatcgcatctgcgatattctcaccgggcttggttacctcgaacgtcatgtcaatgcggccggccacattgacatgacgttgaccgaaaaaggctcgctgctgcgccgcatctacagtgaacatgacctggaactgtgcgaggcgctgctcgccggcacgttcgacaagctcgacgccaacggactggccgctgtgctctcttcactggtatacgaggccagacgcgggggagacggcgaaccgaggcactacccgggcggcatctccgggcccatcgcaatcgcttcgtccaagctcaagggcatctgtgaagacatcgatatcctgtgcgaggatcacggtctggacgagatgcagcggccggacttcggcattctcgacatcatgtatgaatgggcggatggcggttcgctgggatcgtgcctgtacggcaccgacatgaccggcggcgacttcgtgcgcactgccaaacgactggctgacgtgctgcagcagatcgctgtcgcccagccgctgccgttcgacgggggagagcggctggcaggcctcgcccacgaagcggccgaccgggtcaatcgtggcgtggtggcctactccggcgtggactgacggggggccgtttgatgggagtttgtcagccgacgtcggaagcttggaatagcggccaagtccgaactgttgcgtaaattagtagggttaaagatctttcaaggaggatgccgatatggcagaacgtagcctcaggggcatgagcatcggagcgaaatcgctggagtccgacgacaacgtcgatttcgccgcacgaaacgatgtggcgtatgtatgcccgaagggccaccgcaccatcctgccgtttgccgagggtgccgaaatcccggacgagtgggagtgccgttgtggttccgtggcccaccgtgagggcgacgccgaccgtgagggcgacgagatcagcaaacccacccgcacccactgggatatgctgctggaacgccgtagcgaagaggaactggccaccctactcgaaaagcgcctgcaaatgcaccgtgacggttggattcctgactacgagtgatctcctactgaacaacacgtgaacttgatgcccagtcatcccgactgggcataatcattgttggaacaagtcgcatatcgtttgacgaccattcaaagcagtcgacatgaacaaaggggagtggaatctcaatggcacagcatccgatgaaagtggtcctgttggacctcgacggcacgcttaccaagtccgacggcggcatcatcgcctccgtcgtcaagacgttcgaggaattgggtcgcccggttcccgacgatgccgagctgcatcgtttcattggtccggccatcatcgaatcgctgcgacgcaaccatgtgccggaggatgagcttgaccgggcggtcaccatctaccgcagctactatgcggatcgcgccgtgttcgatgatccgaacgagcccggcaacaaagttcccggccgcttggtgaacgtcgtgtttcccggtatccgcgaacagctgctcaagctgcgtgccgacggctattatctggcgttggccagctgcaagcccgagtaccaatgcgttccgatctgtgagcatttccatctgaccgagctgttggacggcatctatggcgcatccagggataactctcgtttggacaaggatcaggtgattcggtactgcttcgacaaaatcggttttgatgctgcagcgggggacaaggccgtgatgatcggcgaccgctacaccgacatcgacggcgcccacgcctgcaatctggacgccattggctgccgctggggctacgctccggccggtgagatggaagaacacggtgcctacgaaatcatcgagaagcccgagcagatcgaagaagccgtaaaccgttatttccaaacacactgaaacacaacggcgaggacttcttcatgatgggatgcgatggagcctgcgccgcgggcttcgacctggttttcatcggtttgccattgctgtcgctgtatgagattcccatgctgatatggttcatttggcgagcattccactggaaacgagatgacaaggattggctgaaaggcacggcgattcttgcaattgcggtggtcgctccggtgctcctttggctgtcggcctggtatgctccggtgctcctttggctgtcggccttggtatgcgtggactagttgatacaggcgaccgaatccttgtcaaggataactaatctgacataacgtacattatcggttatttaatatcatctttattccggtgagaagcaacacctaaacgcctatccatttcggtttctgaagcgttgcgtgcctgcagatacatggcgatgatttccagcagcaccaacacaaatatgatgattgcaccgggcaattgcgcacgatcatagaacgcgagcatatccgcgtccatcaaatccgctgtaaacgtcaacacgggaaacgggatcagcgccgccgcaaacgacaggaaatgcgttttcaccatcgcccagtcgaccggatcaaccggcggtcgccggcgtctcggcgtgaacagatggcctcggctgaccgttatagtgatgatggacacagcaaagatgacggcgaccatccacagaacgcccggcaacaatccgacaacaatcccgttcacccggtcctccaatcagtcataaatcacctcaacatataaaaaacataaaatggcaggcaacaaaagcaacacatacaacaaagcgacctgccgaccaaagccggcaagtcgccaacaaccatacatgtatcaggcggttgcgcgttgcaagcgctgtgcctcgagcttcttgcgcatcctcatggcagtcagttcatcaatcggacggcccgtggcaatcgtcagcggcttggcctcaagatcaacatattcttcctgttccaaggccgtctcaatctggtgccacaacgaacccaccgacacggcgaacactgccttaccgctttgcaacagttcgagcatctgttcgctggtcgtgcattcatgcacgttttgaccatcgcacatgatggtcacattggccagctgatcggtgctgcgttgagtcaagaatccgatagccgccgtcacgttctgcagattcacaccggcatcaagcaacttcttggatacagcgagaatcaccacatccttaaacgagtatagtcgtcgtgaaccggagccatgagacggcgtgatggacggctcaacaatctgcttgcgtgcccaataatcgagctgtcggtacgtgatgccggccaccttggaggccacagtgccacggtagccgcgcttgatctcctcagtatcgacgttggagaacaactccccctgaatcgcgtcagcgttcagattctgacggtcctcaagcgaaacatgaagatgcagcccggtctgtcccatggcactcccctaactcatgcgtgtctcgcatatgactcacactggtgtaatcacatgattgcaatttctgcaatcagtctaaccccgtgctgggtgtggactattgggaaataatggcagatttcgtgaagaacacgaggcggaatttaccgatcatgatttcgtcgccgttcttcagcgtcgcctgatcaacacgctgacggttcacgtaggtgccgttcagacttcctgcgtcaaccacaaagaactgaccgttgaccctgcggaacacggcatgctgacgggatacggtggagtcgtcgagcagaatatcagctcgcggatcacggccgacggtgatttcatcctcgtcaagcaagtaacgagaacctgagaccgctcccctggcggaaatcagcaatgccgttccctcggacaatctggtgatggtgtccagatcctcttgagtcagcggtcgatcgccggtggtggtaatgggcagtacattaatcgcgggcaggccgataatggtggtttcgcctgcgctaggaatcgggttggtcataatcccctattctaccgtctttgcatactggttttgcgtagcttcgcgtacttcgtcgataatgatgctgtcagaaggctgtacattgacgttggacccgtatttcacctggagctgagcgcccacaccgccggcgatatcgactgcgttggacagttcctgcggattgccaatggccttcaccgtgtatgtgggcttgatggtggtgccatccacgatcaaaccttcctcggcgtcctgaatgtaggtggaggtgatgacgcgcacgttattgatggcgattacctcggcaccggcattgcgaagttcctcgataaggttgaacatgattgaggcgtccactttagtcgtcaagcctcgtccgattcggatggtcacgccttgaccctttgccgggagtctgccggagatcaagccgctggtctcctcgttttgcttggcgatcttacgcgcctgctcctgctcgttagccgccgatttcagcgagttgagctggctgttcaactgggttttacgctgctcgagattggagatttgcgtattcgactcgttcagcagccttaccagttcactctcgtccatcgtttcgtacgtggatttagtgttattgatctggctcatgtaggcgaaacccaacaacgcgcacatcagagcgatgagaatcgaggatagtaaccgtgatttgttgctggcacggttgagatccttccggggcttcttacgcaccgtgggaaacgacccggtttccatccggtcgttgaccttgtcttgtgcatgctggtcgcgcattttctccagcatgttgtctgattgtgctttacgtgccatacgtcagtacccttgtcagcctcggaagatgaagcgtctgatcgcggacacgttggagaagatgcggatgccgagtacgacgatgacggctgtctgcagctgcgaaccgacgccgagctggttgccgaggaacacgagcagtgttgccgtcaccacgttggcgaggaaggagatcacaaacacgcggtcggagaagctgcgctcgaaataggctcgcgcggcacccagcagggcgtcaagagcagcgaccaccataatcggcagataaggctgcacgatgatcggaatgtccggcttgacgaacacgccgatgacgacgccgatgattagtcccagaacggctgccattattcattcctttccgcgtacttcacttcgccagtgactgctgcctcaagtgtaatcgaattggatttgctcacctgcgggtagataccggcttccttgaaggaatcgtaaagacttgcaagtttcttcttccccatcgcttcggccaaggcgctcttatcgcctatggcttcaatggtataggggctttgtatcgcggtcatgccgatgagaatatgcccgccggccttgcgtatcgaggtttgcgcgccgagcctattaccgttgatggcaatggcttcggctccgttttggaacatcagggagaccagttgctgcagatccagatcggtgatgactcggatgttggtggaggtgccgactctcgtcgaggaggattgatccgactggcttgccgcgattggatcggccagcgtcatggtgattccttcgccttcgaccaccgtggcaccattgaccatttcgtcttggataagcgtatcgcttttcacgctgccggatattttcttggactgttcgtcaacttgggagcgcaaattattgacgtccgtggtgagttcgtctatttgcgagttgcgattctccaattgcgtggccaaagtctgccgtacctgcttacgcggatcggattgcaactgttgcacgaataggctgcaggcaaagccaacgccgacgcagatgatgaatacgacgatgcgattaaaccagatggagaaggtcgaacgatgctcatggaccagtcgtgagtcggagaacatcggatccatcggacgattgacaagatcatcgatgagctgaagcgaatcgtcgttggttttacggcgacgtctggtgcggatggcggcggcgtcatccggggaaagcgcatgatgtgattccgcgcctcggactgagtgggagaacacggcgcggcgtcgtaccggctcattctccttgggtacggggaatgagaccggggccgtggcctcaagcgccatacttctcccccagttccttgcgtagcaatccgacgccctgcttggtatagatatatccggcgagccaatacatggcgatgccccagatgccggcggccagcgcggcgatgtagagcaagtggaaaaacgtactggtgcccaaatcggcgaaaatcagaccgacgatggaaatcatcagcagcgcggtaccggccttgcccacgaaatgcacgggcagcggaccataaccgtactgggcaagccatagcacctgaatcgccatccacagatccctcagtcccacgataatcagcatccaccatgggatgatgccggcgacgctgagagccagaatcgagcagaaaatgagcagtcggtcggcgatcggatcaagaatctgaccgatcttgctcacttggttgaatctgcgcgcgatgatgccgtcaagtccgtctgaagccgaggaaatggcgatcagggctagcgccgcaatcatctcgtgcttggatatcagcacgctgatgaaaggaatcgagatgattcgtagcgcgctgatcaaattgggcacggtgaaatagatgtcacgtgcttccggactgtatctggtgttgactttctggttggtcatatcgactaacagtctacatgcgggaggcttgtagagcggtaacgatgatgccgcgtgcgccgacttcgtacaaatcatccatcagctggttgaccttggccttgggaaccatgactcgcacggcgttccactgtttgtcgtgcagcggggagatcgtcgggctttcaaagccgggggtcacggccacggcggcggcgaccttgctgatcggaatgtcatagtccatcagcacatactgatgtgcagtgagcacgccttgcagacggcgggtcagcacggccagacgtgagtcctgctcgttcagacgcggcgaacgaatcaggcaggcttcggagtgcatgagcggttcggcaaacacgcgcaggccggcgttgcgcagggtggtaccggtggagaccacgtcggcgatgaggtcggccacgcccagctgcacggaggattcgaccgcaccgtccagatggatggtctcggcctggatgccgtgctcgaccagatagtcgtgtacgagcttatcgaatgtggtggccacgcgcttgccctgaacatcctccagggtggtgatcggggattcgttcggtgcggcgaaacggaaggtcgaggcaccaaagccgagcggcatgtgctcgagcgcggcggtaccggagttcttgagtagatcctggccggtgatgccgacgtcgatggcgccgcggcccacgtatacggcgatatcgagcggacgcaggtagaacagctcgatgccattgtcgggatcttgcacgaccagctggcgagggttggtgcgcagacggtagccggcctcggccagcatgttccacgcgggttcggatagcatgcccttgttgggcactgcgattctcagcatttgcgttcctctcacaggtgcttgtagacgtcttcgagcgtcaggccgtgcttgatcatcatgacctggacgtggtagagcagctggctcatctcctcggcggtgcggtccgcaccctcgtattcggcggccatccaggtctcgccggcctcttcgatgatcttcttgccgatgaagtgggtgcccttgtcgagctcgtcgacggtcagggagccttcggggcgggtctgggccttttcggacagttcggcgaacagggattcaaacgtcttcatgtgattcagattcttttcttgcggttatggatgaaaggtggattgcggttcaggcttggagctcaggccttgaacgcggcctcggccttggtgcggatgtcgtcgatggcttgggcgggattctcggcgccgtacacggcggaaccggcaacgagcacgtcggcgccggcttcggccacgatgtgcgcggtcttggggctcacgccgccatcgacctggatgcgggtcttcaagccacggcgggtgatctcatcgcgcaggcggcggaccttggccatctggttgtcgaggaacttctggccgccgaagccgggctcaacggtcatgatgaggaccatgtcgaactcgtcgaggatatcgaagatcggctcgaccggttcggccggacgcacggcgaagcaggccttgcagcccatctcgcgcagctgtcgggccagacgcacgggggcgtgggtggcacccatgtggaaggagatggaggcggcgccgagcttggcgtattcgggagcccaacggtccgggtcctcgatcatgaggtgcacgtcgaccggcagatcggtgacctgacagatgcggccgacgatcggctcgcccagggtcaggttcggcacgaaatgatggtccatgacatcgacgtggaccaggtcggcgttggcgatggccttgagatcacgttcgaggttgcagaagtcagcggacaggatgctgggtgcgattgcgatattgctcatggtttcctaccttatctgtgcaatgggacttggagccccgtgtttcgcgctgtttcggcgctgtttatcgtggtgtcacttagtgcgattggtttgctttttctggcgaagttgttcctcttcgatgctctggcgttcgagctcgtcggcggtgaccgccgcaagcccgcgcgcctgcgccttggggtccggcccgtactggtagagcacgacgaacaggatgcagccgagcacgaagacgatgatcgcggtccacacgttggtcctcaggcccaggatcaccgtggaatagttgatgcgcacgttctcgatccaggtgcggcccaggccgtaccacatcaggtacatggcgaactgctggccggccttgagccggtcggcaagcttgtggccgaggtagatgatgagcgcggcgccaatgaggttccagatcatctcgtacaggaacgtcgggtggaacagcgtggtcctgtagtccgggcattgcgcgccagaatagcagatttcggatttgccgatggcgtccgcgtcgttgagcttcaggccccacggcaacgtggtgggccagccgtagagctcctggttgaaccagttgccgagtcggccgatggcctgggccacgggcagcgcgggggcgatggcatcggcgaagatcgcgaacggatagtgcttgtgacggcaccacaggaacgccaccaaggtgccgacggagatgccgccgaagatggccatgccgccttcccacaccttgaggatgttgaccaggttgccggtgggcgggaagtagtcggccggcgtggtgatgcagtggtagaggcgcgcgcccaccagtgcgcagggcacggtgacgagcgtggtgtcgagaatctggtcgaaggtgccgccgtaccgcttccaacgtgtggcgaggatccatacggccacgcagatgccgatcaggatgcagatcgcgtacatgtggatagtgaacgggccgatctcgaacttggagaaggtcggcgagggaatataagccagattcatcgtgcctctacttgctggtgctcatggtgtgtgtccacgcgcgggttgtgcttgacgctctgtgactaccctaccgtgtcacggcacaacccgcgtgaggcgcaccgggtgtttaccgggcgttgtggatgccttcggccagttcctcgctcttggcggcgagcagcttcaagccttccttcgggtcgcgtgcggtcttgttgtcgtccgcgagcagggtgtgcacgagcgcggagccgacgatgacgccgtccgcgtaggagccgaccttggcgccctgttcggcggtggacacgccgatgcccacgcacacgttctcggcaccggcctgacgggtgcgctccacgagcagttcgggcgaggcgtcgatggtggcgcgttcgccggtgacgcccatgcgggcggccgcgtacacgaagccacgtgcgttgcgggccacggtttcgaggcgctcggtggacgagtccggggagaccaggaagatgcggtcgagtccgtggcggtcggaggcttcgatccactcccccgcctcgtccgggataaggtccggggtgatgagaccggcgccgccggcgttctcgaagtcgcgggcgaaacgctcgacgccgtagtggtacacgaggttccagtagctcatgatgagcggcacgccgccggcgttggccacggtttcgacggcctcgaacacgcgcttgatggtctcgccgttgttcagggcgatggaggcggcagcctggatgaccgggccgtccatgaccgggtcggagtacggcaggccgatttccacggcgtcgacgccgtgctcgaccatcgtcctgaaggcgtcaagcgagacgtccgggttagggaagccgtagggcaggtagccgatgaaggcgggcttgttctcggccttgaacttggtgaacatagcgcccgacttgctgggcttgtggctgatgcccagcggctggccggacggcgtggttgcttcgttggtcataatcaaaaatctcctcttcttgttcaggcgacagtattgccgtgggcgccggtcacatcgagcgcggcggcctggtcgtcggtcaggtagccgaaccacttgccggcggtggccatgtccttgtcgcctcggccggagatgttcacgatcatcacggccttgtcatagcccttggccttcagatcggcggcggctttgtacgcgccggccacggcgtgcgagctttcgatggcggggatgatgccctcggtctggctcaggtcgcggaaggcgttcatggcctcctcgtcggtggcccagctgtagttcacgcggccgatgtccttgagccatgcgtgctcggggcccacggaagcgtagtcgaggcctgcggagatcgagtaggtgtcgagcgtctggccttcgtcggtttccagcaggtagctcttggcgccctggaacatgccgagctggccggtgccgggggcgaagcggatggcgtgcttgccggattcggggccgttgccgccggcttcgtagccgtagaggttcacgcgctcgtcgtccaggaaggcgttcatcacgccgatggcgttggagccgccgcccacgcaggcgcagatcgcgtccggatggtcgatgccgtaccagtcctggagctgctgcttggcctcctcgccgatgatcttctggaagtcgcgcaccatggccgggaacgggtgcgggcccgcgacggtgccgagcaggtagtgcgtgtccttgacgttggtgacccagtcgcgcagggcttcgttgatggcgtccttcaggatcttgtcgccaagggtcacctcgaccacttcggcgccgagcatacgcatgcgggccacgttgagggcctgacggcgggcgtcgatctggcccatgtagatgcggcacttgaggccgagcatggcgcacacggtggcggtggccacgccgtgctggccggcgccggtctcggcgatcacgcgggtcttgcccatgcgcttgacgagcagggcctggccgagcgcgttgttgatcttgtgcgcgccggtgtggttcaagtcctcacgcttgaggaagatacgggcgtcgagaccggtcttctctttgacaagtgcggagaagcgcggggcttcggtcagcgggctcgggcggcccacgtaacgctgctggagcgtcatgaattccttgtggaattcggggtcggccttggcttgcgtgtacacgcgctcaagctcgtcgagggcggtgatgagggcctcgggcacatagcggccaccgaactggccccaatacggtccctgatgttcgctgagcggggtcgtttcggatgctttcacttgtgctcctgcctttactagtcgttccactgcaagttcatgattgtcggcggtggccacgccctcgccgaccagtaccgcgtccgctcccgcgcgggcgtagtcttcgacctcgaccgcgccgaatacgccggattccgccaccttgatgacgtcatcgggcagatcggccgcgagttcgttgtatttgttcacgtccaccttgaggttcttcaggttgcgcgcgttgatgccgatcaccttggcaccggccttgcgggcgcgttcgatctcttcgcgggtgtgcgtctccaccagcacggtcatgccgagctcgtgcgccaggtcgagcaggtgcttgagctgggcgtcgtccaatgcggcgacgatgagcagcaccaggtcggcgccgtgggcgcgggcctcgaagatctggtagtcggtgacgatgaagtccttgcgcagcactggaatgtgcacggcggcgcggaccttgtcgaaatcgtcaaggctgccgaggaatttgcggccttcggtgagcacggagatggcgcttgcgccgcccttctcgtactcgcgggccagcgcggccgggtccgggatgtcggacaggtggcccttggacggagacgcgcgcttgatctcggcgatcacggggatgccgtcggcgcgcttaagccatcgtgtcgcgtcaatcggagccggggccgccagcgcggccttcttcacatcctcaagcgatacggtgagctcacgggtgcgctgatcctccagcgctcccgccaccagttcgtccaaaaccgacatggtcctccctttgttggtgttcggtcatgcgccactctaggtcacgtcctgtcccgattgccgaacccgtcctacattttgggctttcgcaggcgattccggcttaggcagaacattggcataaactggcacgcatgtacagacgtttcgcgctcgacttggaatgggacgccgtggctggaccgcacaatcgacggcgcatccttgctcgccggcgtgcggaactcaggcactgcgttatcccgccgcttgcaatttcacgaggtcgccccgctgcagggcgacggcaaacgcctgattcagccgttggattcgaccgagcccatgcgcctgttttgacggaacatctttgacgagagatcgtcactgaatcattgtttgctatatatgtatcacagtgtcataactatgaaatcatattgtggaattgtggtatatgaagttcgcatgacaacgatgtcaccgttggtaggtggaccagtaggtgccgttgctgccggtggtggtgctgaactgccgatgtgattcagtccaccagcccgcgcagcagcgcgatttcgtcgcggtgcgtggtcggcgtctgctccttggtttcgagaatcatcgggagcttggccatggtcggatcgttgaccagtcgcgtgaagaacgggatgccgagctgcccttcgccgatgttggcgtgacggtccttatgcgagccgaggccgaactgcgaatcgttcacatgaatcgccttgaccctggccaagccgatcacctcatccaactggcgcatcacgccgtcgtagtcgttctccaaatcgtagccagcatccaacacatggcaggtgtcgaacgtgacgccgacgttcgccttattctccacgccatccatgatcgtggcgagctcatcgaaattgcggccacattccgtgcctttgccggccatggtctccagaagcaccatgacgccatccgcacgctcgaacacctgattcagcccctcgctaatcagccggcagccggtctcggcgccttggcccacatgcgcgccgggatgaatgttgatatatacctcctggccggccgcgcggatggcggtcagcagctcgatgtcctcggccaacgcctcgatcgcgaatgcgcgcttggcctcatccttgccggccagattgtagacgtacggcgcgtggacgaccaacggcccatagccctcagccttcagacgcgcaccgaacgccgccgcaccggccgggtcgagcgccttggaacgtttgccatacggagatcgcgggaagaacgcgaacgcggtgccgccctcctcatgggagcgttccagcagcgcattccatccgccggccgtcgacagatgcgatccgatatacagttccgtcattccaaattcctcgtgttccactcgctgttcgtgttaccgctatcatatggtaggaggcatcgagcgccgcccgcacaaccgacacgagacacaactgttcacccgaccaaaggagacccgagcatggcgtcagccggcaatcccaaggacgacaccggcctcgaacggaaaatggagtcgcaccacctgacgatgatctccctgggcggcgtaatcggtaccggcctgttcgtcagctccggctatacgattcatcaggcggggccgttgggcgcgatcctcgcttacgcggtcggctccctgctcgtctactgtgtgatggtctcgctgggcgaactgtccgtggccatgccgtatgccggcagcttccacatgtatgcgaagcggttcatcggccccggcaccgcgttcaccattgctatcctgtattggctgaactgggcggtggcgctcgcatcggagttcacggcggccgggctgctgatgcagcgatggtttcctcattcgccgtcctgggtgtggtcggccgtgttcattgtggtggtgttcgcgcatggtatggtcgctggccaaggagcggctgattcccgcgcgattcgccaagacgaatttccgtggtgtgccggtgtgggccgtgctgttcagcatggcgggttcgctgctggcgctgctgtcttccgtgctcgccgcctcgaccgtgtaatttggtgttggtcgcagtatccggtttggcgacgctggtggtgtggttctccgtgtgcgtgtgccatatccgtttccggcgtgaatgggcgagggacgggcacagcgccgatgagctcgactaccgtgcgcccggtttcccggtgctgccgtggctggccatcgtgatgtgcatcggcgcgctggtgctcgtggtgctcgatgagacgcaacgttcgaccctgattgcatgattccgttcgtcgcctgctgttatgcggtctattacgccctcgaacggcagctcaaacgcgaaaagagcgcctaactcggtttcgaggggctgattcggcgttcgccggaggtctacttgcgtttcaaggggctgatgcccaagtagacaaggctctgaaatggcgttatgtcgttgccacaaagccgtttatactcgcggttcggcgtttgagcagcccctcgaaagccaagtagatgtccccaccggacgaaatcagccccttgaaagccaagagccccactttttcggcgaattacgtcttatatcaggtcgtacggcatctgatgcttgaccatccagaagatgccgaggccgatgaacaccagcagattgaatccgccgctatgccaccacaccacggcgatcagcgtcgccatgcgcgccacatagaacgccgcacgccgccagccttctcgcggccgggtttccactgtcatatgcgtgaagctgccgccgagcgtacagccgccgcgcaaccatggcaccacgccctcgaagaggatgagcgccgccaggaagaggatcgaaccggtccagtcgaacggttccatcgactgccatgagccgttggagcccgagggcaggtttgagcggacgatcatgacgaacagatgcgtcggcatcacggcgaacccgatcagcgtcatgtcgatgatgaacgtgatcagccgccttatgaagccgggtgtggtggtcggcgtcgtatcggcgacccgcgccggaatcaggcgcagcgagaacatggccagcgcgaacccgatcagcgcgccggttgtgttccacaggagatcgtccacgtcgaacagacggtaggcgcacgggaacacgcccatgaggccggtcagctgcatcgtctccagaaacagcgatgtggcgaacgacagtactgcggtaaccggcagcggccaacgccatatgcggcccatgatgaagcccaacggcaggaagaacacgatattaaacgcgatttgcagtacggcggtgagaccatcggtacggatgtcaccgatgaactgcagcgggttgagctgcggtgtcagatggtgcgcggcgcaataggccgccgcatcggccggcatcggatacagtgtgaagcacagcaggccgagcaggtacagcaccgtgccatacgccactatggccgacgacagtcggatgcgattgtcgcggtgatacagcaacgccagcaccggcacagtcagcagcatggacacaaacggccacaatgccagcgcgaacgcaaacggttcggaaaagttcttaagaaatcccatcttcaatgctccctgcttcggtccgctccattcggtttcggaccatgactctcgacttctgattccaaggtacggaacatgacggcatgcgggtatcggccatgagagcgaaatcattgggatgaaaggcgattcgtatcattcgcatggatgaggaagatgcaccagttgtgactgacaattgcggcctgcgaaccggcaggatgaatgggactgacccaactggcccgtctcatcttgtagggtgtttcgtgctcttgtaggcagatgattccaatggcgatgatcggaataccgccattgcaatgacctctcgccaaggccagctacctacaagatgctgaatctgcctacaagatgaattcgccggtgaaccatgccggcatcaccgcttcgaggtaaggacgcatcacgttcacgagccgaaattcgtgagcgtagttcatgagtttgaccaagtcagtgtgcgcggatctcatgtaattctggaaggcggattgcaaatcttgcggatccactgtgctgcgggagcggaacaaatcgcaaatggttcgttccaaatcataaacgcgaaccgtatgcccgaacatggtgatagccgacgccaggccaattgcaaagcgattgtcggccacctttctcactgttatgtcttcattcttgagacgagccgtacctgatgattgcggtaaggtaatcgtcggtgtcagggggggctcgctccccctctccaagcaagaacaacgcagtttcatgcgaaaaaatggctttcggatatcgatactgcaattcgaacagcggatcggactccgcattcggtgaaacatataagccctttgccgctttctcaagcttggcttcacgcacgaatcgcgaaatctccgtgcgggaaactcctcgacgctccatttccgataccggaagatatcccatatgctccttcaatacgctttccgcttctgtcgctctagtggacatgggcactccttcagatgttgcggagctcggagagttgcctgaagaaaagttttgctatcgcctaacctaatgcgttattcgactccaaccgttgctcgacttcgaaatgctcgaatactatgagcgagttgtcgttcaacggaaagtttgggttggcgaattcatcgcggtattccgccgaattccagaaagattcgtgtgcgctccgccattgggccgccgtgacgtcgccttcaccctcatcgatggcgtaccggtcagtgacttttccgagcggaatcacgtcaaccgcagtggtgacgagtacggctacgggtcgttcatcggaatccaccaacaccgaatgcgcgccaacgcacggcagcggttcgacctcttcctcatattcaatcatcagcgcagcggtggcggtttttacgccgtccagaatgagcttcaccaagcgatcgcgttcaggcccaggaaacataaactccgctttgggcaaatcactggtttcaaatgccgtattgacgctcatgcaatgctccagatcgtctttatgttcaattgtgctgtgcttttcttactcccatcataatagcccgaattccatgagtttccggcgctgatccagtggcctccattacggtcaatacaacctgatgccaagcaatcacatgacaacaagtgacactgtactcacgaaccggcctactatgggcggcatgacgattcgtattgtttcgattgagccgccatggtttgaggaaaaggcccaagttcagtcgtgcacgtggcgcgaactcaatcaggggcatattccgcaggaaatcgtggatgcgatcactcccgaattcgcgctcaaactgacgcgcagcacgccaaagaccccaatcaggtcgtattggtcgctttggagaacaaccacgtgattggttttgctgagcttctgcaaacgccgcgttcgccaatcaaacggtccgaggctgcggaactggcttcgctatatgtgttggaatcttgccatcgtcatggtgttggccgtgctttggttgaggcgggccaacgcgccatcggcaacgatcggctcgccttgtgggtcgccggattcaacaccaacgcccaaggtttctaccgtcacatcggcttccatgagaccggcctgactcaaaccgaagacatgggcccggaactcgaaatgatcaactactctgacggcgtattccagtgagcagcccgacctcccacacgcgtccggcgctaccatgaagccatgtctttgaacagtgagcaacgcgcggcgactatccgcgaatttcaggagaacatgagccggctgggtctgaccgccgaacggcggcagggattttggcgtcagcggcagcagagtggagcaaatcatcaccctcaagtcgggcgtgctggagtatccgtggattatccgagcctatctgctgagcagagctgagacacagggcgtggaactcacgccgttcatggcgttacgcggaaatccgcacgattattggttcctcgacggcgactttatcgaccgaggcgaaatcgattaaaaccgattgataatcggccatttacacgcaagaggcgccgtcaatcgcctcgcgcatagaggccatcgctctccgtgcaggtggcgatgcgtgtgtagtattccgtcttgtcctcatggtcgatacgtgcgccgcaatgctgctgcaccgcaagacttgccggattggttttgtggacactcaggtaagcctccttgatgccgagctcgcgggccttggcaagcgtgagcttgagcccggcggtcgcgtagccgtgaccgcggtattcgcgggcgacaccgtagccgatgtggcccggaccgttgcgcaggaagtcggtgagccggtgacgcaggttgaagatgcccacatagtcgccctcatcgttgacgagaatgtatttggtggctggcacccagccgtccagcaggccgacgccaagcgactcatcacgcaaccctcgcacatatgcggcgaaccgttcacgattcatgccggccgctgggttctcgaatcccgtctcctccgccgggaatttcgcgaacaagtcaaacgcgcgttcctggtccgccagccatgtctcaatcagccgcattggtcacactcctcctgttgacacagcagaccacactactactgtgctcggccaacggccgcaagccttatctagggtgtgtttacagataggcagcaagtgtctgccaatgcgtttatcgcaggatataccaggttactttccccgatacacggcagcgacgccgaagacaaattgtatgatgaacaatcccagcaggaagatcagagctcctggccggtacatgcggtagaagtcgaccatatccggctgcgccaaaggcgctgccatgatatacaccagcgcagcgaacacggcgccgagcgcggaaacaaccaagaacgcgcctacggcaaaacgcagcaggccacgatccgaggtcctccggcgcagaccacggcatcccacgaagacgaataccgagatcagcaggtagaacagcagcccgtacgtgggcagcatgtcgataatcagcagatcgttcatggcatatcctttcgtggcgcaatcccattcaacctgcgcatggccaaaagcgcaacatcgtgtcaagtaatcgcatgatagcaggttttgtccggctgcgaccgtggccacgatgagcggcatgggacatgatgacatgaccggggctgcggcgcggtcgatccgtatcgcccgtattggacaatgatccgttcgccctggatgcgatgtgcgcgatgatctcggccgtatccaaggacttccatgtcatgtggggcacgggttcgcccgcggtggcgatcgagcactgccataacccgcataccaggccggacgtgccggtgtcggatcctaaggaatctgttggtgtcgctgcagctcattgccattcccactgaagagatgattggcgaaaacgatactcactacctattcattaggcttcagctcgtgttcgagcacaagtttcatcttgctgttatccatcaaccatgcgtgtaggtctcggtccaggatcatcgccagagcgaagcacgcctgcgtcgcattctccaatgcaatccgtcgattctcacccggcagaggtatgccgttgacaagcggctcatggtgagcgacccgattacgcagggcatgcactgtttttacgatatccagcgcgtactttctcgtccagcgttcttccactgcacgggcatactggcgcccattggagaatgtcttatcgagtcctttgcgccataaatcgttctcataatctgcacggcgctggtctggccacttcgtgtggattgttccgccgtcttccaagagattgcgccaaaatccgaatgtcaatgacgctatgagatggccatgcgtatgattttttcgctggtgcggggtgagatggttccacgcttcacgaatctggtactgggttcggtcatcgaattgtagccctgccatataccagtcttcagtgccattctgctccagagcgaggagggagagttgccggtccatgcggttgcgcagagcgacctcgaggatggcgatgtcgcccatacaggcgctggccatgtcgtgatcccacaggtacagctctagcgctgggcatgaacgtctttgagcctcataattgtaggtggcaagccgttcatcggtaatgcacgcgcgcagcgccttctcccgcggacttcctttccttggagtccgtgagaggaaatcagttgttgaatttgactgtcggctcatggctcattatgatatatcaagaattcccccaaagggcctctccggacggtcttcgactcagccgtgatgcactgggggtttctttttatctggataatcggggcttggttggtctgggctcttcttcaggacaatcgcatatgtttcgggagtgctcagctttcagacgaggcattcgaagaaatgccattccgaggaatcggcatcatggatgatgatcagcgtgccgccctcgttggttatctccttatgaggccggtcgtagagcgcatcgagctgtgttcccaggttcaatcgcagggtcgcatccgcttccttgattatgcggatgttctcctggggcagttggccactggagtaatccctgccgtccagaatggtgccgtcgacttgttctgggtcagcggcgaccttcacgtacccggtatccgtccccatgaaagctttcctcgtccttgctgacgattgcccgcgcatcctcggaaaatgagatcgagaacgtctgcgacagattcgaaaccggactatagccctagtatcgagtccatccgaaccatactcccgccactaccaacgccgcgatgcccaaagcgatgatcgttccggcccggccaccggcggaaggttcacctttccatacgcggtttcccatcgtcggcctcctagccttagccgtagggtctgctagatcaaagtgtgtattactgattagcgtgaggtcgccgccactacgtgagcggtcgaaaacctcatgccacccggcaaatccgagaagcggtcggagaactattcgaagccgtcagctaatccagtattgaacgtacgcgacgacacccagaaacgctcctatacccgctccgaggaagacgaatccccatcccaaccagtcagcaaatcgattgaccggggatttcgcaaagccctccatcaccgaattcgttccagtcgagccctcccctgattcatggttgtcctcctcggcatccctacataaaacccgttagtccaattcaactatatctgtttttcgccagctacaggagagaatcgactataactgatttccatgcgcttcttcagagaagacaagtctgttggacactttgatggactaaaggccagaacacaatggcgctagatgggacaaaaggtacattggtcctatggctaagcgcaaacatatcggcaccgtaattctcacgatactggtcgcggctctgctggcgtcgggcatttccggctggctgttctggcagtcggcgcaacgggtaatcggcgaggcgcagtaatccgtcgagcagggcgacttcaagcaagcgcttgagcagatgggcagcgctggcagtcacatcgtcacggcgcgtgatgaaacccaaggcatgccatggcaggccgccgaatacgtgccatattacggttcggacgtgaaggcggtgcgcggcatgctgggcgcggccgccgacgccgcgaccaacgccctgcccaaaatcgacagtgccgcgcagggcacgttggtggacttcaatatcgaagagctgctgtccggcatgaacttctccgacggcacgctgtccattcccaaaatcgcttccatcaagcaggacctgtccgacgccggcgtggtcttgaagcgcgtcaagacgtcgatttatgcgctgccgcaaccccacacagaacagatcaccgaaatggtcaaccagggcaagcaggtagtggaccaaatcgatgaggctttcgacaccttgaacaccatcgtcgagaagattccgggctgacgtcggtttgttcttgtcgtatattggcgtaacctccgcataaggctagtccatacaaatttatgtttaaatttgggataggaggtgccaatatgccgacacgcacaccaatcccggtcagtcgggcgatgcgtcagatatccgccaacctcgatttggcgcgcagacaacagcgcattcccgtagccttgctggccgagcgggctggattatccatgccaacggtcaccaaaatgctgcgtacgggtaatggcagctttgagaacttcctccgcattgctcgtctgcttggactgctggacggcgtacagcaagcgacggaccctcttaacacagatatcggcaaattacgcgccgacgaagacactccaaaacgtattcgatagtacagcaggaggcgcaacacatcatggaagcaatcgtcaccctgcagttcaacggcacagacgtcaccgtcgggaaattattcaccagtatcaggcgcggcatcgaatcggcacatttcacatacgatacggcctatatgcgctcttcaaacgcagtatccctctgtccagagatgcccctctccccccggaacgttcccggccgagcataatgcgatgcatcgcatctttcaagactgcatgccggatcgttggggcaggaacctcatgcttcgtgcagaacatcaagatgctcgttcggagcatcgcacagcacgcacactatttgagggagatctcttgctatccgtcaacgatgagacccgacaaggcgcattgcgcttctggaacaacgacggtgacgcgctagctcccagtgagaccggcggtccaagagaagtgaccattcagtcccgcatccatagcaatgatgagcagctgctttgaatccggcattgcgcggcttcgcgaagcaaacgcacaatgacttcacattcccgccttgcaccagctggctgcaatctgcgtatggtcatgtatctgtaggccggcacgaatgcggctgatgggtgcggcgaatcgtgacattgcttattacccattcgccccttcagtcgtaccattcgggtcgtcgcagttccaggaatggccgctgtttgcgcgctgctgcggtctgtgtgagatcgatgtcggcgataatcaactgttcttggtcgtcggccttgctgacgacgttgccgtacgggtccaccaccaccgattggccggcgaacgtcacatcgccttccttgccgacccggttgcacatgacgatggccacctggttctgcatggcctggacacggattttccacaggaacggcttcgacggttcggcgtcagtgttcggaaccgatgctcgccgtcggcacgatgaccaggcggcgccgcgcaacgcgcatgtgcggatgccttcacggggttcactcaaatagcgtcatccagtcgggatcgcggtgggccgcaaaacacatggcgatttgttccgcggtgtttcttgtttccgaaagccgcggcaaccggtcttcctcgaagtagcggatttccgtcgtttcgatgttggccgagaaccaaccgccggcgcggctgcacaatacgaagaacttgagcaccccgtacggataggtcagcgcgttgtgattggcgcagtcctgcaccgcgatgagtcgctcgcccctcacatcgagcccagtctcctccttgacctccttgacggcgttggaccgaatggactggttctcgtcgacccagcctccgggcagtgaccattccccgctgttctcatgcgtcatgaggatcctgccttcttcatcgaagatggccgcacgagtgtcgagtttcggcgtcggatatccggcgctgagcagtcgactcacctgtccggccggcgcatcaacctgcgtggagagcatgtcgaccgccatcgcgcggatacgctcgtagcgctcccggtcgaaggggtccttgcagtacatcagtccggtctgggccagcgcctgcaattctcgggcctgttccagtaacgtgcggttcgtggccatcatcgttcatcctgtcatcgtaaggtcttggatccgtttgcgctcaggcatcgcagcgtagtgcaagcagtatagcacttcgaaccgttccggggacgagggtctcagcgcatcccccgtaacctctcccatgtgccatcaacgcttggcgagctgcacgttcttgcgctgtctgcgattgcggctggcgaccgacttttcacgctcgcggcgcacgtgggcctcctcacgcgcggccgccgcgcgctcttcttccaaagacggcaatccggaggcggcgcgatgccggttctcccgctcatggtcgcgttcggccttgcgctccccgcctcggatccgggcgccggaaaccatcgcagttggcagagcgtctggccgaagttccacaggttattggtcagccagtacagcagcacgccgaacggcaaggtgccgcccgacaccacgtagatggccgggaacacaaacgcggtcagcttctgcgtgcggaactgcggtgaatccatggcgtccttcggcgtattgcgatggatgagcagccactgcatcgcgaacaacatcagacacatcaacgccacggccacgccgatgacgacgtgcgactgcggcgagacgaccgtgccgaacgagtcggcgatgcgcacgccgaatatggacgatgattcgatgtcgcccgccatgacgcggtcgatgccgctcaacggttccgcattcccggcggcgcttgcgggcagggattgcagcgtgtagaacagcgagcacagaatcggcgcctgaatcagcgaagcaggtatgaaccgagcggattggcgttatgccgctgctgcaaagccataatttcacgttgcatggcttctttggaacgcggatccttacgcgcggcgtacttgcgttggatacgttggatttgcggttggagcacctgcatacgctgcgtcgcgcgcatttgggagaagaagagaggcaatagacagatacggatgatgagcacgaggcacataatcgcgatgcctaagctgtgcggcaccgactccttctacggcggcggcatggtcaccggccagcccatcggcaccatgatcggctctcgcatgatcaacaatgcgcaagccggcttcatcatcggcgccgtgatcatgggcttccggattcgtggcgcttgacatctgacctcgcgaggaatcctcaaaggacatggaacgcaccaagatgacgctcaaggatctcgctgtctccttccacttcccgaagttctccacctcgcgtgacttctacaaggcgttcggctgccgagtgtgcatgttgctcagctaccagatgatctccgtgtaccaactctacatcgtcgaggattacgtgcaccagaccaagaccgaggctgccggcaccatcgccaccatgtccatcatcaccatggtcgtttccctgaccgcttcgctgatctccggcccgatctccgacaagatgcacacgcgcaaggtaccagtcatcatcgcctcgctgctgttcgcgattggcaccgcgatgccgtggatcatgccgagcgtcacgggcatgtacctgtatgcgggcatcgccggcttcggctacggcgtgtgctcggccatcgaccaggcactcaacgtcgacgtgttgccgaacaaggaagaggccggtaagggcctcggcatcctcaacctggccaccacgctcggccaagcagtcggtcccaccatcacctccgtggtcaagaccacgaccggcacctacacgccggcgttcgccatctccatcgtcatggccgtgtgcgctgccgtgttcgtgctgcgtatccagaaggtgaagtagccgctgcgagtgcctatctccgtttcaaggggctgattttgactttgcggaacatctacttccgtttcaaggggctgatgccaaagtaaccactggttaaaaacggcggaatagcgatagaacaatgccatttctatctgcgttccgccagttgaccagccccttgaaacggaagtagacctccggcaaacgccaaatcagccccttgaagctgattttgactcagcatcatgcagcgcagctatatcctcggtgcgggtatactattccgggccgtcacgacgacgcctatggaacgcacgcatggcaaagagagaaacatgagtcagcccgacaccgacacggcggcacagtcgccgtcctcgcaacaggaaccgcagattcagacggatggccgtcgaagccattcggaacagatgaatcaaccagcgcaaaccagccagtccgagtcgtcacatgatggcaaagacgagcacgccctacataccaacctgaagcgcggcatggaatcccgccacctgcagatgatctcattaggcggcgtgatcggcaccggcctgttcctgagctccggatacaccatccagcaggcgggccccatcggcacgatcctggcatacagcatcggcgcgctgatcgtctacctggtcatgctcacgctcggcgaactgtccgtggccatgccggtgaccggctccttccatgtgtatgccgagaagttcatcggccctggcaccggcttcgtgatcgcaatccagtattggctcacctggacggtggcgctcggctccgaattcaccgccgccggcctgctcatgcaacgctggttcccggacagccccacatgggtgtggagcgcggcgtgcatcattctcatcttcaccctgaacgccttgtcggtgcggctcttcgccgaagcggaattctggttcgcctcgatcaaggtgttcgccatctgcgcgttcatcgtcatcggatcgctcgccatcttcggcgtcatcccggtcgccggctaccaacatgccccgatgttcgtcaatctcatcaaggacggcgtcttccccaacggcttcatgccggtgttcgccacgattctgaccgtcaacttcgcgttctccggcaccgaactcatcggcgtgaccgccggtgagacgagggacccgcaaaccgccgtgccgaaagccatccacaccaccctgtggcgtctggtgctcttcttcatcggctcaatcaccgtgatgtgcgcgctgatcccgtggcgcaaggccggcgtgggcgaaagcccgttcgtgctcgtgttcaacggcataggcatcccctatgcgggagacatcatgaacttcgtggtgctcacggccgtgctctccgcctcgaattccggcctgtacgcctccacgcgcatggtgtggtcgatgggcaacgaaggcatgattccgcgctggttcgccaaaacgaaccgtcgcggcgtgccgatgctcgccttgtgcgccgcgatggccggtggcctgctggcgctcctgtcttccgtgatcgccgcctcgactgtgtacctggtgctggtggcgctttccggcctgtccgccgtggtggtgtggatcgccatcgcctactgccagatcgtgttccgtcgccgttggctggagtccggccattccaccagcgaactcaaataccgcacgcccggctatccgtacgtgtcttgggcggcgttcatcctgtgcaccgcatcgttcgtattggtgattttcgacgtggagcaacggttcgcgctcgtggccgagctcgtgttcatcgtggcctgctatggggcgtatttcctgcaacagtgggtacgcaagcgcaaaaaggcgaccgaggccgacgacctcgatacgctttgggtcgcgcgcgactgaacggctcgcgacctaccggcgcaccgctattcgcgccgtgaacgtgcactgatccaacgcaatgccagacccagcaaatccacaccgccacgattgcccatgatgtgggtttgagcgcggccggggagaacggcagcacctgcaggccaatgatgattaggccggcggccagcagcgaagctgagatgaccataccgaacttcttccagtcaaggccttcgcttgcctcttcggcactctgcggaatcgtgtcgaaaccggtgtagaagagcggcgtcatcaccagcactccgggcagaaacgacccgaccatggtaaccgcgccggacgtcgagccgatcggcagcagaaacacggcgcccagcacgaaggcgatcatcgcctcgaccgggccaccgccgacgatcatccagtcaccgaccagcagcacccatacggtgccgatgattgcgccgaatcccatggtgaagtagttccacaggctcagcgatctgaccatgccgccgtcgtcgccgctgccatcggcactactgtcgccgttgccgttgttaccatcctcgtgcacaggaatagcggcactgggcaggccagtcgattccaccaaactggccgtcatcgtgcttgacgggctgaatgccgtggatgcggcgaccatgaccgagcctcctttaattcggcctgactgtgatgataacgccgttcacgatatgccgtattatgaacgcagtgagagcccgcttcaccggccctattcggctcatgaataaacttcgcctatctgcggcactgaacacatgaccataatgcgatacacgtcacttcctgaagtacgtagtcgttatggaatcacccgcacgtttcccgtatcggagctgtgcgatagctgtgagacaggggggtcgtcagatttcggggggagggttccggaaacggtccgactgcaggatgcaccgggccgtgcgacacatgtcaacttgcgtattcacgccaaactcaattgagcaagccgattctcgtaaatggccagaagcggaacaacgccacaccttggatatcgtcgtatggcactagcccattgttgccgtcgtcaagatggtatcgagaatctctggaattggagcgattatcaccaagcacgaacacgttgccgtcagtaacggttacggaaaaaggactgtcgcttggattcacgccggacttaagataagcgctttcatcaatgggtttgccgttgaccgtgatgggctccccggatcccttgcaggtgacggtatcgccgggcagaccgatgacacgtttgattaggtaacgattgctgtcgattatcgacatcagattggtgggaagctgctccccctccatccagtctgcgggatctttgaacacgatgatgtcgccacggtgcagtgcaaagagtctcggagtcaatcgcgaggcaaatacgcggtcgccgatttgcaacgtgtcttccatgctacgggatggaatcacatagacgttgaacacgaaggtgcgtcccagcaacacgaccagcatcaccgcgatcaccgtcagcagatagccgcgaatttcactccaaacggagggctttcgcgcatgtctcctcgactgtccacgcgcttttttgctatgacaccccaccatcatatcctttccgaccggtaacgcaacaccatagtcctcaaaccatgccgttacctacgcccatgtttgagctcagctgtcacaccagcggttcgcgcacgtctagttcacaggcgatgccggtttccttgcgggcccattcggccgcctgcagtgcggcgatgttccataatgcgcacggcactccgccaaggtccggatgcgatgcccagaatgtgaggtcatcagcgtatgcggtgatgaccgattcttccgtgactggcatgatcgtgtggtacagacggtccgcaagcgtggccacgaattcgttggccgcggcgaacgtgtcgataagatgctgttcggcggtcaccggcgggccgaccagctcccaggattcgacgtccgtggcgctccaatgcgcggcttcgccgtccacatcgcgttgcaaagagacgaacagcctggcgaactcatccgaagtcagtcccgtaacccggcgtcgggttgacaattcaatcggagtcatcagataccgttcctttcgcttcgttcattccgttgtctcgctggtttgatttgctgccaaccggtacaaagcctatctcgcacacctcacgatagcccaaaccaccggcatggccatgattgccagccctacgaccagtgaccatgaggagccggcgattccggtcagattggtcatggcggcggagacgtcatacatgccatgagccacgatcggcggtgtaatcatgcccatacggcggtacagcagcacggcgagcactgcaatcagcacacgcggtggcgtgccgccggcacaatggccctatcgagcatcgccgcatgattcgtgcggtccacaatcgaggcagcatcggtttccattcggttcatgcggccagactatcgcccgttcttgccgattgcctgtaagcaggttcggatagactggcgcgagaacaatgcgagaaagaggcaagaatgacccggaaacggtcacaacagcacgacgcacaacgcaaaccgtcctggcgcgtacgctggaagaccatgagccgagccgtaggcatggaaatccgcgaacacaaaagctcattcgcggtctatgtggtgctgcgcatgctggtgctcgccatggcaatactccagttctttaacggcgactacgaaaatgtgttcctgtgcatcctgacgttgctgctgctgttggcgccggcgttcatccaggtgcagttccgcatcgagctgccttcggtgctggaagtcatcgtgctggtgttcgtgttctcggctgagattcttggcgagatcagttcgttctatgagatcttcccgttctgggacacggtgttgcatacgatgaacggcttcctcgctgcggcgatcggcttctcgctggtcgacctgctcaaccggtccgaccgggtgaagttcgagctttcgcccctgtatctggcgatcgtgtccttctgcttctccatgaccatcggcgtgatctgggagttcttcgaattcggcatggaccagttgttcgggttcgacatgcagaaggacgccatcgtgcattccatcagctcggtgatgctcgaccccacgcacaccaaccatgcgattcgcatcaacgacattacccaggtcacggtcaatggccaagacctgggcctcggcggctacctcgacatcggtctgatcgacacgatggaggatctggtcgtcaacttcatcggcgcggtcgtgttctccgtgttcggtttcctgtacgtgaagaaccgcggcaagaaggactccatcatcagtcgtttcgtgccacgccgcaagtccgccgaccgcgattatctgcgactggtgatcgatggcgggagcgcggctgatgccaaggccaaagccggcggtgccaacgctgacgatagtgctaacgccagtgcggccggcaccgattcagctgatgcagccggagccaaagccggcaatgccgacgccgctccgaccgtcatcgccaagccctgagtacgctctacagcactttcgaagcgtcgaaacggtagtgcccggtgaccgtcatgtgcttcttgaaggcgaagtagtcgttttcgcgctgccgctgcgccatgttgtgaatcacgtacggtgcacgccccgcgatcggccggcggatagccgccctgatagtagccggaatcgtaagccggatggttttcggcgtccttgcgcgcacccgccacgataggggctgcggacgttttcttggagaccgaacggaaggattttcgtatgttcagtcttgaggaacgagagcgtgcggtggagttgtatttcaccacgccgatgacgacggcccaggtggtggagcatcttcgttcgaatcaaatgggacaagacgaacataacccggaacgttaagccgggaaaccacatgggacacggccagccaccaagaccccgaaccgttccccggcttaacaacaaacccggcttaatccgagttaaaccgatgtcggtttaactccgaccgcggctgccactaccggtgggacgaatggatccgcatctgcgaggagcacgggctgatccggtcgatgagcgccaagggatgcagcccggacaacgcggccgccgaggggttcttcggcaggctcaagaacgagttattctacgggcgggactggaggggcgtgggctacgaggagttccgcgaacgcctggccgcctacctgacccactacaatgaaaccaggatcaagaagtcactggactggatgagccccgtgcaataccgcagaagtcttggactggccgcctgaccgtccaaaaaaacatccgcaccccctccgtgcgatcatggacgatgcgctccgcctgcgccatcgcatgattccgtacctccacaccatgaactggcgcgcatcccggacaggccttcccctggtggagcccatgtattggggatcgcccgacatcgacgccgcataccacgttcccaacgaatacatgttcggcaccgaactgctggccgcgcccatcacggaaccgatggataaatcctcccgacggggcaaggccgacgtatggctgccgcagggcgactggttcgacttcttcaccgggcgccggtatagcgcgtcttcgcccaacggacggcgcatgaccgtctggcgtccgctcgacggaattcccgtgttcgcgaaggccggcggcatcgtgccgatgcagcccctgtccgagggggattccatcaactccgtcgacaacccgcagcatctggagatcatcgtcttccccggagcggacggcgacttcacgctgatggaggattcgggacattactctcggcagatcaccccggcgaccaccgcgatcacctatcgatggcgcaaggacggcgccacatccgcactcacggtatcgccagcccagggagacgttcacgctctgccggcccggagaacatgggatttcctgttccgaggcattaccgacagcgacatatccgtacaggccgacggcgcatccgtcgattcggatcgccggtatgatgccgaaaccctcacattgcaggtaacggtcgccgacgtatccacccgcagcgagatacgtgtcaccatcggcgacacgacgatggccgccgatccccgcatggaagacgtcttcgacatccttcggcatgccgaaatgcgatatctgaccaaggaacaggcttatgccgccatagcggagaacggcatcgacgcattggccacgatggattcactcgagcacgtcagcgggccggacatggaagattgctccgattcgcatatgccgagcgccgtccgtcaagcgctgacggaggtgctgctccaatcctagcccgcatgtcgcctctcccggaatacgccacgggagaggcgacagcagcccgtcacagacccatgtccaggcgaacgccgggccgtcaacacgtcgaggcacgacgcaccagatcgtaggaggtcacatacgtgcggaacggatccgccgacccctcgatgcgcgcgatcagcatatccacggcatgtcgcgcgtaatcatccacatgcgggtcgatcgtcgtcaatccgggcatgcagtactcggcatccggcacgttgtcgaacccaatgacctgcatatcctgcggcacgcgcacgccgcgccgctgcagctcatgaatcaccccgatggcgagcgcgtcgttcaggcacatgaccgcatccggacgcggcgcatccggatcgtccaacagccccgccaccgcatcgcggccgccggactgcacccaatccgcgttacggaccagccgccaatcgacctgcaggccacgctcctcatgggccaacacatagccgcgggtacgcatcgtgctggtggtttcgggccgcgactcgcggtcggcatccgggcatgcgttctccgcggtgccgccgatcaacgcgatcctacggcatcccgaatccagcagcgcccccaccgcggtgcgtacggcctccacgttcggcatcgtgacccaatcggccagtccctgcgtatcgtaatcgcccacaatcaccaacggatacggctggtgcagtatcgtgcgatccgtgatcggcgagcccatgaagaaaatccagccgtccgcggccagcttcttcgtctccgggatcgcctgcgccaagccgccggcgctgttgtaggtatcggtgatcaccgcgtacccgcgggaacgtgccgccgccacgatgctgtcggcgagatagggcatgaacggctggcagaaatcggtgatggccagtccgatgagcttcgtgccgccggttttcatggcgcgggcggacacgttaacgcggtatccgaggcgttcgatggcatcctggacacgctggcgcgtctccgggcgcatactgccggtgttgttcagcacattcgacaccgttttgatggagacgcccgtctcgcgcgccacgtcggtgatggtcacccgtttcgccacagcacccctctcgtcgcaccatcgggcatgttccgcacggttcaggcggaacgcccgtctgattccagcataacgcgttttccccggccggtccggtcccttccgcccggcccgggaagcaagggccgtgcgatccgtccttctccggaacggaccgcgcggcccatcgcgtcacttgatgtgcagggcggtccaactcaccggcggcagggagacgcggaccacgccggactcggcatcgtacatggccgacccgttggcgtgcggggtcacacggttctggtcgtagagcgtattcgcggcgaacagatcgtcgtcgtgcagcgtctgcgcctcgacggatgccggctgcgcgccgtcctgcagcctgatctcgaactcggcggtcgcctcgagcgaacggttcaccgcaaacacggcgagcgagccgtcggcgcagcgcacggccacggcgttcacgccgtcgacctcgccatagcgcggcgtatccacggtgccggcggacagcttcggctccagcacggtgccgcccttggccaggcgcgcggtcacggagaacgggtggaacgtggtctggcgccaggccgggccgcccggctccgtcatgatcggggcgatgacattgaccagctgcgccaggctggcggcgcgcacgcggtcggcgttcttgagcagcgtgatcatcagatcgccgaacaccacggcgtcggcggcggtgtagatgtcctccagcagacgcggggccaccggccagttgccgatgccctcgggggtcttgctcggctcctcaccctggtaccagacattccattcatcgaacgagatgtacacgtcgtgcgcgctcttcagatgggccttggtggcgtcgatggtggcggccacgtccttgatgaagccgtccatatccacgccggaggccaggaagctggccatgtcgcgcgtgccgtcctccttgaagaacggctggtagtaggcgtggcaggagacgaagttcacgttctcgtaggtcttctcaagaacggtctgctcccacttgccgaaggtcggcatgccatgggcggaggagccgcacaccaccagttccacgtccggatcgatctggcgcatgccggcggccacggaggcggcgagcatgccgtagtcctcggcggacttgtggccgagctgccacgggccgtccatctcgttgcccaggcaccacatgcggatatcgaacggcttgtcggcgccgttggcgcggcgacgttccgacagctcggtgccgccgggcacgttcgcgtactccagcaggtccagggcctcctgcaggccgcgcgtgcccaggttgacggcctccatcagctcgttgccgccggtggcctcaagccattcggccatctcgtgcaggccgaattcgttggtttcggtggaatgccaggccagatcgagtcgacggggacgttcctgcttggggccgatgccgtcctcccagcggtagccggacacgaagttgccgcccgggtagcggatggtggtggcgccgagttccttgaccaggtcgatgacgtccttgcggaagccgtgctcgtcggcggtcgggtggtcgggctcgtagatgccggtgtacacgcaacggccaaggtgctcgacgaacgaaccgaacagacgattgttgaccggagcgacctcaaaatcgtcatcgacgacgagacgtgcggtcagatggtcctgctggggcatgggattcctttctacatatctgcatgcactctgcatacgtgacacgtatccatacaacgatgtaccgcggaggcgcgggcgaccggggacatccatgtgacagccaccagtgtagtacaaccttgtactgactgccggaaggcgtggcgcagagacggctgagaccttttggcgcaccactgcagcaaaaaagatcccaagaagtcgaattacagtcccatccgacgcatagccaccgtgaacatacggcaaaaggcatcaaccacgtcacccgtccacccgctacattcacaagcagtaccgcccactctgcatcattcgcatatgcaaaggccgcgaaccgtacgatgacggttcgcggccccctgacatgccattaggccacccggctcgcaccggctgttcggcctgccggctcagccctcgcgcttgggcgcctggctggccacgcgggtcaggcgcggcgggcggcgcgtggacacgaacagcggctgcacctcgaccagcgggttgtacggcgccaggccgaaccacttgaccggggaaccggccacgcggcggatcgcgtacttgatctgcagcgagagggcgccacggccggagaccttcgactcgggcatcagcgccttgtggatcaccacgtagcggatggtgccgatgccgggatcggcgtcaagcttcgggtagatcgactgctggttcggcagctcgccggtcttctccagatcgtgcatgatctgatgcaggtaggccgggatggactgcgagaccttgaagccgaggcggatgcgcacacggaacaggtagtcggtaccgaagctctcgaccgaatactcacgggtgaacggctcgtcggtggtctcgacggccaccgcccaccatgcgcgggcgcgcttggggtggtcggcgaagatcgagaagaagatgtccgtatcgagacgcttcaggtccggatcgctggtcaggtagacgatgttgtccgcgaaccggtggatgcggctatcgccgtgcagcttgtccagcgcggggaggaagtccttcggcatcatgtgccgacgctgcgagcgctccagcttggtgccctcgttccacgtgtacatgatcatgaggatcgccagcgtgagcagcagcgtgaaccagccgccgtgcaggaacttggccatcgaggcggcgaagaacaggacctggatcgccaggaacacgatggtgaacacaacggtgccgaacttgttgctgcggtgccacaggtagatgcccagcaggatcgtggtggtgatcatcgtgatggtcagtgccaagccgtaggccgccgagatatgttccgaatcgcggaacagcagcagcacggccagcgtggccacgcacagcaccacgttgacgaccggaatgtacagctggccgcgggtacgggcagggtaacggacctgcagatgcggcatccagttgaggccggtggcctcggagaccatggtgaacgcgcccgtaatcagcgcctgggaggcgatgatgccggcggtgaccgacagcacgacggccacatagcgcacgttcggatccatcatctggaagaacgggttgatcccctcggcgtcggccagttcggggttgttctggttgcgcagcatccacgcgccctggccgaagtagttgagcaccagcgccaccttgatgaacggccaggtgaagtagatgttgccgcggcccacgtggcccatatccgagtacagcgcctcggcgccggtggtcgaaaggaacacggtgcccatcagcgccagaccggtggcgttattcggactgaacaggaacttgatgccgtagtacgggttgagtgcggcgagcacggaccagtcgttgccgatggctaccacgccgacgatcgccaggaacgcgaaccagaccatcaccaccgagccgaagaccttgccgatcgattcggtgccgcgcgactgcacggcgaacaggatcacgatgatcaccgcggtgatcatcatcgtcagatccttgttctcggtgaacagatgctccaacgccggcagcgtcttcaggccttcgacggcggacgagatcgacacggccggcgtcagcaccgagtccgccaggaaggccgcgccgccgagcatggccggtatgacgagccatgcgccgtatttgcgaatcaacgagtacagagcaaagatgattctgcagaaacggacatccaaacatcccaattcacatcacacatgaccgattctccagaatcggacacacagaacacatttttcggaactcagacgtccgattcggcagaatcggacacatgggcacaagtcggatgatgagcacgactatcgacgggcgttcgccggttgtggacgccgctgaaatcgatgcgatccacaccgggcacacgcatgaagacgcacagtatcaacgcgtggtatcgcctggcaccagtgtcatgggaataagcacgttcggctcgaacggcttggggatgttcttgcgtgaagcgttagccgcggccacttcctcattggcaatcgcctgcacgatatggtcggccgccgactgtgcgatcgccgagaaatcctgcgcgaccgcggtcagcttcatgccggccaaatcagtcaaatacgtaccatcgtaggcaacgatctgcagctcgtcaggaatggaaattccacggcccaacgcttcgcgcacgcagaacgatgcaccaatatcggaactgaccacggcatcgacgccgtcggtcgtcaccttgtcgagcgcattgctgaccgcacgatgatagccggcaaaatccatcacttcgccagcttcaacatactcgtatttcacgcctgcggaggtcaattcctgttccaacgtgaggtagtagcgcaccgtcgggaacgtggtctttcccaaatcgaacggtccttcctcgacttctccgcgcgcagtcaaatcgaagaattgatctcgcggaccgccaatcatcaccacatgtttggcaccattgcggatcagcatctgcgcaatcaatcgcccaccctgctcgtggtcggatccgattgacgaaataccgtctccaagcacacggtcgaacgcgacgatcgggcgatgaatcgacgtccaataatcgccgggatgcgaagtgtgcgcacacatgacgatgccgtccatcatgtgccgacgcaacatgtcgacatactggatttcgccgtccgcctcatctgcggtagagcacagcatagtgcgtaatccttgcgcggcgagcgcatgctgcagatgtgcggtaaacgtcgcaaagaacgggtggcggatggtgggcacgatgacgccgaccagattcgtgcaatcatgatacagattgcgggcaagctcgttcggcacataattgagggcttgcatggctttgcgcacacgttcgcgcatgtcatcagacacgtacccgttgccgttcaccaccagcgagacggtgctcagagacaccccggccttcttcgccacatcgcgcatgccgaccatgatcgcaccttccccgtcatcactgttctatcgttgtatgctcacgtgcttaccacgaaatattacattcatttacattctctcgaacctgttcgacagtccggcaacgaaatacagcttcttagtgtcgactcccgcggaggcgaaggccttcagcagcggcttggtctggtcgaatgcaatcaccagcgttgcatccggactggcggccttgatggcggttgcgctcagatttctttcacgttactcagcgaccgtccgtgtaacgtgaaaattacgccggattggcaagcagcgcaatgccgaaaccggcggccacacaaatgagaggcaccgcgacggttgctattccatagcccagagccagcgtaaaacgacgctggcgaatcaatgaaaccacttcgttgagcgccgtggagaatgttgagaaaccaccgagaaatccgacaacgaacatcatgaccgtgtccatatccaccgattgcgaatagtaggacatcatggcgatgcccgcgcatagcgaggcgacgccgttgatgacgagcgtggatagcgggaagttgcgattcgttcttcgattctcgcggttccagccttgttgaattgacacgtcgagcacgtaacgggccatggctcccagaccgccgaacagacagatcatccacatcatcagcgcacctccccggtagtcgggtcggcgacaagcgaaatctccgcagtgatcggtttgggctcgaagctgggtggaagcgggttggccggctgctggattggctgcgactgctgctggggctgctggattggttgcgactgctgaatcggctcgggcagctgccccaagtctgaagtatccggctcgcgcaacaacggctgcgatgactgtgtcagctgaggaacgaccagcggaggaatctgcggaacgcggcctgtctgcataggctggctggcggtcggcggcacggttggtgtttcgactcgcggaacctgtcccgtctgtgcaatctgctgggccgtctgcgcggcttccattgcggcctgcgcggcagaacgcgccacgtcggccactttcacatggcgtacgccctgcgtgtccgattcggcagaatcggacacggaaacagctgaaaacgcaccccgaacccgctttcgagtactccgtgacagcagtgcctgcatcagaaccacgccggcggcggcagtgagcaaaccgcctgcaaaatttcccgcaagatagccaagcgcactggcgatatgccgctcgtgcagaccttccatcgtttccagcatcacgccggacatcgtcgaaagcccgccgagcaagccgagcccaacgccacggctgacaacctgccgcacccggcgacgcagccacgaagcggtcgccatgaattcggtcagcatcgcgaacaggaagcaggcgaccatattcgacacaaacgtgcccacaacgaatggcgtcccgctgaccgacggcaggagcatatccaacgcatgccgacagccgactccaacaaatccaccgacgaacaccacaacatacatcagtccgtcggcgagcggattgaaccgcgcctgcatacgtttcatcggcgccaggggaatcgtaggcggatccatggtgttagcggcgggcgcggttgcaccagcatgcatcacctcaacagtgtcgattgcctgcgtgatgggatgtgagtcctcacccgcagtcaccacgtctcccggcgattgttcttgcgattccattgcgctccccctgtactggccttccgcggacagcgttgttccgcccataggccgtgcaacaacgagctgggccgcggttgccgccttcctaacgcatatgagtttacacggagcgccaacgtatgcaccctggatgtccgattccgcagattcgtacatccagagtccagccgaattcagccaggctcagtcaagccgggcatcacacagccgccgcatcgcaggtcgcacctcgcgctcctcctcgccactgaacagcaccaccagatagtcgccggcacgcagccgtgtatcgccgcgcggcacgatctcgctttcgccgcgacgcaggccgatgatcaggcacccagacggccaacgcacgtcacgcacccgcttgccgtccgcaatcgctcccatttccaatggcagttccataatgccgctgcccacatggcttgcgatcgccatctgcatgccttgcgcgcgcacgtaccgctccagcaactccccataaatcggtttggtgcgcagcaaatcggacaccaacagcgcgacgaaagcgacggccgcgaccggcagcatgtgcgtcaacgttccagacatctccacagccaacagaatcgacgtgatcggcgttttcacggacgcggcgagcgtgcccgtcatcacgcacaccgcaaacaccgccactgcgtcggatggcagatcaccgaatcgatgcaacacttcaccgcagatgccgccggccaacgaaccgaccgcaagaatcggcatgaaaataccgccaggcgcgcctgagccgaaactcgtagatgtgaacagcatcttcgccacgaacagcagacacagcattcccaagccgacgcgcgcatgttcggcggtatcaatcagattcgagccgccgccgagcacatcgggcaaccagatgccgacaggcaacgcgatcgcaatcgcaatcaccgggcggctccatgccggcagtttgccgtacagcgtctggaagccaagcaacgagcggttcatcagcgaaccaaccaaaccggccaccaatcccaacggaatcagccacacatactcttccaacgacagctgaccgatatcaccgaaatccaaaaccggacgcagaccaaaacagtattttgagacgaaatcggcggtcagcgatgcggcggtggcgcccatcagaatcgcaggggaaaaactccgatgcaccccttccaaagcgaacatcatgccggacagcggcgcgctgaacgcggcggacaagccggccgcggcaccggcggtgaccagataatgctcctgcatgtcctcacggcggcggccgcgcaaacggtgggatacacactgcgcgcccgacgcaccaatctgaatggacggcccctcacggccgagcgacagaccaaacaacgcgcccaacagtccaccgacgaaacggactggcagaatcgtctgccaacgcatcttcaagccgcatatcaccacgccgttggtctgcgggatgccgctgccaccagccatcggctccttgccgaccatccacgcgatcgccagcgcggccgccaccgcggcaaccgcccacggcgcaatcagccacggggtctcgcgaatccgcgcatatatccaacgggacgcatccgtgccgtattcgatgccgagacggtatacgacaaccagcaatcctgaaaccagaccaatgactatgccggccgccgccatcttccacttcaagtggtcgaatcgcggaatcagccggcggatatcatgtgccgcgtcgttaccagtcaagccgggaaattcgttgcagacggtcagtcgaccagcgaattgatctggatgacatgatcgcgctgcggaccggtgccgatcacggagatacggcagccgctcagctcttccaaacgcttgacgtaggcctggcaggtggcgggcagctcgtcgaaggagtggcagtcggagatgtcttcgtcccagccgggcatggtctcgtaaatcggcttggcggcggcgaaagcggcctgatcagtcggcatatcgtcgtgacgttcgccgtccacgtcgtaagccacgcagatcggaatctccttcaggccggtgagcacgtcgagcttggtgagcacgatgtcggtcaggccgttgacctgggaggcgtaacggttgacgaccgcatcgaaccaaccacagcgacgcgggcggccggtggtcacgccgaactcgtggccctgctgacgcagccattcgccggactcgtccagcagttcggtggggaatgggccttcgcccacgcgagtgacgtaggccttggagacgccgactacgcgggtgatcttggtggggcccacgccggtgccggtgcaggcgccgccggcggtcgggttggaagaggtgacgaacgggtaggtgccgtggtccacgtcaagcatggtggcctgagcgccttcgaacagtacggtcttgccttcgtcaagcgccttgttgagaatcaggccggtgttggccacgtacggcttgaggcgttcgccgagcttcagcagctcctcggtggtctggtccacgtcgatcggacgacggttgtagagcttgaccagcatctggttcttctggtgcaggctggcctccaccttgtcgtgcagatggtcggcgttgaacaggtcatgcacgcggatgccgacacggttgatcttgtccgcgtaggctgggccgatgccacggccggtggtgccgatcttgtgcttgccaaggaagcgttcagtcaccttgtcgagtgtgcggtggtagggcgcgatgatgtgcgcggcctcgctcaccttgaggtgggagcaatcgatgccgcgggattccaggccgtcaatctcctcgaagagcacttccgggtccacgaccacgccgttgccgatcaccggggtgaggttcgggttgatgatgccggagggcagcaggtgcagggcgtacgactcgtcgccgaccaccacgctatggcccgcgttgttgccgccgttgaagcgcgcgacgtaatcgaccttggtgccgatcagatcggtagccttgcctttaccctcgtcgccccactgagcaccgataagaacaattccaggcatgatgcacctccgcattcgcacgattccgccggaaacagactaccttacaccctctaccctgcgaagtttcgtctcacgcagggcgaggctgggggtgcgacgacccggaatgggtgacgaatttctactcgtacgaggcggcgctgtgaccaatcgcacaagcgcacaggttgaagaacggggcctagcgggcatgcctcgcgcgataatgaagccatgacgatcgcaacaccggaacgctatgccgaaatgctcgatgccgcccgccgaggcggttacgcctatccagccatcaacgtaaccagctcacagacgctgaatgccgcattgaagggcttcgcagacgccgagtccgacggcatcatccagatttccgtgggaggcgcggcttacgtctccggcataggggtcaatgatcgcgttaccggctcgctggcactggcggctttcgcacatgaagtggctgcgaaatacccgaacatcaccatcgccctgcacaccgaccactgcgccaagcagtatctggatgagtgggcgcgtcctctgctcgcgcatgaggccgatcaggtggcacgaggccaggagcctacattccagtcgcatatgtgggatggctccaccgtgccgctcaaggaaaatctggacatcgccgaggaactgctcgacaagtcgcagaaggcgcacaccgtgctcgaaatcgaaatcggcgcggtcggcggtgaggaagacggtcactccgccgaaatcaatgaaaagctgtattccactccggaagatggcctcgaagtcgcccgccgactgggtttgggcgaacgtggccggtacatggccgctttcacattcggcaatgtgcatggtgcctacaagcccggcgtggtcaagctgcgtccgtcgctactcggcgacattcaggcgcgtgtggcgcgcgcggtggccgaaggcgagttgcctagcgcggccggcatagtcgatttccccaacggcaagccgtttgagctggtgttccacggcggctccggttcacgcccggaagaaatcgccgaagctgtaagctacggcgtgatcaagatgaacatcgacaccgatacccagtacgccttcacccgtccaatcgccgaccacgtgttcgagaactacgacaaggtgctgaaaatcgacggcgaagtgggcgagaagaagttctacgatccgcgttcttggggccgtaaggctgaggattccatgtccgcccgcgtggtcgaggcttgccggcagctgggttccgcgggcaaagcgctcaaatagcgcgtagttttgcgatcgtgcgcgacactttcccggaaataatgaaaatcattgaaaatcaatggagcggacaacgggagtcgaacccgcctctaaagcttgggaagctttcattctaccgatgaactatgtccgcatgccttacggctgctgcacctcacgtgacgagcatgctcagccaaacgaggcacgaatagttatcctagcacgtcacctgccgacgcgcgtggagtaggtgggcggagcgatcggcgtgccgttcatttcgttggccatctgcatgagacgcgctatgcgctcatcggtcggcggatgtgtggagaacaagcgcgagaaaccgaccgcggagaacgggttggcgatcatcattgcggagacggactgggtgccggcggttttgcgcatcggcgcggcctgcgcgccgtaggaaatcttgttcagcgcggaagccagggcctcgggatcgccggtgagcaagctgccgtcttcatcggcgtcgtattcgcgggtgcgggagatggccatctggatcaaagacgcggcaatcggcgcgagaatcacgctcagcaatgcgccgatcaggccgaggccaccggaactatcgcggtcgtctcgcgagccgccaccgaaatacatcagcgaatagcccagataggagatgacagtggccatggcagaggcgatggcggaagtcaggatgtcgtggttgtacacgtgcataagttcgtggcccagcacaccacgcagttcacgggcgttgagaatctgcaggatgccttgggtgcagcagacagccgcgtgccgttcgttgcgtccggtggcgaaggcgttcgggctcatggtgggggcgatgtagatgcgcggcatcggcttgccggccttggcgctcagttcacgcacgatctggtagatttccggggcttcctgttcgctgacttcccgcgcacccatggaggcgatggcgagtttgtcggagaaccagtaggtgccgaacgtggtaatcaggccgatgacgatatagatgctcagggtttgccgactgccgcccgtggcccaccaaatcagcatgatgatggcccacatcagggcaaacagcagcgttgtcttcaggccgttgaaatggccgtgcacccgtactttggcatccataatgcacacactaaaatcgcatgctgaatgattgctggatatgcgccgcgagaaatgtcccatattcgcccggcccgtccggccccgagcccggccgcgtccgcacggggcgcggccgggtggacgaatgccggacgaatgccggacaaatgccggacgggcgtgggcgggccgtcaggcgtgggcgagctcgcgcatctggtcgggctcgatgaccttcttgtgctcgcggccttccttggcaccctcggcgcgctcgaaagcgtcgaccttcttccagccggcgaagtcgatcgggcgaatgccgcgctcggccagcagtcggtcgatggattcggggtcgcggtcggctgccacacggccaccttcagcggccttggccagatcctcgagcatgttggtcacgatggcgagcgcatcggacttggtggagccgatcaggcccaccgggccgcgcttggcccaaccggtggcgtacaggcggtcgcgcacttcgccgccgtcggcctcggtggtgatgcggccgtcgccgttggcgttggccaggtgggcgccgtgctcgtcgtaggcaatgccgggggcttcggcgggcttgtaaccgatggcgtggtagacggcctcaaccgggtagtcggtgaactcgccggtgcggtgcatcttgccgtcggcaccggtttcggtgcgctccacgcggatggccttgaccttgccgtcctcgccgagaatctcggtgggggcggagttgaagtgcacgtagtactttcggtcggccgggttgccttcgaagtcgacgtcgccgtcgtcttccatgtcttcggccatctcgcggatggcgaacagctcctcgaccatctggcgggtgagcttgtccttgccggccacctcgatggtctcgtcgtccagatcgaagtcgtcctcgttgatgatgagctgcacgccgggcagcttctccatctcgcgcagttcctgcacgctgaacttggcctgggccacgccacggcggatgaacaggtggagcaccttggccttgttctggccgatgccctcgtacacgttgtccggaatgtcggtcttgaccttgaggtcgtcggcgttgcgcatgagttcgcgggccacgtccatggccacgttgccgccgccgattacggcgacgttctcggccgtaagcggccattcgcgggcaccggtggggtagccgtcataccattcgacgaacttggcggcgccgtacacgccttcaaggtcggcaccgggcaggttcagcggcttgtccttgaccgcgccggtggcgaacagcacggcgtcgtaacgggccagcaggtcgtcaagagtcacgtccttgccgaattccacgtcgcagtagaggtggatgttcgggttatcgagcgtcttctcaagcgcggaggcgatgaacttgatggacgggtggtccggggccacaccgtaacgcaccaggccgaagggcacgggcagcttctcgaacaggtcgatgcgcgcttcggtgccgaggccgagctcttcgcccagcttcttgagctggcgcaggaagatatcggatgagtagacgccggccggaccagcgccaattacagcaatgcggagttcagtattcacagattcagtcacgcgctctagcctaacgcaaagccttccgttgcaacagagggcgagtggtgggaattctgtgtattaggccatagtttgtgcgtttgggaaacctacgagcactgctaatgtcagattatgggtttccctattggtcaagttattgccgttctcattccaagaagcatgcaaggcggatcaggcccttactccggatacgtttatgccgcaaggcggttatccacgcatttatgacacgagaatgccgctcaatctgttcttctcgaactacatcgacacttatatcgaacgtgatgtttccgaatatcttgatgtacgcaatttggctgaattccgccgattcttgactctttgcgcactcagttccggagcactcataaactacaccaacatcgccaatgaacttggtgtaagtccgcgaaccgtaaaggcatggatgtcgattctggaatcaagttacatcgcattccatctcatgccgttctacacgaacgcacgcaaacaggtggtcaaaacgccgaaactctatttttatgacactggcttgctgtgtcatctcttgggcattcggacggtcgaagcactggttgcgcaccccaagttcggcgatatatttgaaaacctcatcattgcggaaaccatgaaacagcatttgaacgccaatcaggagccacaattattcttctaccgcgatgccagcaaggtcgaggtggatttgttggatttcaccgatcctaacaaccgtatgctcatagaaatcaaatccggacaaacctatcatgaccggttcgcccgccatctcactttaattggcaatgttctcggtataccgtgtgagcaacagtacgtaaccagtcgggttgagcatagttatgtctcacaaggaatccgcgtcacctccacccctcgattggctagaaggccgacggtaaagagccgccgcagagcagtaggaattctgtgcaatcagtgaatcccttgaggcattaaagacgtcacctccaacggctctttacgacctcgattgcattcattaggtcatttcttcgtccattaggtcggagggtgctgaagccatcccttggaacggcggggtttcaagggccgctccgaccaaggaccgacctaataaacgtcaaatcgacctaatgaataactccgatgctattgctgctttcgtgggcgggatttccgtttccgccacgtcaccaaccgtatcgccccgattatgtttcgatgcggtggactcgacatacgaccatcccggtcagtcaactgacctacaaaaacagcagaagcctcatattcttaatcagtcccgatcaattagggcagtgagggcccagaggatgctcaccacgtcgatggcctcctggaggaaggcaccgacgacgaccgggataaggttgaacgcggcggcaatcatgccgatggtggcaagcacaaggcccgcgattacggcttgaagcatcacgcgcttggtgcggcgtgcaatggcgatggcgcgcggcacggcggcgatattgtcattcataatgaccacctgagcgctttcggaagcggcggtggacgtgccatcggtcatggccacgccgatatcggcaacagcgagcaccggggcatcattcacaccgtcaccaaccatcatcgtgacggttttgccggctcctgtagcggccctgactgcggctaccttatcctccgggaacagttcggcgtgaacctcgtcaatgccgacttcgctggcaatgatattggcggaagcccgcttgtcaccggtaagcatggcgagctcggtgacgcccaactcatgcagtttggcgagcactgccttggcgttggcacgcggcacatcgcgcagcacgatgcgcgcgatcagccggccgtcaacggacacgtaggacgccatctcatccggctgcagcaggccaaagcgagtgcgcaggtcatctttttgctgagctccccctcttagggggagctggccgcttcgcgggctgaggggggcagcctcgccgaccgccaggaatccatcctccccagcagccgcgaaagacagccggccaacgcgcaccgcgtgtccgttcacctcgccggaaacgcccttgccggcgtcttcattgatgttcttgacgaccggatactcccggccatggccaggccagctggcctccggctctgggcacaggcgctggccatcctcgaaccgctggcgcagtcgggccagcgcctccgcgccggccttggcaatgcctttggacaggatgtgcaccgagtagctttccaccgcgccggccatcatcagcacatggtcttcgttgagacgggttgcagcgccgggcaacatctcgacgcgcaccacctgcggctgcttgacggtgagcgtaccggttttgtcgaagaacacctgcgtgacgcggccaaggttttccagcacgtcctgtgctttgataagcacgccggctgcggcgaggcgtccggttccggcgatgtatgccaccggtgcggcgatgagcagcgggcagggcgtggccagcaccagcacctgggcgaatcgcgtcggtaccccggacaccgcccatgcgacgccggcaatcaccaacgaaagcacggtaaagggcacggccaagcggtcagcggtttttaccacggccgggcgcgactcctgcgcggaggccacgagctcgaggatgcgctggtactgcgaatcggcggccacctgggtggcacgcatggtcaatgcagtcgagccgttcaccgccccggacatcacacgggcgccggcgaacacttcacgcggcaccggctcaccgttgatattgctcaggtcgagcgtggccgtgccggacagcagctcgccgtcaaccggcacagtttcgcccggcaacaccatgagtacgtcgcccagctgcacctgctcgaccggcaccgtgtcgaagcggtgcgcggcggcggcagccgatgccaagcccacacgccggaagccatcggacgaatcgcccttatcggcagcaaacccacgccccacgccaggcaggttgacgacgtgcgcggtttgcggcgcggcctccatcagcgcggtcagactgcgctcggccttggcttgagcgtattcctcaatggcctcgccggacgtgatcatcagcgtcaccgcccaacttgcccagtattcggcgacggccacggtggagaggatcgcgaccacggccagcacatcgactccaacctgcccatgacgcaaatcgtcaatcatgccgcgcacagtgtcaatcacaataaccagcaccagtgcgataaccagccactggccgaaacccggattgccgagtaccggaatcgccatcgcattgccccacggacgccaatcgcccagtaaagccaacggaattgcggcgatgacgacgaccggaagcatcggcacaagcttgcagatgtcgagaattttggtgaagaatctgatgagtctgctcatcattgctccttacgctcgtatacggagtcgattgcggtacggtaagcgtggcccgcgcaatcggcgctacggtcacgccttgttaacccaccggcggctttgcctggggcttcgctttgctcggctcccgcgcgaccttccgatacacggcgtaaagaaatgtattcagttttgtattgaattatgcgctgtgttcaggacgtcgcccgaactcagtgcttggcctaccctatcaacgagcgttgcgcgacatgccggatatcgaaactgcgttggcggcatgggcgcggggcacaatcgcgcatacgaaaggcccgtggcaggagtttgctcactgtcacgggcctttgcttgtccgacacggtgttcagcggttaccgctcaacaccgtgtgacgttgtcgagtcggctttaccacaggccgaacgggtcggagaagccgccgccgtcaccggtgccgccatcgctgttgccattgccgttaccgttaccgtaaccgttctggccattgccattctggttgttctgcttattctggctgttgccgttggaatcggagctggacgagccgttcaccgacgactcctcctgatcgagcgtcacgtccacatccatggtcttgccgtcgcgcacgatggtcagcgtcaccttgtctcccaaagccgcggcacgaacgtaaccaagcagcgagtagttgttgttcaccgcgttgccgttgaaggccacgatggtgtcgccctccttgagaccggccttgtcggccgggccgccggagacgaccgcgctgccggtggcgctcgacttggtgatggtcgcgccgccgcgggtcacaccgtcggcttcaaccgtgtcggacttgatgaccacgccgagggcaacgtgcttgaccttgccgtccttgatgatttcgtcggccacacgcttgacgaggttggacgggatggcgaagccgatgccgatcgagccggcggagtcggaggaagttgcggtagaggcaatcgaggagttgatgccgattacctggccggccgcgttgaaggtcgggccacccgagttaccggggttgatggccgcgtcgatctggacggcgttggtgacgatctcgttgttgttatcgtcggtcacggtcaccgggcggttcagggcggagacgatgccggtggtggcggtgtcgtcgtagccgagcgggttgccgatggccatcacgttctcgccgacggcgagcttgtcggaatcggcgaatttcacggccttgaggtcgctcggcgggttgtcgagtttgatgaccgcaagatcggtggtggtgtcggtgccgacgagcgtggcggaatacatgttgccgttggcaagcgtcacctgaatctgctgggcaccggagatcacgtggttgttggtgatgatgtggccttcggtgtcgatgatggcaccggagcccttggcggtgccgttgctcaacgcggtctggatggagaccacggagccggagacatcgctggcgacagtctgccagtcgggggcttcgccgctcttggcggtggcggacccggagccggacttattcgagctgacgttggtaagcgagttgctggtcggcaaggtgatcaggccgctggtgagggcaccgtagccgaggcccaggcagagggccgcagccagaacggcggcgaccacggcgatgagaatgttgctcgccgtcttggacatgccctgcttggcggggccgggctgaccgggctgaccgggctgtcccggctgggtcggaccttgaccgttcggcgtaccggtaccgggaacgccgaaaccgaacagaccgccctgctggggctgctggccattctggccattctgaccggactggctggcaaacgggttgccgttgttctgctgcggctgcgtgggcggattgaacggattgccgttaccctgcggctgcgggttattggtgtagtaggggttgcggttgccctgctggccctgtggggtttgctgtgcaggctggccgaacgggaattgctgcgtgggctgggcattgttgccggcctggccgccctgctggccctgtgcctgagtcggggtcggcccataagcgccgtattccggggccggacgatacagcggagttgtggccgaggtctggtctgcggccggcgctgccggagaagccggcgaggaggagaccaccgtgctctcgcccttggcggaggcgtagtccgggatgggctcggtggcggcagtgtcggtagcggcttgcgtaggctgctgatcggcagcgagggcggccgaggaaaccggggcttgctgctcgctggaatcgctggcgttgccggcatcaaccgagtcgccacccacaaacgggttcttcggctcggcgttgccggtatcggcagtactattggggttttcgttattccgcggggtctggtcgacgccctgcgggttaaattcgtcagccattgctgctccttttcctaaattcctatcacgtctgttcggcggctattcgggcacttgcccattgccacttctcgtgtgctacctcagtagtaaaggcagtcaatctggaggttttctgaacgttgattgaaagtctatgcgtaatcatcgcagagtcttatgggcatctcggcttcgaggggctgatttcctgtttcgggaacatctacttgcacttcaaggggctgttcgcgcggtcaattccgagtatcaagggccctcatttaacgccattccgccatttttgcagccggcctacttgaccgggagccccttgaagcggaagtagacgttcgggagcggcgaaatccgcccctcgaaaccgagttcttcacaatttccggcccttttctggcccttctgcctaaagtgaacatatgacgatcagccttcttgaacatccgttgggcgcacagcccggacagcccggcgaccgcagcgccttccatttcgaaacgatcacccgcctgccatccacggccagcgggcttgggcgagacggtgcccgatacggccgcaccggcatcattcacacgccccacggcgatattcgcacgcctgccttcgtgccggtgggcacgcaagccgcgatgaaggccgtgttgcccgagcagatgaaggatctaggcgcacagtgcctgctggccaacgccttccacctgttcgagcgcccgggcgaggacgtgctggacgcggccggcggcttggcgcgtttcatgaactgggatgggcccacgttcaccgattctggcggtttccaagtgatgtcgctgggcgtcggcttcaagaagacgctggcaatggacgtgaccggcatgaagtcggacgacatcatcgccaagggcaaggagcgcatggcctgggtggatgaggacggcgtgacgttcaagtcgcctttgaatggtgacgcacatcgtttctccgctgagatttcgatgggcatccagcacaaaatcggcgcggacatcatgttcgcgttcgatgaactcaccacgctgatgaacacccgctcctaccaggaggattcggtggagcgcacgttccgctgggcccgtcgctgcgtggacgagcaccagcggctgacggcggaacgcctgggcaggccgtatcaggcgctgtatggcgtggtgcagggcgcgaattacgaggatctgcgccggcgcgcggcttcgcagatcgcgtcgctggacttcgacggcgtgggcatcggcggcgcgatcgagaagcgcatcatcggcgacacctgtgcatggatctgcgacgcgatgccggaaaaccgtccacgccacgtgctgggtatcgcctctgtggacgacattttcgcctgcgtggagaacggcggcgacaccttcgactgcgtggcccccgcacgctgcgcccgaaacggcgcgatttacacgcgcgccggccggtacaacatcaagcgtgcccagcataagttcgatttcgggccgctggaggagggatgcgactgctacacatgccagcattattcgcgcgcgtacgtcgaccacctgctgcgcgcccgcgagttcaacgggttcacgttggccacgatccacaacgagcatttcttcgtgaagctgctagacgacatccgcgcctcgatcgacggcggatactttgatgagttccgcgacgaagcgctggcccacttctacggcaacggcgagcgccggccagggttgtgagtttttctccttcgttgcggcttgtgctgccacgaagtgactgaggggagtgtcgccaccgtcaaagatcacggcacccgcagaagacccacgagcgatatatccctgccgcccatgcgacacgccgaagattgcatgattacccagccgggtgtaagttagtcgattgtctgcgagtgtggcggaatggtagacgcgctgtcttcaggtgacagtgagtgtatgctcgtgggggttcaactccccccactcgcaccagcaactaaagggctggaatcggaaggttccagcccttttgctttgtccgggcacgcgccgtttttcaggggggctttaggacttgagacttatggcccaactttcgtggcggaaaatgtcccggtacctgcatcaatcgtttgacgttcaagccaggccagaatccgctgtcccggttcgcgatttcgggcgatctttgcaaaccgggacaatttttgttgccccggtataaatgtcaatcgatttatgcgaaaaccgggacaacgtgccaattccagaatcggccttattccgccgattccgtctgccagacgatatgagttgaggaaaccggagtgtcccggttcacgaaaacaagccgaaatcgccgaccgggacagcggattctgccccggtcgacaggtcaaacgattgacatatgaaccgggacaaatacagatcagagagaagcccatgaagcagatttaactttcctcaactttccatccgccataaactagcattacataacatcatgaaccgagacgaaaccaacgaagtatctggagtcaccgacgaccagctcggccgaacggccgagccgtacgaatccggcaactggcggggcggcgtcgggagcatcattcgcagcaatccgaaatcaggaaccgacacaagtcggacccagcagacacgcataatacgagttcacagactcggcgatgtattccgcaaccgcaccaccgaataccgcaccacggaagaactgtaagcattacgaaatcaaccttgattattgcgcgggcctatactaggttacggtagcgtaggttagtggtcgggagagcgtcgccggccatagcgaggtgatcagtatgagcgtttccatcagcacgccatctggacgaaccatggcttccgccgcaacagttgcgccttccgcaaccgcgagtcaaaaatccagcgcaaacgccaaccccaccgcactggaccgtgcatcggcccgatacagggccgcgcaatcgcgctaccgccaagccaaggccgcactgaaggcgatcaagcgccagatcgtccccgtggatgcattcggcaatcgcaagccgcgactgcgcggatggcttcacctcgccaccctgccgctgtgcatcgcggcgtccatcgtactcatctgcatcgcgccggccggctcggtcaaagcggcctgcgcggtgtacggcgcctcggccatgctgctgttcggcaacagcgcgctgctgcacgtcgtgccatggcgcagcgcgaaggtgactcgcgtgctgtgcggcatcgattattcgaacatcttcctcatcatcgccggcaccaacacacccgtgctgttcgcgctcagcccggcgattcgccggccatatctcacggtaatctggacgaccacggcgattggcacgatactgcatatcgtctggctgcggacgccgaactgggtgttcaccaccgtatacgtcgtgttggggctggccccggtaacgcttattccgcagctctggacggctcccgcagtaggcccggcgccgaccgtgctcatcgcgtgcggaggcgccgcgtacatcgccggcgctgtatgcttcgcgctgcgcaagccgaaccccgtccccggctggttcgagtttcacgaggtgtttcacttgggcacggtcatcgggtatgcctgccacgtcgtggcgatttatctgattgtctgtgcgctgtagtcgtccagcaattcatacaggatgcttcgaactcgctgtattgcagcgatttgaacacggcgcgggacagacagcggcccttaattctcggagccaagaatcaagtccttgatcagccagccgtgacggccgccttcatagacttcatcggtgagtcgatagccgcactgctcatagaacttgtagtggtcgttttccgagtgcacggcggtcatggttccgccggcttgcgcgatgcggcgttcggcgtcagccagcagccgcgagccgatatgccggccttgtgcctcgggcagtaccgccaggcgcgcgatgatgtatcgcccgggctggtcgggatgatcggggtccgcgtagaaccgacaggtcgctacggggtgattctggctgggctgaatgggctggctgcgtgaggccaattgcgcggacgagccagggcgattgggcgcatcattatccgaatcgaacaccagcagatgtacggacgcggcatcccattcatcgaactccggccgccagtcgcgttcgcggatgaacacctgctcgcgtatggcgcgggcggcggcgggcagccggtcgtatgcttcgattcgtatggtcatgagcgtcagtgtaatgcgtcacgataaccgacaaagcccggctcggtggacgagctcgggcccaagctcggcctgcgttcgataggctcaggccgtacgcgcgatctgcacggcggtgccggacgcggtgaccatcagcatgccgttgtcggcgccgagcacctcgtagtcgatgtccacgccgaccacggcgtgcgcgcccatcgcctccgcacgctgctgcatctcggcgatggcctcgttgcgggcacgcatcagctcttcctcatagccctggctgcggccgccgaacatgttacgcaggcccgcgccaagatccttgaacatgttcacaccggataccacttcgccgaagacgatgccctggtaattggtgatggtgtatccgtcgacggacggggtggtggtgacgagaatcatggcgaggctcctttggcttgtctgcgtagatgaatcactgccgagagtcggatcgctcccgaatctcacctcggaaacggatcgcttctcttggctaccacaatagtcgagagcgccttccccaacatcttcaatccacgcgattgcgtaatcaaacgcatgtttcgcctccaaaaaatgctgatagacattgggccgcaaaaggccagcctcaacgggcgcaagccgctcaccaaactgaatcgcagacccaaatgactcgtcatgggcaaacggctggaccacccaaattccgctgcgataatcaaccatcaccgaaagcccaggctgctccgtcgatacgaccatcatcgaaccggacacgttctcgacattgatattcgggtgcccgtacaacgcgtaactcaaaccatcatcggcaacaccctgctcttgccaattggcgcctaagcactccaacatctcgctgggcgagtacgcacaatcttccgcataatcaatcggctgagcatccgtataacagcattcaccgccgtcaccttccgcaatgctgcgctccacaagataggccatcacatccggcatctcccaataatcaatggacagcttatcaatacagccgtttttccaagccatataatgcgtttgctcgtcgccaagaatctcttcaaacgcctcggctgagataaacgtcgacccgtccaactgatagcactcgtccaaaggatagatttctcggttcgcgtattgttcctgagccttggacacaagcttgtcatccaatgcgctcatctgctgatcaacttcatcctgtgagggaatgaaaggggcgaagtccagccctgcttcgccacagcctctctgccgttcacgcctgtacatcacgtccgcacacgtatcggtctgccgttcattcaccattgatcagcctttcttttcgttccacaaatgccctagaacactgcgattccagtagttccgattgaatcaggatcgttcttgcgaaactgtcgaggatcgtggatcgcttgtggatcttgaagcgttgtatcctggttgttcatggatccggaacgcaaaatcattaacgtcgtgggagccgcaatcgtcaccaacggcaccgtactatgtgcacaacgcggtccggggaagtcgttggccggatactgggaattccccggcggcaaaatcgaacctcatgaaacagcgcggcaggctttacaccgcgaaatcgaagaagagctgttatgcgaagttgaagtcgcggaagaagtgtgcaccagcgaatacgcctacgactttgggaccgtacggctcactacattcgtctgtcacctcatcgccggcacaccgcatctcaccgagcatactgatatccgatggctgaatcctgccgatatgccgacattgaactgggctccggtagatcgcgaagcagtcgcgattatcgccagcaaacagctgacgctccgatgaatgcgccatagcgcagccatgcagtcatgcagtcatcaacaaacaattcgaatcgcaagggaacaagacaacatgtctatcaatctggccagcacctcaagctctccggccaacacgcaacatagtgatcctggcccgacaccctcaatcctcgaagatgtcatctcaggtctgatcgagccgcgctcagatgctcccggcgaatataagccgaccctcatcgcaaatcgccccggtggattgaccatgcgcgaggaaatcggcaattccttggctactagcgattccttcgacatttctgtcgcattcgtctcggctgaggccgtgctcagcttatttgaagacttcagaagtcaccatgaaacagcgacccgagcgggcacactgattacctcaacgaaaaatcatttcaacgatcccagggcattctgggagctgctgcatcttcagaacaccactggtgttgacgttcgcgtgtgggaaggctcccgcaatgcctcagtggccgcaatggctcaaggacagccattccatccaaagggatatatcttttctcgccgcatgaaagacggtacgccctattacgacctgtacgttggcagttccaatctcactggagccgcattgaccacgcaacgcgaatggaatctcaaagtctcatcgctggcggatggagagctggtcgggcagttccaggatgaaatcgactcacaggtggccgattccgttccgctgaccgaagagtggatcaaacagtatgaggaagatttcaagaaatacgccccaccgcgtcatgagattctgcagtcgtttgaggggcatgacattcagccaaacgccatgcaacaggaggcgttggcgaatctcaagaaacttcgtgaacaaggcgagcaccgcgcaattatcgtgtcggccaccggcaccggaaagacgtacctttccgcattcgacgtacgcgaatgccagccgaagcgcatgctgtacatcgcccaacagcagatgattcttcaaaccgcaatgaactcttaccaaaaggtgctcggctgtgatgaatccgaattgggattgtattcaggcaccagcaagcaacaggaccgccgctacgtattcgccacggtacagacgatgcggcagccggaggttttggcgcaattcaaatccgatgaattcgactacgttctggttgacgaagttcatcacgctggagccgaaggatatcagcgcgtcatcaatcatttcaaagatgccgacttcatgctcggcatgaccgccacgccagagcgcaccgacggcatcaacatcttcgagctattcgggcataacatcgcgtacgaaattcgcttgcaaaaggcgttggacgagaacatgctctgtccattccactactacggcgttgcggaataccttggctccgacgacgatccgaatggaatcgcccatcgtctcgatgtctccaagggtcttgatgcgaaggactcgaaacagctcaagtacgagatcgagcagcttgccaccgaaaagcgagtccgctacatcattgacaagttgcaggaatatgggcagttcaacattccggtcaccggactcgtgttctgcagccgacaggaggaagcccataagctgtcccagctgtttaaccagcagtggaatcaacaagatgaacgcccctatcgcaccgctgccgttaccagcacggacgatgacggcaggcccgtgtcccaagcgcagcgagacgaatacgtccgcaagctcactgaaggcgaactcgactatctcttcactgtcgatatgttcaatgagggagtcgatattcccgccgtcaaccaaatcgtcatgttgcgcagcaccgaatccagcattatcttcacgcagcagctcgggcgcggactgcgcaaattccctcacaaagaaagcgttgtggttatcgatttcatcggcaattacaacaacaactatctgattccggtggcgttatacggcaacactggcgaccgcgacagggctcgcaagaacctgcagcgaaagtcaatcggcctgtcgtccatcagtttcgacccgatcgccaaggagcgcatccttaagtctttggacaccgccgactggtccgacatgaaaaagctgtccgaacagtatcgccaagtccgttacgagctgggccgcatccccatgcttacggacatctataactacgacccctcactgccgtataccatcgcatcgaagcgcagcaactatcttgatttcgtgcgttcccgtgaaaaaagcctgggcaaaggcaaacatcatgaagcgacatttgaggatcagttggagccggtgaccgacgttgaagacgcgatactcaagatggcagcggagctgctgctgcccggattgcgaccgcacgaattggtcattcttgctcagctatgccatttcgtcagcgaacggctcgacgacgacgtacctcagcattggagtgcgggctcgtcaatcggccgcagcgaactgctcgatgcgattcgtactgaattcccgctggccgatggttcagacgcgcaattcgactctgcgatcagcgtgctcgattattcatatttcaccggcccgaactgcaatcgttttggcaaccagccattggtcgaaaccttgaacagcaccggcacaggaagcgacaccgcatatcggttgagcagcagattcgccgacatacttgccacgaaccgaacgttccgcatcttcttcgcggacactttgcgcaccggtatggccaattgccgagatatgttccgcgaggccgccgccaggcaacaggtcttcgaccacatgttcttgtacgagcgcaaatattccatggctgacgtcatgcgcctgtgcggatggaagaaggaaaacactccgcaaaacgtgggtggttacctgctcgacaaggaaaccaacaccatgcccatcttcgtgaaatacgcggccagccaatacgaggatgaattcctgagcacacaggaaatgaaatacttcagcaagaacggacgcactccgcagtctccggaattccgatgggcgcttagcggcattggcccgaattgggaccacacacatttcgtcccgctattcgtcatgcgcaaggcggaagaggccgatggcaagtactactacgttggccacgtcgctgcgtttgagaatcctcagctcaccaccaagcctgacgcaaccggacagggcagtgtgaaggtcaccctgtcggtcctgcgtttggcccggccaatcgatccagagctctatcggcatttagccggctgaccatcagctcctcaaccgtacggcggcggccattccgccgtcgccgtaggtggggtgggccatgaaggcttgactggcggtggcgtcgccgcgcatcgactcgtcgtagccgccacagcgctcccacgcggcacggcgaattatgacgtggccgggcagcaattatgcgacacgaacgtggcggcgatgccacggttacgcgcggcgcatcatgcgatgctcgccggcgaccgtgtgctcatcctcacgcttggcgggcttgcgagcgcccgcaatattctccatgctcatgcctgctcatccccatccacaaccgaaatccagtcgccgtatccttcctcggccatgcgcgagcgcggcacgaagcgcagggcggcggaattcatgcagtagcgcaggccgccgcggtcggccgggccgtcggtgaacacgtggcccaagtgaatctgtgtgtccgacgtgcgcacttcgatgcggtcgcggcccggaatgcggtggtcctcatgctcggtcagcaagtcaccggcaatcgggcgagagaacgcgggccagccgcagccggaatcgaacttgtctcgcgacgagaacagcggctcgccgctgacgatgtccacgtaaatgccgggctcaaactcctcgtcatactcgttgacgaacgggcgctcggtagcggcgttctgtgtgaccgcgaactgctcaagcgtcagatcccagatgcgttccacgtacttctgacggcgttttacgttcgcgattgcggcgatcggcacatggcagtagccgccgggattgttcaccagatagtcctgatgatgtgcctcggccgggtagaagttgcgcagcggttcgaccagtacggccgggcgctgcggctggcggtcgaccagctgctccaaggccgccacatacacggcgcgctgcgtctcgtccgtgtagaacatgccagtgcggtactgccggccgcggtcttcgccctgctggtccacggagaacgggtcgatgacctccaggaacagcaatgtcagcgtccgcaggctgacctgtgccgggttaaactcgactttcacggtttcggccgcatccgtgccgcccgcgcatacctgctcgtaggtcggcgattcgacggtggattgcgcgtagccgaccgtggtgtccgtgacgccgtcgacgttctggaagtagcgctccagcccccagaagcagccgccggcgaagtatgcggtttgcgtattgccgtcattgtgttcgttacgttcgctcatgcgccccacgttactacgtcgaggcggctcgcgatgcagtcaacgacacctctgcaccggcaaaaccgctttcgaggggctgattcggccttcgcaggaggtctactcccgtttcaaggggctggtcggcagctagaccgcatgtaaaagcccatccgcgtcaacgccattccgccgattttggagcgtgaatactcggccatcagcccctcgaaacgggagtagacctcccggagaggccaaatcagcccctcgaaacggagatagcgccttctgcgcccttctcgctgggctttcgccgctcaaagaggtacattcgggcttctgcagaatgctttctccgttcaaagaggtactgaatacgggaaaccccgagtacaaacgccgtcattgcaacgctcatactcgggatttcagagtttaggtatctctttgaaggcagttagctgtccgcaagaggccaaatgtacctcctgaaagcagatagccccatcttgggctcgaatcggtcagtctccgtgtccgtacgtgaacgaacaggcaaacggcctagagcctcaaccgcgagcacaattgtcagggtccgccccgcaccctacgaccgcagcgtgctgagcataccggccacttcggcgggcgtcacgctgggcacgtaggcgcgcaccaccgcgagcccgatctgcggcaacgccgccgggtccgggtagcacacgtagaccggcgcttcggcgggctggaacttgcgcttgaagttgaacagcgagtggaagccgtaggcgggttccatccagtcggccacgatctgcagcgcgtgttggagcacctgcgtgccttcgccggccgccaccccaccttcccgggcattgtctcgctcggggttcatgccggccaagggtgccgcggacagactcatgaactccacggcatgctcaggatccgcaagcccctcgtcgcgcaggcgctcggccatgcgcgcgatcaggaactccataatgccgttgggactgtcggtgcgatggcgcatgaagtccagcgtccagccgacgatgcgcccgtcgcgccaggtgggcagccagctggtgacgcccagcacgcgaccgttcgcgtcaatggcgtacaacagccgcacacgcgggtcgcgcagttcttcgacgccgccgagcgtgaacttcatttccggcagcgccttgagctgcgcccactcctcggaaatgtcctcaatctgttcgcgcacgtcgagcgacgcctccaggaacgtggactgcacatcggtcacgccgtcgcgcttggccttgttgatggcggtgcgcacatcctgccatttcttgccggtcgtcttccagccgcgcgggtccacgaccatttcgctgccgacctcgatggagctccagccggcctccagcaacgcgtcgcgctgttcgcgatgcacgctgtagaacaccggcgaaagcgaccgctccacgcaatactgggtgaagccggtcaggtcgtccatccactcggagggctcgccgaacggcccggtgcaggtcaaggcgatgccgttgagcacgcgatatgccacggccgatttgcccgtgggcgagagccagtagctgttgccttcccacgtagtcatgaagctcatcgattcgccgccggtttcgaccagccgctcggcgcgtgcctgcgcccgctcgttcgattcgctcacgtcgctcatccagcggatcaccacgaccagcaccacgatccagaacaccaggccgacgccctgatacacgatcgaggccatcggggtacgcggcacgaacgacaacttcatatggctcaggaagccgatgggcaggaagcgccccggcagttcggccaacagcgacgaggccgtggcacgcggcgagaattcatccggctgggcgatgccgtacatcaggtacacggcggcgcacgccagcagaaccagcacgatggcgccgacgccgccgatcagtcgccgccagccgacgcgaatcgggaaatgcttcaacgccgcagtcaaggcgacggcaaagaacagcggcggcaaggcgttcgccacgcaggcggtgatcgcgccgtgctgcagcagtgaggtcatgccatccggcgcaaagctcagcgggacgaccaggtaatagacgatggcaacgcccgccgtgaacaggttgatggccacggcgcaggtggccgcgaaccgacggccgcggtacaggccccacgccagcaccagagtcacggcggtgggcagcagcgaacgcagtaccgcgcccggcatcgaggctcgcaataggtcgaattgcaggaagcagccgctgtgcgtggcgccggccaggcagcgcgcgagcgtgccgtcgtcgacggagaccgggctcatgagcaggccgactgtgctgagcggccccgcgtgattatgcgaggtgatggcgatgaccggccccagcgccagcaccacggcgatggccgcaaacatgcgccgcgcctcgaaggaggtgctgcgcagccagtgccatccggtttcggcgtgcgcgggcggcccggccatcacgcggccgaccgcgtgtccgatcagcgcggcggcgagaatgcagtaatcgccaggattgccgctgtaaagcagcgcgaccagaatcgccacgtagccgatcagccgaatacgccgccgcaacagatggctgcagaacgcgctggccgccataagcgcgccgaccggcaacaccagcgggctcaaggcgaactgcatgcgggagacgaattgggagtcctggaacagccatccggccgccgcacacaaggtcaggcccacgatcacgccgccgagcgcgcaggcgagcgcggtgccgacggtacgtgcgcggccaagccacggctcggcgattgacagcatgacgagccacagcacggcatcaagaatgagctggatgacgccgcgcgccaagaacagcgtgcagaagagtttgccgaaatcgaattcggccatgctggtgtcgagccgcagcgggaacgcgaatccggccatcgcgaccaccagccacaccaccaagttcagcaccaccagcgccaccgtggcagtgatggccagtcgatgaccgtccgcccactgtcgcacgtcgccggccagttcgcgccagctttccgccgcatgactgttgtgcttacgcaattcttcgctcattgcaacacctccacttgtgggtactccttcaacgatttcgtcatctcgcccaagccggtccgttcgccgaaccagtcgagaccgggccgccagaccgcctgcaccgcgtgccagtcgtggccggtgccgggcacgatcagctcgatgacctccatgccggctttgcgcgcggcggcggcaatcgtgcgcatgttgctaatcgattccttgtcccgttcgccagcaccggtgaacagcgcctgctcagatgtgccggtggaggcgatggcgttgaccggcacctgttcgtcgtatgccttgcggtcgccggcgaaatactcctggaccatcttggcgacgctgccattggtcggcttgagttcgccgtccaccggcagcatcgcgccgtagatgtcggggtggcgcgggacgagctgcgtggtgcaggtgccgccttgcgagaacccgcccatcgcccacatgcgggccgatttggccacgggcagcatcttcttggcccagttcaccacgtctgtggtgaggtaggtttcggcgttgccttgcgtggtgtcggcgcacaggctgttgtgcgtggcctcgccgttctggtcgggcacgagcacgatcggcgcgagcccgtcatgtttggcggcgtacgcattcatcgtggcggcgatgttgccggcgtcgatgaggcgactggggctaccgggctgcccggccaacagctccatcaccggcaaggccggcggacggtcggacagcgcggcgggcggcaggtagatcatcgccttgcgggccgtgaagttggattcggtgttcggaatgtcgacggtgagcaccttgccttggctgggcatggacggcaggctgcccttccgcgccttgctatgccagtcgctgacactcatcgcggccttgtgtacctcgattgagccgagcgaggcgtacggcgtgtagccgacgagggtgccgatggtctggtattcgccgtaaatcgagtccacgccgagcgcggtggacagcagcaccagcggcaccagcacgacggccagcgcacggcggaccccgcgcagggtcacggctgcggcgatcacgaagccgacgccggcgatgccgcccgcgatggtgaagatcaccggccagcccagcgatacgccgaacaccataaacacgtcggacaccagccatgcaaccagcagtccagccgcgccggcgagcacggcggcaatcagcgagacaatcagcgggtgcaggcggccgcgcttcttgctcttgctcaatgccagcccaataatcagtatgattgccgcgatcgcggtcagtccgaacacggtccgcggcacgattccgcggaccagagacaattccatgaacgttttccaaacggagttcttcatccttcacccccgcgctccaggctcctcgccttgtaagctcacgcaacactagcgcgcgattcatagagcgtcacccaatttcacaaaaattgtcgcgagttctcatggtttccccagactccgttcagcgcctgttcacatccggtctggcgcccgcagttcaaggccagtgtcggcgctggattagcggcgcgcaggcttgtcccagcttcagccggaagcagggaatatgctggtggatatgactcacgcaaacgaacaacgtccagcagcgaccggcaatgccgccgataacgtgtctgacgcccctactggccccgcgacgagcgcggcggcaaggcccacgaccgtcacggctgatggcacaacagccacaaacgccgcggccagttcaacagcaaagcccgcagccagcacctcttgggccagggaaaccaacccacgtcgagcactgttgacgattatcgtcacggtggtggttgtggtggccatcgtactggggctcggattcttcgtgaactggggattggcggcccttttggtgatcattatgattccgggggcgatttcgctggccgttctcgccaagcaccctgaatccaccggcgggcgcagcatgttcggcatctccgatccgaatacgctgcttgacccgattcgccgcccgtccgagcgccgcggcgagtaagttgctgctgcccatcgggcggtaatttatccatggggcggtaaaaggcccatggggcggtttgaagaaattgtgaaaccgcagaataaagtcattttgggataccgccccatgagggttttaccgccccatgggattattaccgccccatgagcaaagccaccccgctatttgcgcgcactgaccaagtaattaagcaccgatccgacggccaccagcagcgcgccacaccaaaacggcagcgacagcgccaaacccagcaacaccgcactggccccggtggacagcaccggcgtggcataggacgcaatagcaagccgctccatagacccatgcagaatgccatagccccagcaggcataaccaccgccaatcgccgccgcggcaatcaacacaaacagccatgcgaccagactcggaggctcggccggccacccctgcccggacgcgaagtggataatccacaacgccacggccacgcaggggaagaacaatgaagtgccgtccaccccatgactcatggctggcgtgaacaccgcgtacaccgaccaagcgagcgcgcccacgaacgccagcgcatagggcaaagggttggcggcgatatgctgcacggccgcatgccagtcgagcccggaattaccgccgaccgccaacaccacgccggcagtggccacgatcgcgcccggcagcaccttgacgaccgcgtgcttgcgatgggatacgcccgccgacagcagcaccatcatcgtgggccacagatagttgaccaggctcacttccaccgaggatgcgtcggtagaggccagacccagcgagagggatatcgacgattcgtaaaatacgaacaacaggccgccgataatcaggtatttcttggggaactcgcgaatcggggccgggcgccggaacatcagcagcaggatgccgccgaccgtgtagatcagggccgagccaagcgtggcgccgaagttttcggagacgatgcgcacggtgccggccatgaagctccacagcaggattgccatcaggccgatggtcgtggcgcgcgcggatacgacgtggccgccggaatggcttgccgccggtgccggtgtgccgcttgcgttctgtgcgccgttcgccatatgtccgcctctctcgcatcgtttcgaagtcactctacccatcggatgtgtacagcggcagaacggcacgcgaccggcgcgcgaacagggtggggttcggtgattgaaacagcaaaatgccgggtagggtaaatccctacccggcatttgcattggctatgtttcccgccgtctgtcaggttagtcggcgttgaaagcgtagggcagacggcgtgggaagcatggtttggttacgatttatctctcccccacccgcttcgcgggagccccctcgtcagagggggcaaagctactcgaagcgggacttcgggacgaatcaagtatcgtcagccctcaatcgcgatttggtgcttggactcgacttgcggctgggcctgcatcttcggaacctggatgcacagcgtgccgttccggtagctggcgtggatgtcggactccttcacgtcctcgccaacgtagaagctacgcgagcaggagcccatgtagcgttcgcgacgcagccacttgcccgaatcggacgcgcaagcacacttgctgtcggaagcctcgtcctcagcggccggagccttgtcctcatgctcgctgcaacgcgaggcggacacggtcagatagccgttgttgagctcaaggttgatatcttccttcttaaagccaggcatatcgatgtcgacgtcgtaacccttgtcggtctcgcgcacatcggtagtcatcatgttggcgggcattacggcactcatcgtgttgtccgtgttgcgccaaccctcaaagaacggatcatcgaacagatccgagaacatcgtgtcattcatcaaagccggaaacattgccataatcggtactccttgattaggagagaatcggcttggctgccggccgccaacccgtatcgcggggctagcagcggttatcgtggccggttccggaaccctcccgggctctcaacctttaaccttcacttcacccaattcccgagcgcggcaatcattccgggattatgcccacagagaaattgcggcgggaatagttgccggtaaagccggccgagccgagcgccgtgaccaccctcagccagtcttacggctgccagctcccgccagcgggagcatatatacgcacaccagtaggcgtactcatatacctctgccaacgggagcatggttgcacgttcccgcaaactccgccaacgggagcatgctggcgcgcgaacggctcacatctgctgggcgttttcgagcaaggcgtttttgaggtcggactcgatttggcgcatcttgacctgggcggcctcgcggttggcctcgccttccttctggatctgcacggtctccttcagggtggcgatgagttcggcgttgatcttctccagcgtgtcgatttccaccacggaacgctggttggccttttccgcgtccactgcacccttgtgcagggcggccgcgttacgcgccagcagcttgttggtcacatcgtcggccttgttctgcaggtcgagaaccttgcgctggttggacaggcccagcgcgatcaccatctgactcttccacaccggaatcgtggtggagatggtggtgtcgatcttgtccacgatggtctggtccgcgttctggatgattttgatctgcggcgcggtctgcaaggtaaccacgctgatgcggtcgaggtcgtcgagtcgcttggcaaaacggtcgagcttggacttgaagtccttcagcacttgcgcctgcatggcgtcgccactggcggcggcctcggcctccagcgctggcagctggttggcgttgaagtcggcgagcgccttcttgccggccagtacggtcattttcagctcgcggtattgctgggcgttctgcgtgtacatcgtgtcgtacatggagatgtcggccacgagtttggcttgcgcggattggagggtggtgatgaggtgttgcatggcgtcgttgttgggcagttcggatacggccgggatctggtcgagcgtgccggccacgccgaatcggctgatcgaatcggtgccggcgaagttggccgcgcggaagccgtggcgctcccacgccagcttctgcgccgccggtgttttcaacaggttcagcagtgtgtcgcctttctcgtccaaggccatcagcgtgtgggtgctccacacggtcggcgtcgggtagacgatgaccacgtcgtccttgatctgcttgaacgcatccgtctggttcacggccaaatcaagcacatgtgatacgcgcccgaattgtccttggtcacaagtccgccgttcacgagcccgtccgccacggccttgtgcgtgtatagcacaatcggtgagttgaagacgatgtcgctttggggggccttgacgcctttcgcattgccgtattcgacggccgcgcgcgaggaggggaacaggtaacccatgcctttccggtccgtatccatcatggccggcgatccggccttgcgatagtcgatggcaatgccttgcttggcggcgagcgccttgaacttggcgtcatcgaacaggccgattttctcgccgcccaggtagccggtgatgctcacctgttcggtcggttcggccggcgctggttgcgattgccgccacaccagcgtgccgcagaccacgcccactaccgcaagcagggcgatcagtccgatgatttttgatttggagagtttcattgtgcgtccgttttctggtccgactggtgagccgggccgccagatggagtctgactgggtgcatgccgtccttcatcagcagccgaggaaggcacaggcgaaggtgcgacgtcgtcgtatccatccatgcgggccaaccgttggatggcgtcggagtcggccgtaatgcccaacgtcttggcgcttaccgcccggctgagttcgccggcggcggtctgttcgagcacttgcagcgcctcgatggtttcgattcgtaccgtggctatctgatcgcgtgcgccggaactttccacgtccacgtaggagcgcaacagtttctcggtctgctcgccgtacacggtgatgtagtggcgcaacgtcgggtaggcggaggtgtctcgggtcacgtattgcactcaatctttggtagcggcgatgaagtcgttggcttcggctttgacggctgggtcacgtacttgcttggtgagcatggcgatcgagttgagttgagcgttcgccgcgtcgatcgtatcggcggtcttctgaccgttgggcaaggcggaaaccagcattttgccgatgcgtcgctccggctcggtgagcgtggaggcggcgatatacccaagtgcggccagtaccacggccacgatcaggccgggcactccgccgccgaccagtccgaaaccgagcccggcgagcagcagtccgacaacgaatccacagattacctggagcatcagttgaagcccttgacttggcggaagacggcggcgaggtcgccggagcggccgtcgaataccttggcgttgctcagggtggcgagagacttcagctggctgggatcggcatcgccgaacatgatggagaagatcggcagatcacggccgcgcgacttataggcgctttcgaattcgtcctgatgatcggagttggagcggccgtcggtcatgagcacgatggcggtggtgtattgcgaggcttccgactcgctgggcagctcgtcgagcgcgctcagcaggccttcatagatatcggtgccgccgctggcatcggtggcatcggcctcatgcagcaggtcgctggtgcttgtgccagtggccttgaccgggcggtgggcctcggtttcaaacgggatgagaatgttcacgtcgccgctggcgggctcgatgtacgacttcttggcctggtccgggtcgagcgccgcgttcaggcctttgaccacgccgttcttgccctctccagacatcgaaccggagtaatcgaccacccaaatggtccagctgggtttcctgagcgcggtctggtagacgttgagcgcgctgtcgatcaccgtggcggaggtcatggagaacgtgagtttgccgtcgctgaccgcggcgaggatgtccgcggtggagacgggcttggtggcgccggtgtcgtcagcccagccgagtttgacggccttggatttggcgatgccgaacacgatcggcgtggtggaggtgctggccgcgtctttgacgatgtgcttggtgtctcccatcgaaatccacatcgaggaggcaggccagacggcgtcgtgatcctggccgccggccttgagcgcgttcataatctccagcgaacccatgtagtgcatcgtcacggctacgttggattggtcggccgctttctggatggcgacggcgacttccttgttttcggagccggaggcaatgctcagggtggcagtcggtttgccgccggacggctggaaggtctgcgtggtggcggacgtgccgttgccgtccgctgtgccgtcatcggaattattgaacgccgtgcaaccggtcaacgcgagcacgccggcacataccgcggccgcaaccgcggcggcggagagaagacattatgcccataattccatggctctcccgccatctaaagcgggtcgggccacaaggtgaccgcacggtgaacaatgggtgaagagctacatcagtacgcggcgcaggcaatcatggggtcgtcgtagaagccgaggatcttttcgaggtagggcttgtaggtgctgttgggcatggagaagatttcgtggcgcgattcggggaagcgcacgatgttcgcctcgccgccgccgtccttgaccagttggacgaagtgattctgcggcttattgagtacccagatgtcgcgtccggactggaagagcagcaccggcgtctccacttcggcgcaggcggacggattcagtatggcccggttgagcttcaacgcttggcgcacccattcgaacgccgcgcagtaggtctggtattcgcggttctcgcaacgcagcttgaagtaccagcgttcacgcgcttcggaagcgccctcgttgccttccatcgagaattccggcgtgaagtccgactgcccgaacacgcgcttcttgccgaagccgagtccgcacagcgcgccgaccagcacacgggccacgcccagcggcatgccggtggcgggggcgatcatcggggcggagagcaccgctttgtcgaacagggtggggtatcgctccaacacggccgcgccgatgccgccgcccatcgaatggcagaacaggttcagcggcatgccggccgcgtactgctggccgatggtttcggcgaagccggccagatcggccacgtagcgctgccagtcatcaatccacaccatgcagcgattgtccacgtcgcgcgcggacttgccgtggccgcgatgctcgagtacacacaccgagtagccggcgagcagaaaataccagacgagctcgtcgtatttctcggcgaactcggtgaagccgtggctgatgacgatggccccgcggaagatggcggtggcgccttgctcgcgaatcgcgtcgaatttggcggagtcgtagcacaggtagtgcagctggcccgagcggccgccggtgtccataatgccggacagcggctcgatcccggccgaacgttcggcggcggacggatcgaaccagccctcctcgcggcattgttcgagcgcgggcagcaccacgtcggtcatcgtttcggcgtacttgttttcgtcgatcatcgtcacctgcatggttcccatcttaggacaagcctcacgcccacacctcgcacccacacccacgacacaatcccgggaatgttgcgctaatcggacctaccgagacccacttcgcgaaacaatcccgggaatgcgtcgcaagcctgcgcgccactgaccgcacaggcgcgtaggttgtgaggtatgagcgaaaccaatgatgtcaatgacgcaatcaagcatttcccacgcctccgggcgcgcacgctgcgcttcggctgcggcgcaccgcgctccgcacagaccgtgggcgacggctcgcgggccctgttcctgcgctccgacggccccgaggatctggtgaccgcactgtggctgagctggttcgacgagtccggcgaacaccatgagaccaagctggccgacccgcgcgaactgctgggcgcaaccgccgacagcgaggacgtgccggccgaggagaaggcccgccgcgagcgtgcgcgcgaaggcggcaccggcatcgtcggatactccgcagatgacgacggcaatcgcatcgtgttcaccatcaacagccgcctgttcctgaccgacatcgattggaatgacgagaccggcgcacccgagccgcacacccgtgaactggccggcgaatggctcgatgaggacccggcgatgtacacgccggtgctgaacccgcgcatcgccccggatggcgaacatgtgctgtacaccacgggcagctacctgatgctggtcgatatcggcggcgaactaggtgaccgcatcaccgccgtctacggcgtgagcgtggaggatgaggacggcaatccggccgaaaacacgtggaaaatcggtctggccgagttcgtggccggcgaagaaatggaccggtacgacggtttctggtgggccccggattcgcagcatgtgctgttcgagtctttcgacaccgccgacgagccgacctggtacatcagcgatccggccgaccccgagaagccggacgccggccgccgctacccgcgcgcgctgacccgcaacgccgacgtgtacctgaccgtgatcacgctggcgttcgatgagaacgaccggtacgcgggcatcaccggcaacgccgatgtggattgggatcgcgaggcgtacgagtatgtggccgccgtgaactggcgtcgcggccacgatccgctggtgctggtgcagaaccgccgccagacccgcgatcaggtgcttgaggtggcggtcgaggcggatggggccgcgctgggtgccacgcgcgtgcttgaggagcacgcgaacgagcagtggatcgacctggttcacggcacgcccgcctacacgccggatggtcgtctggtgtgctcgctcaacgatatggccacggacaccaaccgtctgacaatggacggccgcccgttcacgccggctggctggaacgtgcgcacggtgctcgccgtgaccgacgaggatgtgctggccgtggtgcagcgcgcgcccgaaatcgcgcctgaggtgccggacgcttgggccgatgcggccgccaccgagtccgtattcggcgaccacgacgcccgcagtttcgacgtggtgagtatcgattacaacggcacgatcacgccggtcacgaccgatcccggccagtggaccgcctcgcgcggcgagcgcggcatcgtggtctccggccgcgatatgcgttccgcccgcgcccagatgcggcatattctgggagaacagagcgccactatcgcgtccacggcggccgaacccggctttacaccgaacgtcacgtttacgcgactgggcgagcaccagctgtacacggcgatcatcgcgccgagcccggaaagcccgtacgcgcacgccgagaagctgccggtgctgatgaagccgtacggcgggcccggcttccagcaggtcatcgcctcgcagtccttctactgggagggccagtggtgggccgaccaaggcttcctggtggtcacggcagacggccgtggcaccaccggccgcggcccggcatgggaccgcgagatcttcgaggatatgaaggacgtaacgctggccgatcaggtcgaggccgtcaacgccctgcccgaggccgtcgcccggctcaacgccgatgtggaatcacgtgcggcacagccggctgcgggcgatcaggcagacgccgagaaccacccaccggcgcttcgcgccacctcccgccagcgggaggcgattcccatgccggacctcgacaaggtgtgcatgatcggctggtcgtacggcggcttcctgtccgcactggccgtgctggacgcgccgaacgtgttcaaggccgcatgcgccggcgccccgcccaccgactggacgctgtacgacacgcactacaccgagcgctatctgggcctcgacccggatgtctactaccgaaacggcatcgtgcaggacgcaccgaaactcgagcgcccgcttatgctgatccacggtttcgccgacgacaacgtcaccatcgcccacagcctgcgcctctcgcaagccctgatggcggcgggtcgcccgcacaccttcctgccgttgacgggcatcacccatatgaccaatgacgagaccgtggccgaaaacctgctcaccctccagcgcgatttcctgcgcgacgcgctggcctgacaaatcgataacacgcgcatcccacccgaggtgctccaccggtaaagcacctcgggtggtgcgccgcacccatttccgccctgaatttttggatattttgcactcatcgtcacgtgaaagaccggttttttgtctcatattcccatcaccgcgtaggatgggtgaagattagaaagggaggactatgagcgttctcgaccgttttgaaaaaagcgtggagggtgcagtcaacggagtattcgccaagtttggctccaaagacctgcagcctgtcgatctttccagcgccttggagcgcgagattgacgccgaggccatgcccgtgggccgtgaccgcacggtggccccgaatgaataccgtttcaagctcagtactcctgacttcgaccgtatcgaggcatggggtagcgagaccctggccaacgaactggccgataacctcaccgagtacgcgaagagccagcattacgccttcgtgggcccggtgatcgtgatcttcgaggaagaccttgacctgtccaagggcaacttcaacctcacctccgaatccgtgcagggcaatgccgtgccggtcaccaccgatgcgcagaccgaggatagcccggtgctcgaggtgaacggcaaccagtacctgctcaccaaagacaagacggtaatcggccgcggttccggttgcgatatcgtcatcgacgatccgggcatctcccgcaagcacctggaaatcgacatcacggataacggcgtgatcgcccgcgacctgggttcgaccaacggcacgtacgtggagggccaccaagtgcccgccgccacgctgctcgacggcaacaccatcaccatcggccgtacccgcatcctgtactgggcctccgcccaagcccaggagtagtcgagcacacgcccgaaagtcgtccacttatgaccgaactgacattcgccctgctcaagtatggattcctgatcctgctgtggatattcatctggctggccgtacgttcgctgcgcaaggacatcgagacgttcagtccgcgaccttcgcgcgcgcgtcgtcgccgtgagcgtgaagtgcataaggccaaggccgaaacgccgcaggcagctgcgccgcgcccgcatcgccagcccagcgcttccgcgtcgtccgccgcctcggcgcagcctaccctgttggtcatcatcgatggtccgcttgccggcagctccgtgccgctggccgaagccgacatcacgcttggccgcgccgcctcgaacaccgtggtgctcgatgacgaattcgtgtcttcccaccatgcccgtgtctaccgtgacacgcgctccgggcagtgggccattgaagacctgaactccaccaatggcaccgtggtcaaccagcagcgcatcaaccgccccaccattctgcccgctcgtattcctgtgcgcatcggcgccaccaccttcgaactgaggtagccgcatgccaaaatccgccgcttcacaaccgctgttcctgtattccaccacggtgtccgatgtgggcaccgtgcgcgcgaacaatcaggattcctccttcgccggcgagcatctcatcgccatgtgcgacggcatgggcggtcacgccggcggcgatacggcatcctccatcgccatccggtcgctggcccacatcgagcaggatgacaccggtggcaacgtcgagacgatctcccgcatgatggaaacctccgttatggccgcgcatgacgccatcgtcggcaaggccaagcgcgaacgcaagcttgccggcatgggcaccaccgttaccgcagtggcattggtggccggctactgggtcatcgcccatatcggcgattcgcgcgcctacctgctgcgcgacggacgcctgagccgcatcacgtgcgaccacagctacgtgcagcacctcatcaacaccggtcgtatcaccccgtccgaagccaagaaccacccgcagcgcaacgtcgtgatgcgcgtgcttggcgactttgacattgacccgcgcccggatatttcggttcgccgagcccaccccgccgaccgttggctactgtgctcggacggcctgtgcggtgtgctggaagattccaccatcgaagagacgatgaccacgctgtccgatcagggcgaatgcgcgcagcgtctggtgcagatggcactgcgggcgggcagcaccgataatgtcacggccgttattgcggatgccacgttggcgttggatgccgatgcgttcgacctgccgcaccaaacgccgttggtcggcggtgccgccagccgtaatcttgagccgattgccgacatcgtcaacgagccggtggctaccgcgcccgcactgcgtgaggatgattcccccgcccagcgcgccgcagcattgattcagcccgccagcgcgcacgaggcggagaccgcgcaaaccacggccaaaccgtcgtccacacgcgtggtgcagccgtccaccgtccgcgaggagaccggtgaacgagccaatcccgataccggtgagattccggtggtgcaaaagccggatgggcgcctgtccgccgaccccaacgacccggatgtggccaaagccatccgcgatgagcaggtcgagcagaagaaggccacgcgtaccaagaagcgccgcaataagcttgcggtgattattacctgcattcttgccgtgctggcattggccggcgctggctggggcgcgtacacgtggagccagacgcactactacgtgggagatagcaacggcaccgtggccatttatcgtggcgtgccgaccaatctctttggacttgagctttcgcacgaagtgcagaccaccaatatcgccaccgcggacctgcctcagacatggcgtgaccagctgagccaaggcatcacagtcggttcgttggacgaagcgcagtcgcatgtgggtattatccgcaccgaaatgcgcaaactggccaagcagcaggaagccgacgccgccaagaaggccgaggcgtccaattccccggacagttccaaagacagttcccagagcgattccaaggacggcaccaaggattcgtccagccagtccggttcgtcaagctcatctgattcctcggataaatccggtatcggagcggccgacaacgcggccacgggggattctcaatgatcgctacccgtctacgtcagatttccttgttgctgattgccatggcgatcagcgcgttggcgttcatccagatgttccaacgcaccgccggcgaattccctatgcaatacgccggcatgctggcattggtcgtagtgctgtttctggtgctgtgggggctgattgtgcgcttccagccgtacgccagccagtcgattctgccttgcgtgctactgctgaccgccactggcgtgaccatgatcgcccgcatcgaccagagcgaaggttgggcggttgcccaacgtcagctgatctggctgtgcatcgccatcgtgctttccgcgctgctcatcatcttcctgaaggactaccgcgtgctgcggcgcttctcctacgtgtcgatggtggtgggcttggtgctgctgctcgccccgatgctgccgtttgtcggtcaggaagtgaacggcgcgcgcatttggatcaggattccgggactgggccagttccagccgggcgagttcgccaagctgttccttgcgttcttcttcgccgcctacctgttcgaccatcgcgaccagctggccgtgggcggtaagaagatgctcggtctgcagctgccgcgtatcaaggatctcggcccgatcatcgtggtgtggatcgcctcgatgggcgtgctcatcatgcagcatgatctgggcacctcgcttatgttcttcgccatgttcgtggccatgctgtacacggccaccggccgtaaaagctggatcatcatcggtctgatcgcgttcgccgcgggtgccgtgctggccgcaggcatgttcagccacgtgggtcagcgagtcgatgcctggctgcacccgttcagcaacgagcaatacaacaagacccccggcggctcctggcagctggtcaccggcattttcggcctggcatcaggcggcatgctcggcaccggtctcggccaaggccatccttcgctcgttacgtttgcgaactccgatttcatctacgcctctctgggcgaggaactcggtctgatgggcgtcctggccattttgatgctctacctgctcatcattgcctccggctttatcaccgccatgaaaatcaaggatggcttcggcaagctgctcgcttccggactggtgttcaccatggccttccaggtgttcaccgtggtcggcggcatcacgctggtgattcctctgaccggtctgaccctgccctatatggcggccggcggctccagtctgatcgccaactatattctcgcgaccctgctcatcatcatctcgaactcggccaatgcgcccgagccggagctgacctcggatacgttccagtacgaggctttggccgtgctgcgcaacaaggaacttgaggcccgagcccgcgccactgagccgatcgttcagcctcgcagcgcgtcggctacggcgtcgcagtccgaggcggaatcgtttgacgaccccattgtggatgccaccactccggcgtatgccggcgccgatgaaccgtacacgcctaccggtacgattcccccgcttcctcccgttaacggaggcactcgcgtatgaacaaatatcttcgtcagcttttcaccgccgtggtcgcgctgttcgtgattctcggcctgtcgtccaccatcatcatggcggtacgggccaacgcgctgaacaacgatccgcgcaacgcccgttcgctgtaccaccagctcggtgcctaccgcggtgccattctggcctcggacggcacggtcatggccaaatccgaaccggtcaacgacgcgttcaaatacctgcgcacctattccaacggtccgctgtatgctccggtcaccggcttcttctccatcaaccagaccgccgatcgcggcctggaagcctcccgcagcatgctgctcaacggtgaggccgattcattgatctggcagcgggccaaggccatgctcaccggcactacgaatcagggcgcgtccatcgaaacctccatcgaccccaagctgcagcaggttgcctacgatcagctcggtacgcgcgatggtgcggcggtggccatcgaagtcaacaccggccgtatcctcgccatggtgagcacgcccagctacgatccgaacaaactggcgacccatgacgccaaagccgcgtctcagtcctacaacgaactctctgcgggccaaaatagcccgctaatcaaccgcgccacctcgcagctgtacccgccagggtccacgttcaagaccatcgtcgcctcggctgcgctggaaaccggcgattatcagacggacacgaagattcctgcaggctccagctataccttgccgggaaccgccacacagctgccgaacgacgaggcacagggcgatggcgtcaacggacagatctccctgcaagaggccgtcgcatggtcgtccaacaccgctttcgcccagcttggcgtgaaactcggcgcgagcaaggtttcggacatggccaccaagcttggtttcggcagcaccatcaccattgacggcaccgaatccacgggcaccccgatgacggccaccgcgtccacattcccctctgatccgaccgacgacaagcttgcgctggcgtccatcggccaaggcgacaccacggccacgccattgcagatggcgatggtcgcgcaggcaatcgccaacaacggcaaactgatgcagcccacgctggtcgatcgtgtgcgcgccgccgatctcaccgtgctttcgcagaccaagccgcagaccatggccaacgcattcagcaaggattccgcagacaagctcaccacgatgatggagagcgtggtgaccgaggccaatccgcagctggccatcgacggcatcaaggtggcggccaaaaccggtaccgcacaaatcggtatcgacaactctgccatcgacggctgggtgatcggtttcgcgccggcggacgatccgcaaatcgccgtcgcggtgttggtgcataacacagatgtatacggttcgctcgccgctggcccgatcatgcgcgcgatgatgcaggaggctttgcagcagtgaaacttatcgaaggacagcttattcaccgccgatatcgtcttgattcgcgtcttgcgcaaggcggtatgggcgaggtctggaaaggctacgatattcagctcggccgtgaagtggccatcaaggcgctgcgctcggacatgaccaacgccgaggccaagctacgccgtctgcgtgccgaagcccataattccgccaatctggcgcatccgaatatcgctgcgttgttcgaatactacgagcatgacggcatcggctttctgattatggaatacgtcccctcgaaatcgttggcggacctgttccacagcaagggcgcgatggatcccatcgaactgctgcccatcctgattcagaccgcgcgaggcctgttcgtggcccactcgcacggcgtgattcatcgtgacgtcaagccggccaacatcatggtttccgacaccggcgaagtgaaaatcaccgatttcggtgtgagctactccacgggtcagggccagatcacccaggacggcatggtggtgggcaccgcacaatacatctcccccgagcaggcgcagggccagcaggccacgccgcaatcggacatctattcactgggcgtagtggcgtacgagggccttgccgggcatcgtccgttcaccggcaccactccggtcgatatcgccgcagcgcacgtgaacaatcccgtgcctccgctgccggactcggtggacgtccagttacgcgaatttgtcatgtcaatgctggccaaggacccgttggatcgcccgaaagacgcgctggtggtgtcccgtacgctggcacgcatcgaacgccgtctgctggatcagcagaccgaaatggccgacaccgccatggccacgtccggcaatcgactgccgcgccgagtgaccagcacgccacgcattgttttggaggccccggcctcaagattgggagggaataagcaatgagcaccagtatgcccaccgcattggccggcggacgctaccagcttggccagctcatcggtcgtggcggcatggccgaggtccacgtggctcttgacacccgtctgggccgtaccgtggccgtgaaaatcatgcgcgccgatctggccaacgacgacatcttcctggcccgtttccgccgcgaagcacacgccgtggcccagatgaacaacccgaacatcgtgaacatctacgattcgggagaagaactggtttcttccgaaagcggcgatgccgagcgtctgccatacatcgtcatggaatacgtcaagggccagaccctgcgcgacatcatcaaggtcaacggcgcactcagccagcgcgactgcgaacaggtgatgttgggcgtgcttaacgcgctcgactattcgcatcgcatgggcattatccaccgcgatatcaagcccggcaacatcatgatttccgagcagggcgtggtcaaggtcatggacttcggcatcgcccgcgctctggacgattccgcagccaccatgacccagtcgcagggcgtggtgggcaccgcacagtacctttctcccgagcaggcgcgcggcgagaccgtcgacatgcgttccgacctgtattccgccggctgcgtgctctacgagatgctcaccggccgcccgccgtttaccggcgattccgccgtggccatcgcctaccagcatgtttccgaagtcgccacgccgccatccgccgtggtgccggggctgccgaagatgtgggattcgatctgcgccaaggccatggccaaggaccgccagaatcgctatgccacggcctccgaattcaagaccgacatcctgacctacatgaacggcggcgtgccggtggcggccgcgttcaacccgttgacggacctgtcgaatatgaaggcccgcaaggaagccgaacgtgatttgcccaccacgccggtggaaccgcatcagcaacccacccaagcattcaacccggtgaccggtcagttcgagcagattccaccggccaatggtgccaactcagcggcgttgcagtcccgtgcgcagcagcgtgcggcggcggccaaggccaagaagcgcaagaagatcatcatcggttcggtgatcgcagcgattgttgcagtgcttgtcattgtgggcatcgtgttcgccatgaacggctccggcaacaagtcctcggaagacaccgtcaccatccctgaggtgtgcaacgcttccacatccaaggacagcatcgagctcaaactcaaggcatcgggtttgaagatgaccgaaaagcaagacaccgactccaccgagccggaaggcacctgcaccaagatgagcccggacgccggctccaaggtggccaagggatctgccgtgaaggtgtggttctccgcaggcccgcagtccactcaggttccggatgtcaaggaacgcagccaggaagaggcgcgcagcattctggaaagcgccgggttcaaggtgaacgccgccgtcaaaaccgaagacagcgccgacatcgccaaggatatggtgacgaaaaccgatcctgccgccggtcagtcggttcccaagggcaccaccatcaccatatatgtttcttccggcatgaccaccgtaccgagcaatttggtcggtcagtcgaaggacagtgtgctacagcagtatgagggcaagttcagcttcactgtggagcaggagagctccgatacggtggaggccggtctgattacccgtgtaagccctgattcgggctcttccatcgcacagggcgggttcatcaccatttgggtgtccacgggcaaggagaaggtcgctgtgccgaatatcaccgctggcactgactacgtcaccgccgaactcatgctcaaggccgtgggcctcaaggctcaggccaatggtccaaccggcagcaccgctgtggtagtcagcatcaatcctggcgctggcagccaggtagatgcgggatcgaccgtcaccattaccacgaaggccggcagcactggcggcggtaccggtaccggagacggtggcaacggtactggcaacgggggcggaaccggtgagtgaaccggtgagtagcaagtaagcgccgggcgtgtatgtgttgcgcatatgcaacgcaaatagcgcaacacatacacgcaacacaaaggggaagggcttctgcgcccctcccctttgctgtataaagagctatcccagcgcaacaatcccgggaagcgtcgcaaaaccagtacgcaagcctcgttctagcgacacattccggggagagtatcgccgcgcggaaaagctacttcgtaactttgggctggaggccggcggacttggccacggcgttgtcttggccgcagaccttaagccagttggccagcagacggtagccgtcctgggtcatcacggattcgggatggaattgcacggcgtacatcggcttgcccttgacacgcacgccctgaataatgtggtcgccttgcgtccacgcggtaaccaccagcgtatccggcaccgaatcgggctcgacggccaacgaatggtagcgggtggcggtcatggggttggccacgccctcgaaaatctcgtcatcgatatgttccaccaagctggtcttgccatgcatgatggtgggcgcatggtccacagtgcagccgtacacctcagcgagcgcctgcaagcccaggcacacaccaaacatcggcacgccgctggccgcgcacaggcgaatcatatcctcactggcaccggattcggccggagcaccagggccgggagaaatcagcacgccatcgtaaccgtccagtacacccggcgcggctgggtcgatagcgtcgttacgcaccacatcaacagtggcgccaagggtttgcagatagcctacgatcgtgtagacgaaggaatcgtagttatccaccaccaaaatatgcgcggaatcggtcatagggctctccttgagggacgtgtactgcaagccatagtactaggatgccgtcagctcgctgccacgaagttcgacatctgctgtaggaatgggatattggcggcggcccaagggaatccccactggaacagcgccgcggcggccgcgaacagcagcagagccagcagcaaccatcgaatcggtgccacgccgggctgcagacgcaacagtccgccatagatgctggcatccggacggcgacgctcacccgcgcgaatctcgcgcagcaccggccagcgccatgccaccgcagcggcaatgaacagaaccagccacactaccagcgcgccgaataccaccttgtccagcgagccaatgcgggaagcgatcgagggggtttcggtggtggagaacatcactgcaccggacgaatcagtagtagccagctctttgggcacaccgtcggacactttggcccagtacgccaactcaccatagctgatccatcgatgggtgggggtggagtatttcggctcacaggtggtcagtgtgatcatgcgtttggtgggattggcagtggagtcttccggattgggggcgatcacatgcacgtccgtgggcagcacaatctcgtaccgggtgtagtggtagacgtaccagtaatccttggtacgaacgatgatgggatcgccttcctgcaacttgtccacatcgcccaacggctgcccgtagccgttgcggtggccggcgacggcgaagttgccgacctgccccggcatctgggtggtgtcgtaatggcccagaccgtggcgattgagctgctcgagcgtggtgccttccacgatgttgcggtgccattgggagccgaagcgcggaatgtagatctgcgcaatcaagtcgccatatttcgcgtctttcggctgtaccggcgcatcgccctcctgggctttggcgatggtgaccgttcccccgttgttgctggggtcgctccagtcgacggactgggtggtttcgttctgggctcgctccgcctcgacaccggtccaccacatctgccagacgatgtacagggcgcaaatcacggcagcggtaatcagcagttcggcgcagatgccgagtgcctgccagaccgggctccgctggggcgaagacgcgccgcgtactgcggcacgacgggaccttgccctactggcgttggccgggtctgccgccattcgtgcggcatcgtcctcggggaagggctgtacgtccgacacggacgcgagatcaatgggcgccggtacgccgctgttgtgcctgccgtgtctcattgctgagtctgctcctcatctgtggtctttgacgtatcgaccgtggcatatttcaactgctgcagcaaggcggcggtagcggggaactgaaggtcctcggcattctccaccttgtagccaatgccaaacgcggtcacatattgcttaagaatggtaatggcttcggagtcgttcaacgctgcgcgaagtctttgagggtcaccaatcgcggaaatggtgaacggcggcgagtatttcttaccgtgcaacgacagcacgttgccggaacagatgaccgccgaattgaacagcacccgctgatccataatcatcagcgcatcggcaccgccggcccacaaggcattcaccaccgattcgacgtcctgctggtggatcacgtaatcgttgatattggcggtcgtgccgttgttgttgactgcgttctcccacaacggagaatcatccagcgttaccgttacgccgctgccgctgagcgcgggcagcatcaggctggaatccacattgctggagtccttgccttggttctgtgtgctgtcggtgccatcggtgccatcggccttgagcgcgtccgtaagattggcgacctgtttggtcagatcgctgacgtcctgctgcagctggttggcctcgtccacgccttgctccaccagatcggccgtatcgttggtggcggcaaccgtacgattgaccctcacgttggtgctcagcagaaaaccggtcaaggcaatgacgacgaataccgcgacaccaccccatagggagtgccgtgcaccgtgcttacctacatgtctggccatgaatttcctgtcttcttgccgactctggtcgccgctttcgagtgtagccactattatgacttttagcctattgaatggagactatgctgatggctgacgaagagctgcacgaaaccgactcgaacaaccagaaggactggcagagcgagacctcatccagcaccgttgctgacgagaccgccaacaaagacaccgagcagaacgcagagaacgcttctgccgaggaagacgcggcttacggcgtgaatatggagcaggtgcaggccgtgctcaacgccactgccgataaggccacgctgaccccgcagatgcagcgtatgatgaaccgccaggcggagaacaccaagcgcgttgaagaaaccattaagggcaccaagtcgaacccgcgttggttcgtgccgctgttctgcgcgtttatgatcatcggcctgatttggtgcgtggtgtactacctctccccgtccggttcctggccgattccgaacatcggtgcgtggaacctcggcatcggcttcgccctgatcatgatcggattcctgatgacgatgggatggcgctgagttccggctcgttgcgcttatctatcggtagattgttttttctatcgttaggttgtccttaattcttatgagaaaggccgacctcccgtatgcggaggtcggcctttttcgtgccttagcctgttcatccacagctatccaccacttatccacgacttatccactacgttatccacagcctgtggatgaattacacccatgtagttttccaccgaatgtggaaaaccatgtggataagtggtggataagcggcgtttctcggtgtatatctcgtgcataactttggcttggcatacatcgccacagcgagggaacagttatacacccgagttatccactgcaacaaacccaataataccgcggcattcctaacttatccacataagttatccacagtcttatgcacttttctacacacttgtgcacaagtcaccattgtggataactcattatcgtggataactcgtcattgcgcgcatctcattactgtggatatcttcatacggcacacacccactcgccgaacgacgatatccacatcgctaatatccacatcgtcgctttccgcacatacattgatgccgggcactgcatgttccgcaatacccggcatcaatcgtttttttttacagccatatcaagccatatcaagccatatcaagccatatcaagccatatcaagccatatcagtgcagggagccgaaactcatccacccgtaaggattggccatattgcacaacagaatcaacgcaatgaccagcaccaccatggcccagccgtacacctgcatgcgccatttcaggcttttaccgcgccacgccggcacaccacccaccagcagccatgtgagtattccacccactacaaagccgccgacatgcgcctgccacgccacgccaccgaccacgaacggcaaggcgaagttcaccgccatccagatcaacatggagcggatatcggcgccgatacggcgatataccaccagcaatgatgcaaacaggccaaataaggctccagaagccccataggctgccatctgccagccgatgcctcccggagccaccgcagcccacaccataagtcccagggagccgccaaggccggaaatcacatacagtcccaagaaccgccagtggccgatcattcgttccagcactgggcccacggaatacagagcaatcatgttgaacaggatatgcaatagcgagttcggcgcatgcaggaacatcgaggtgatgagcgtccacggctcagccaccagtctgaccggagccgccatgccgaggtacatcaaccaagccctcaggcccggggcaataaatcccaacaatacctccagtagccacactgccacgcacgcaacaatcagcgcccaggtcatcaccggaccaccgcgctcccactggtatcgaatctcccgttgtgtaggaatatgcatgcagcccactgtatcgaaggtctcggatgcgttccacgcgccgcgaagatgccgagccggccaagggcagacgggcgcggatgaatcgcccacgaatgtcattccacccaatcgtcacaaacagcggcctagaatagggagcagagtcggtctgaatgggcataccgaccagacgatccctagggaaaggagccgtcatggagaacaagtcttctaacggttggaagttcttcgcgctgctgttcggcggattgctcgccgcgcttgttggcctgtacatctacaagcagcagaacccggattacgatccgtgggaggagccgtgggagaacagctcctcgccggtcgacctaggtctgaataaggccgaggatgaggccgatgacgaggcgaaagccgccccggccgaagcctgatagggcggtctttcaacgcaagaagccccgcaaccgatggatgtcggttgcggggcttcttatgctccggcggccgtcaggccagaggagcagtgtgccagatacgttccaaatagtcttccatggagcggtcggagctgaagtagccggagttggccacgttgagcagggccttgcggttccattcgagctcatcagcgtagagggcctcgatctcggactggatgtccatgtaggcggagaagtcggccaaggtcatgaaccagtccttggtcagccagtcggccacgagcggggagtaggcgttgcggtcgccgttggagaaggtgccgtcggccaccatatcgatggcgtgcttcaggcgcgggtcggcctcgtagtaggaggcgggattgtagccctcggcgtacttcttctcgacctcgtcgacggtcatgccgaacaggaagaagttctcggcgccgacgcgctcacggatctcgacgttcgcgccatcgagcgtaccgacggtcatcgcgccgttgagggcgaacttcatgttgccggtacccgaggcctccttgccggcctgcgagatctgctcgtcgaggtcggtggcgggaatcaggtgctgggcgaggcgcacattgtagttccacgggaagtacacggccagcttgcccttgacgtccggatcgttgttgaccacgcgggagacgttgttgatgagctggatggtcatcttggccaggtagtagcccggggcggccttggcaccgaagaacacggtgcgcggggtgacgtcctcggccttgaccttgccggacttgatgtcggcgtaggtggagatgacggacaggatcttcagggactggcgcttgtactcgtgcaggcgcttaaccatggtgttgaacatggtgttcgggtcgagctcgaagccgtactcgcgcttggcgtaggcggcgaagtcgaccttgttggccttcttgacggcggcgaacttcttgacgaattcatcgtccttggccagcggctcgaggcccttgagcatctccaggtcggagagccacttgtcggtgccgaggccctcggtgatgaggtcggacaggcgcgggttggcgagcttgacgaagcgacgcggagtcacgccgttggtcacgttggtgaacttgtccgggtagacgtcggagaagttcttgagggtgacgtccttcaggagctgggagtgcagctcggccacgccgttgacgtgggagccgccgtaggtggccaagtaggccatgcgcacggcgtcgccagtgtagatggccatgtccttgatggtgttcttgtcgacgcccttggacttgagctcgtcctcgaactgcgcgttgatcttctcgatgatctcaaggtgacgcggcagcagctcgccgatcaggctggccggccagacctcaagggcctccggcagcagggtgtggcaggtgtagttgaaggtcttggtggtgatggaccacgcggtatcccagtcgtagccgtactcatcgatgaggatgcgcatgagctcggggatgccgatcaccgggtgggtgtcgttgagctggaagacgatcttgttcgggaaagtcgtcagatccggcttgtcctggcccgggtagaagacgcggatggcgtcgtgcagggaggcggagacgaagaagtactgctgctcaaggcgcagttccttgccgaccttggtggagtcttccgggtagagaatcttggagatgttctcggccttgacctgcggggtcacggcttccatgtactcggagcggttgaaggcgagcagatcgaactcgtcgtagctcttggcgctccacaggcgcagggtgttcacgcggccggacttgtagccggggaccaggtagtccaccggcacggcgcgcacggaccatgcgggctgccaggtcttggtgccgtcggcgttctcgacgaccttgccgccgaaggaaaccttctggtcgcggttgtagtcgatgtggccccacggctcttcgttggccagccagtagtccggggtttcgacctgcttgccgtccttgtcgaactcctgcttgaagatgccgtacttgtactggatgccgtagccgaaggccggcacgcccagcgaggcgagggagtcgatgaagcaggcggccagacggccgaggccgccgttgccgaggcccggctcgtattcggcgtcgacgacgtcctggaccttgaagccgagggcttccacggccttgtcgaactgctcggtcagaccggcgttgagcagcgcgttgcgcagctgcttacccatcaggaattctgcggacaggtagccgacggccttggtgttgccgttcacggtgtcggcctgggtcttgaaccaggagtcggcaaggtggttgcgcacggccttggatgcggcgacatacacgtcagcaggggtagcctgctcggtggtgacgttctgagtgtatttcagttgttcacgaatctcgtcggcgaattgttccgccgtgacaggagacttcggtgcggtgatttcggtcattctgactttccttccgggataagtgcccgtgtttattatgccgcgcgataggtatcgtcgcacaaacgtaagcatgaactctccgtaacgacgatggcggagcgttcttgcatacgttctcatttagagcgtagcacatgccccgatattccgcatcacaccgtatgccatcgtttgcattatggaagatcttccggctccggtgccatgatgggatgcatggcagtaattcttgaaaaagacctgaaacgcgggcatgacgcgctggtgcaatggcgtgccgcggcccgggagctggcggacaacacaccacatcgtctgaccgtctcccctgtcttgccacgcccggtgtgggcgatggccgtgcgctactcgctgtttctgctggagcggcgcgcacccggccctggcgtggaggtgcgtgtcgcgccgtggggggcggtcaaaatcttggacggcccggaatcggacccgcataacctgaccccgccggacgtcatcgagctggacccggaagtctggctgcggctggcctgcggcatcaccacatgggcagaggaaaaggacgccggccacatcagcgcggtcggcgagcgcgacgacctgagcgacctgctgccgctgtgaggcgcgaagcgtaagtaagccaccagcggcggcaccatcagccataaccacaaatccccttgtgctcaccaagcacaaggggattattacgagaagaccggcgttcagctcttcttgggcttgagcgcggaaggcatgggcatcggaatcggcttgcgcggggccggcttcggtgcggcaggcgcggaggccgggaactcgccgctggtcgcctttgcggcggcttcggcagcccacttggcgtactcgtcgaggtcatcctcctgcgtagcgggagctgcctcggcggcaccggaagcgtggtcatcagcagcggaatccacatccttgtccgcatactggtcatcgatgtcggcgaacgggtcaggagagcccattcccggctcctgctcgctcagctcttttgccagctcatcgtagtcggtatcggtggtcaggtacttgagctttcgggcaattttctgctgttttgctttttgacgtccgcggcccatctgaccccctgcgattactgtgctgttcgattcatcaacaatagagagtaccactaatagtggcttgttcgttgtcggctcacacttttaccataaaaagcgtttatttagggcatattcaaaggattttcgcatgaccgacgagcagcaactgacagcggcaggcaatgagatgagcgcgagcttcctcgcggccaaaaagcgttcggacgaaacgctcgccaagctggaggccaagccgtcgtccttcaccatgttgaccggcgaccgcccgaccggccggctgcacctcggccactacttcggctcgatccgtgagcgtgtcgccatgcaggagcgcggcgtcaacacgaacatcatcatcgccgactaccaggtgatcaccgaccgcgacaccaccgagcacatccaagacaacgtgctgaacctggtgctcgactacatggccgccggcatcgatccgaacaagaccatgatgttcacccactccgccgtgccggccgagaaccagctactgctgccgttcctgtccttggtcaccgaggccgagctgcaccgcaacccgaccgtgaagtccgagatggaggcgtccggccacgcgctgaccggtctgctgctcacctacccggtgcatcaggcgtgcgacatcctcttctgcaaggccaatgtcgtgccgatcggcaaggacaacctgccgcacgtggaaatcacgcgcaccatcgcccgccgtttcaacgagcgttacgccaagaagaacccggtgttcccggagccggccgccattctgtctgaggcaccggagattccgggtctcgacggccgcaagatgagcaagtcgtacggcaactccatcatgctgggcgccaccgccgaggaaaccgccaagctcatcaagaagagcccgaccgattccgagcgccgcatcaccttcgacccggttgcccgcccgcaggtctccgccctgctgaccaccgccggcctggtgaccggccgcgacccgaaggacatcgccgaggagatcggtgattccggcgccggcgcgctcaaggcatacgtcatcgaatcagtcaacgagttcctggccccgcaccgcgagcgccgcgccgagctggccaaggacatggattccattcgtgacatcctgcacgacggcaacaagcgcgccaacgccatcgccgaggagaccctcgaccaggtgcgcgaggccatgggcatgaagtactgattttcccgccgctcgtagcaagacgccgtgtcagccccaactgggcaactgacacggcgtttttgtattgcggcgtctgctgtgtcctatcttcacttcgaggggcggatttcttgtttttccgtgcaacgcggctatcaagacggacctctgttcacttcatgccgatggcttgcatcaatacgtacgctccccgcacagcaatgtcattacgacgtgttgcggcatagcgcgcatggcttccggagtatcggcggcgtatgggtcggcgtccagcaacaccacatcggccgggtcgccggatgcaaggcggtcacggccagtggcggtcgaggctgccagcgaggtatgcacatcgaggcactgctcgggctggaacggctcgcggtcagagctttcggtgccgagcacggcggcggaaatggccagccacgggtccagcggggccacgggcgcatccgagcccatgcgcagcgtggtaccggcgtcgtggagggccctgaacggataagggatgccggccgggttggcccagaaacgggtgatgacgtcgcggtcatccatggcgtgctgcggctggatgctggccgtgagccccagctcggcgaaacgcgggatatcgacgggtttgagcatctgcgcatgctcgatcgatccatgtgcgtgcgtggcggcgactgcgttgagcgcaatggtgttcgcttcgtcgccaatggcgtggcaggcaatgtcgaagccatgctcggtggctaggcgcatatagtcttcgatttgctgcggcgtgtagctcagcgtgccatacgtcagcggctcgatgcccgaatacggcgtggagcagtaggcggagcgggtgttgagcgatccgtccgagatgagcttcatggcgcccacatggccaagcccggcgctgcccggcaattccttgccggtatgccaacccgcgtcaatggcggctcgcaaccgctcggggtatacaccggcgtccacgcgcaaaccgttaatgccggccgcgaaacgattgatccatgtatcgatgttttcggccatttcataatcgcggatgcccaccacgcccttgcttgcggcgtcctgttcggcctcgcgcagcagacggtcagtctcttcagcagcgcccggcgccttgtcgaaggcggtgtaggcgttgaaccattcgagttcaccgaccagaccggattcgtccacatgtacgccaagcctgcgggccgcggcggaattcacccatccgcagtgcatgtccgcgctggagagggccaccggctgttcgccggtcacggcgtcaattgcggccagtgtgggctgctcgtcgtcggcccacagcgagtgacggaatcgcatgcccaccacgaaggcatctgggtcaagcgtgtcggcggcgcggcgctcatccagatgacggcgcaacatgtccatcgcttcggcggcggaacgggcattgatgaggtccagtcggcccagcgtcttagcccattgcgtgaagtgcgtgtggcagtcccacaggccgggaataacccacaggccgtcggcgtcgatggtggtttcgtcggcgggtgcggcggccgacgttgggattgagacgctgccagaagcaatggcattcgtcgcgtattccaacgatgtcgtatgcgccttagtctgcatcgtgctgtccgaagccgagaccgttccagcagggccgacagacgcaacaaccccatcgcgaagcaccacatccacgcggtcctgagaccccggaacaccggcattgacaatacgcaccaagctactcataccggccatcatgccacctttgcatgaacgccatggagattcgtccaagttgaatcgcgccgtcgacggcgattcccgctggctgcctgcaaacccctacgttccatgtaattgcgggatggcctgcaactgcgatgaacacccatagtttatccaccgacttatccacatttatccaccgaaaaattagggcggtagacagggccggtagccggactctacactgcgaggacaaagcgaacatcacgaaggggtgatcatcatgggtagctcaacggcattgaccgagctgacaatgcagaagtaccaacgaatgcagacgtgcgcagatgttcaacgacgaagcgcatggcgcccaccctatgccctgacaacagcgttggagcttttgtcaattgaagtaccccgcatatcaagcaaacacagaggccttgcaactacaaccattgttgcggttccacacgccaatgacaaacggcacattgtgggggtcaaagtggttgtatggccttttccactagacacggtcataatcgagggacaattcacatgcacttcaccagcttgcacatgggccatgttctccacgtatctcgaacttgaagaactcatcgttctcgctgattccatgatgcgacgagatcgaaggctctgcagaacaaccatcgacgccctttctctgtatctcgatgaggccgaggcccaggtgcgagccgacaaagagaatggcaccaattcgtatttgttccgcgggtataacaaatgccgtcgcgccctacttttggcgcgcgcgggcacagattcctccatggaaacacgaactcgtttggttctcttgaaatacggtctgaattgcccgcaggtgaattatccaatattcgtaggaaacaacaccagacccatatatctcgatcttgcataccctgaattcaagatatgtatcgaatacgaaggctctcatcatgccgggcaatggctgaatgacgcgagacgccgccagatgatcgaagatgctggctggaagtacattcaagtcaccaaattagatattggcgacgaagcgggagaagaggcccttgcccgaagagttgccgaaaggatacaggaggttacgggcaaaacggtccagctcacgatgcggcaaactacccagcaaattagcgatgtccgaaagctacgccgtattccactgtacaaacggctgaaattcgagcctctgctgccaattattccgacgacgcaggaataataagcccggtagagtcagtccgcaccgtccgcaccgcgctacggtattcaaaacccatttcaaggggctgatttggcctccgccggaggtctacttccgtttcaaggggctgatcatccgctagaccacgtgtatcaatgcctttacgccaacgccattccgccgttttggagccgcgtctactcaggcatcagccccttgaaacggaagtagacctctccagaacgtcaaatcagcccctcgaagtccgttttggcctcaatggttcctgccgaaccacaaaaaagccactcctctgccatacgaggcgaccgcacagcaggcacgtgtcatttgccgctgcggacctcggactccatggcttccatgggctcgtcgacgagcacggtgccggacggcaggatgccgggcagcggatcgtccatgtagtggtcgaactcgtagagcatacgctcgttcggcttggcggtcagcaacgaaaccaccacgatgaacagcagcgaaatgatgaacgccggcagcagctcatagatggcgaatacgccgcccaagggcttgacgaggttgtgccagatcagcacggccgccgtgccggacagcatgccggccacggcgccggccttgttggcgcgacgccagtatagcgagcacagcatcaacgggccgaatgaggcaccaagcccggcccacgcgtaagacaccacctggaagatcgacgagttctggtcgtatgccaccagaatgccgaacaggaacatgaccaccagcgtgaccctggccacaatcatgacctgcttgtcggtggccttgcggtgcagcagcccgcggaagatgttctcgcccatggccgaagcgccgatgatcagatacgaggagctggagctcatcgaggccgcgaaaatgccggagaccaccacgccgcacatgaagctcggcagcagggtctgcgccagcacgatgaagatggtttccgcatcggtggaggtcagcagttcggtgggcatcatcgcacgccccaccaagccgatgcacactgcgcaacccagcgaaatcacgcaccaggaggtggcgatgattcgggacttgcgcacttcttccacgctgcggatggacaggaagcgcaccagcacctgcggcataccgaagtaacccaggccccacgccagcatggagatgatggtgatgatgccgtagtcggagggcgcgccgaacacggctttgcccgcctcgacgagctgctggccggtggccgggtccagcttgggcgcggccacctgcgtgccggacaggtagccggggatggcacgcaggaattccacggtgttgtcgatgccgcccgcgctggccacggtgccgatgaacaccaccgcgagcgcgaagaacatgagcatgccttgaatgaagtcggtcatcaccacggacaagtagccgcccaccacggtgtagacgaacacgaccaccgcgccgatgatcatcatgacgtggtagtcgaaaccgaacaacgtggcgaacagcttgcccacggtcacgaagcagctgcccacgtacacgctgaagaacaccaggatgatcacggccgcgatggtggagaccacgcccttcttgtcatggaaacgcttggcgaagaagtcaggaatggtgatggcatcgccggccactaccgagtagcggcgcagtcgccgggccacaagcttccagttgagataggtgccgagcgccaggccgatggcggtccacatcgggtcggccgcgccggtgaagtaggccaggcccggcaggcccatcagcagccagccgctcatgtcggaggcttcggcgctcagggccgtgagccacggccccacgccgcgcccgcccgcaaagtattccttggaggaggagttggagcgtttggagtagatgaatccgatggacagcatggccgcaaaatagatgaccatggccagcagaatccagaaatcgttggccaactgcgacacctccccaatcatgacgccaagcggctaccgccatggcagaactatgtgctgatatgcgtgctgatatgcgattgacgccggagcggcgtcatacagaccgtcacagccgtgaatacggccgcaacgcacttcgcctgatggtagtggatacaagggctcaagcaccttccaccgtttccatactgagacgctgttttatccgagctccccccacctgaggagagccaagatgacggtcagatgtcgtagcgccaggacttgtcggtcaccacgcgggccatcgccaagccgatcggcagacagataatcaccatgaacgcacggaacgcccagtccagcgcattcatggtctggaagctgccgaggtaccacatggcacgatacatatacagaccgggcaccatgatcacgatcgacggcacggtcaggcagatgcgcgggtagccgaggtgcggcggtagccagccacgtcgcacggatgaacgccacaccgatgccagaatgcccgccagaaacgcgccgatgaaggtagccatctcgggtgccacgttgaagtcttgcaattccaagcgcagcgtgtccgtgatcgcaccgatcagggcggcggtcaggcacatgcgctgcggcgaattgaacagcacggagaagccccacacgccgacgaacgccgccacgaatcgcagcaatccgttgacccacgggtcaagccccagtggctcaaagccttccgggtgcaggtgcaccatcacggccacggcccagcctgccagcgtggccatcaggatgatgcacagcacgtacgccacgcgctggatgcccgaggggaagtcgattttcgccatgtcgagtccgcctgtgatgagcgggaaaccggggatcacgaacagcatggcgccgatgtaggccgtatcgtgcgagagcgcgactgggtcgaaaatgccgatgagtcgcagggtgccggtgcaggcgagcgccgccgcggccacacacacaaaggtgacgaagaactggttcagatggtatgcaaacagccggcgacgcatccactggccaaggcccgcgcccacgaacgcaccgatcatgtcgtatgggccgccgccgagcaggaacacgaaggccgcgcaggctagggcggaggccagaccggagaaccacggcttgtacagcggcttgcggcgctcaatcagatcgagtcgctcgtgcgcctgccgcacggtgataccgcccttggccttctcttcgtcggagcgctcgttgaagtgttcggcgtattccttgggcacgcgattcttacgcttcgtactgcttgcagcagggctttcggcggttgcgccgttcgccgcgttcgccgattcaaccgactcattggagtcaccggtaaacacttcggcatcgtcgtaggccttctcttcggccgctttgtcttcgaccggagtgacttccgcgctgtccgccaaaagtcggtgggcttcttcattgtcatcgtccaaggacttggccacggaggtcacgagtaccttggttttcgacgcaagatccagcgcctcgtccacgctgccgttggccgcctcagcctcgaccttggcacgttcgcgcaggcgcttggccagatcggccgaatactgcgaagcgtcacgttcgtccaaatgcttgaccacgccatcggacagttgcgaatcaacgtgatacatcgaccccttgccgagattcacggagaaccagtcggcgaaatgttccagcagccagatacgttcggtgttcacgccggtactcggcaaatccacgacttcggtgatgcggttacgaccatccgtgcaggtggcctcgatatccgtcaggttcacgtcggcgcgtacgtgcacgcccagcgggtaggcgatgcggtgcatcatttcacgcacgcggaaggagccggtgccggctcccaggtccaacatgccgactcgtacaatcacgctggctttggcggcgataccggcgtccaccaccggtttttcccaatcgcgtgcaatatcttccatgtccagcggaatggagtgggtgtggaatttacgtacagccgttgcgcctttcgcttcgggcgcactttttttcttctgttcgctcacatccttcattactactccctgccttccccgccagcaatcgtaaggcgctcaaatcttccgcgaatcggacagtgtctcatatgctgtccgatattcggtctctataggtggacaacttggcgcactatatggacttcgtaacgtaaaaagcgatttcgcggggatacactattgcccacacaacaaccacgttgaatatgggctgtgggctcgcaacgactggtctcaacaactgcggaggagccgcagacgaccagtagaccgagcaacctgttattcggcaaaggaggttatatggcaacacctgaagaacagatcactcccgctgacgccgccatcgtcactaccgggaccggccgaaagggcccggaggagcatgatcttcccgaaagcctgaagtacgacatggatctgtgtcttgagatcctgcgtaacgtactgggcgaatacaaccccgaactgctgtctacgttcgacaccgtgcgtcattacgcggtggaggccagcgccgagcatttcgccgagctgaaggatccgaaccccgaccaggatggcctgaaggaggccgtgaacgtcatcgacaacatgacgttgcacgacgcccagctgctggcccgcgcattcgccacgtatttccatctggcaaacctgtccgaggagaactaccgcgtttccgtgctccacgagcgcgagaacaacgtgcccgttgaccaggcggtcgatccgatcaacgagctcaccgtcgcctaccaccagctcatcaatgagactggcccggccaaggccaaggaactgctcaaccagctcgaattccaccccgtcttcacggcgcaccccactgaggcccgtcgtaaggccgtggaaggcaagatccgccgcgtttccgaattgcttgaggagtacaagcgcctcggcggctcggataagaaggaatgcctgcgccgtctctacaacgagatcgacgccctgttccgcacctctccgatcgcgctgaagaagccgaccccggttgaggaagcggacacgattctcgacatcttcgacaacacgctgttcaacaccatccccaaggtctaccgtcgcttcgatgactgggtcctgggcgataaggccggtctcgtcgagcccgcttgccccgcgttcttccacccgggcagctggatcggctccgaccgcgacggtaacccgaacgtcaccgccaaggtgagccgcgccgtggcccgcaagttctccgatcacgtaatcgccgcccttgaggaagccacccgcaccgtgggccgcaacctcacgatggaagccgagaccacgccgccgagcgccgagctcaagagcctctggagccaccagaaggaaatgagcgagcgtctgaccgacaaggccgccctgatctccaccaaggagatgcaccgcgcggtcatgctggtgatggccgaccgtctgcactacaccatcgagcgcgacgccgacctcatgtaccactcctgcgacgacttcctcgccgacctcaaggtggtccagcgttcgctggccgccgccggtgccaagcgttccgcttacggcccgctgcaggatctgatctggcagaccgagaccttcggcttccacatggtggagatggagttccgtcagcactccgtggtgcatgcccgcgcccttgcggatatccgcgagcacggtctgcacggcgagcgcggcgaactgcagccgatgacgcacgaggtgctcgacaccttccgcgctctcggtgccatccagaagcgcaacggcctcaaggccgcccgccgctacatcatctccttcaccaagagcgcccagaacatcaaggatgtctacgagctcaaccgcttggcattctcccacccggaggacgtgcccaccatcgacgtgatcccgctgttcgagcagcttgaggatctgcagaactcggtggacgtgctcgaggaaatgatcaagatccccgaggtccaggctcgtctgaaggccaccggcaacaagctcgaggtcatgctcggctactccgactcctcgaaggacgccggcccgacctccgccacgctggccctgcactccgctcaggagcgcatcgccaagtgggctgagtcgcacgacatcgacctgaccctgttccatggccgcggcggcgccgtcggtcgtggcggcggccccgccaaccgcgcggtgctcgcccagccggtcggttccgtcaagtgccgcttcaagctcaccgagcagggcgaggtcatcttcgcccgctacggcaacccggtgctggccatccgccacgtcgagtccgtggctgcggcgaccttgctgcagtccgcgccgagcgtggagaagcgcaacaccgagatgaccgagaagtacgccgatatggccgctcagctcgacgaggccgcgcacaaccgcttcctcgacctgttgaacaccgatggcttcgccccgtggttctcgatcgtcacgccgctgaccgaaatcggcctgctgccgatcggctcccgcccggccaagcgtggcctcggcgccaagtcgctcgacgacctgcgtacgattccgtggatcttctcctgggctcaggcccgcatcaacctggccgcctggtacggtctcggcaccgcatgcgagaagttcggcgatctggagaccatgcgcaaggcgtatgaggaatggccgctgttctccaccttcatcgacaacatcgagatgtccatcgccaagacggacgagcgcatcgccaagatgtacctcgccctcggcgaccgcgaggacctcaacaagaaggtactcgaggagatggagctcacccgcaagtgggttctggccatcgtgggcgacaagtggccgctgcagcaccgtcacgtgctcggccaggccatccgcatccgctccccatacgtggacgcactgtccgtcactcaggtgctggcgctcaagtcgctgcgcaagaaggtggacaaggaagagctctcgcaaagccagcaggccggattcatctatctgatcctctgcaccgtttcaggtgttgctgccggcctgcagaacacgggctgattcccggccgaccgatcgacaaaagcgagcggggaggttccgtgccgataaacggcgcgggcctccccgctcgcgtcatccggccctagactggccggcgacggcgcacgccgggcgggcgcgcagagaacggacgcgcggaacgggcacctcgacagatcggaggggacatgggcaagccagcgggcgggcgcgggaacaccgggtccacggacggcatcaaggcggggggcgacgccgggaacgaacgccacacttgcaaagcgaatccggctacaaccgatggcattgggaagaaacacggcacagaagatacgtcagaaaatttttccggcgagagatgtgctttggcaccgaaagcagctaccaaattccctaaggcgagtagatgctatgtggctttgggcaaggccaggcgtgcgctatggtggctgggattactgctgctttcaccagcacttattttgtgggcggaatggggcgccaatggcgatgatgatactataatctgcagagtcttaacgttctcttcctcttcgtgcatgaatttaactacggcaactgagtatgtacgtagacttaccttagtattgattatgggggtagtctgctggattgcggcgcttgtcatctttggcgtgcgttcatatatgcgatctgtatatccggaacttcgtgatcattcctcttccgcctcgcatgtccttgtgggaatcatatcgtttctcgtgctggtcatggtctttcccgttcttgtgataacactactttccgctctaatgactctatgacgttttaccagaggcgcattgcgtggaatggctgaatcattccacgcaatgcgatcacaatcatgattgattaacggttcggatttttcaagagattcagcataggataatgctaatataccagcctccgcttgactcgggagtcggtctgcatgtgacgcaatgagcagtgcttttttacttccggatacgttatcgaatattccaagatcgattccatcaacgagctttcgaaatgcgatgaccaggttgtccgcacttcccttgaaccgagactgatagaaccgtttaattcgattcgtctcgctttgcgcgaacatgtcccgcatagcggtggacaatgacctttcggaggaattgctctgcatggaccgcgccagcaaccatgcatcacagtccgcgagaacatcgctgtaactgaatcccatacgagcgtcttgctcgccgagatgagcgtgcagccatgacgccaggtcctcttccggggcattcgccaggtagcttccccaaatctgcagcaaatccagggcccatccgcccagatcaccgagaccatagtccattggatcgttcgtaacgccccatgtcaagtatcccaaggatgtggcggccatatgggcgatgtcccgattgggcagcgtgcctttgatgacaggctgtgcatcacatgcgacaccgcatgcctgacgcgacaaggccaattcgctgggagtaaccggcttcggggcgtacgcgtgccatagtgcctgcgtgccggaacttccttccgaccagtactcaggtttgcgaagccactgcaggatgagttgaccgatgctgtcctcataaaccgccacctgggtacccagagcggcaggggctttgtgacactcctgctcgggtgtcgccgccggtctgcagaacacgggctgatccgcggctgaccgaccgcttgacgagcagggaagttccgtgccgataagcggcgcgggcctccccgttcgcgtcgcacggccctagactggccggcgacggcgcgcatagaacgggcgcgctggccgagtgacagactcggatgatcgaaaggggacatatgaatgaggagaaggacacggacggaacgacggacgcgcacgagggggaccacacgcccgcggacggtgccgggacggagggcgaaggcggcaagccggacactaggccgggcgacagactcgcgaccatccgacgcacgctgtggtggataggactggcgctacagctcccattcgctttgactctgatccattttgataccccttacctgatattggagcgtatcctatgcgctattccgccaagactggcaagcgacccgtcatcaatcgtcggcattcccgcacttgaaacggaatggtgtcgagaattcctggcactagtcctgggcgcagtttgctgggttacagctggagtaatgagattagttgcggacagcccatcaaaccatggaaaagaaacccttcctgtacgcatcttcgccggaatcatcaccatcatcgtattgatggccaccggtattacaggactcttcctcggcatagcggccttttagaagtttccccgtatctggcagaggaattccaaatcgaaagcacaacagcgaatgtgtgggcagacgacacatctgcccacacataatgcattatgcgagctaccgtcttggctgatcaatgaatgcagcgaacgcccgagcactcacttcagcttcctgcttatcaggaagcttgtctgtaccggcagccttttttaggatgctttcgctcattccaatatttgtcaaaccaagtgcatcaagaccgtccgccattgttgaatatgcactcaccacattatctgcgcttgatgcaaaacgttcgtcgtagaatcgaacgatacgatgggtctcactctgcttaagaaaaattgaagcaaaacacgcagagccagcaggcaggattcatctacctcatcctgtgcaccgtctccggcgttgctgccggcctgcagaacacaggctgatctacacaccagcgcatatggggaagccccgctcgatgtgagcggggcttccccgttttgtgtacatctttcaccatcttgcaataattcttacatgtaaacagagagttcttacatgaaagaattattgaaaggtgatgaaagaacttactttcacgcgcgccaatcatcccaacacgtatcgggatgacggcccattcccctcgcggcgcaacttgcccgcatcctctagcttcttcaacaaccggtatgcactgatatagctcaggccaaacaaatccatgacatccgccgtagtgacgacaccatcatttttttcggcgaactccagaacaaggccactgcgccgggtggcatcgatgtcacgctggcgcacgtaagacgccagcccctctgaacgtttgtacactcgggcactcagcatatacgaacgagagctcccgctaccgaccccctctaccaaaccagcttccaccagattctcaacagcggacacgatgcgtcgatgctccaaatgggagaaatcgcacaattggaccacggtaagcctacgatgctcacgcagcagcgagagcacaatcagtgaccagaccggcaatggagccccacgtcgacgttcctcgtcgccaatcatggttacgaatgcctcgtcaggtaccacacggcgcaagaacaagataacttcctcagcactggactgtgaataatccgggaaagaaccacccgccgcaatcgacccggcatagatggtatccacgcctcgtccggtgcgttcaacatatccggcagctttcagaatcagggcaagctgcggattgcgggaacgcggttgtgcagtaagcaggttatcttcggaaacaccctctatgaatcctccggggttggctatggtcaacccatcatcatcaatcaggaatctcaccgaacccattcgtgcataatcgcgatggcagaaagcgttaatcattgcctcacggaatgcccctcgatcgaagtctggcagatcgacccgaatcaagccgctcatgacttcgtggctgggattccatggctccatcagctcgcctacacgatcaaacatatccaccaaaggcaacacgaacggatccatattgacctttggagacatgcctttcatcacttgaaaaacagccgatgcggctggaaccgatcgatgaatagcatcaaccgaaccaatggtgagcagaccagcaacagatggctgcaatccatacgggccatcaacaaccagctcaagtgcccgatcgaaatcctcatcagtaaaagacaacaacgagttttgcgcattggcactgcgaatacggcttctcaacttgttccgtgagtctggattcaaatcgtccaaccgagcctctggtgcaggttgcgcgctgaaatcgtagaaccgttgctgagataaacggctaatgaattgggaaacaaacagcggaacgacctcaggcgagccgtctgctttcagccggcgctgcaatgtcttcccctgactggtagacacgatttgctgactgttatccacctcaatactgactatcggcacctcgttctcatacaagagcgccacgcgagtgggaagctgcggaacagtcttattgaaaattagtaccgcaagtccattgatattgcgatgctcgtcacatacgccggtcacagtgccatcgtcttcaataccgagatacagtgtgccgccttcggtattggctagagccactacggtgtcaacaatttcatcatgcgattgaggacgcttctgctcactcttgaactcaaccgtcaaactttctttggccggcaacatgagcatcccctttcaccatcttgcaataattcttacatgttaacagagagttcttacatgtaagaattattgcaagatggtgaaaggggtaaagagcaatccatcctgtcatctccagcaacttaaatccgatcatcgctgctttcggcatatctgatatcagccgctggtgccagtccaatcacccaattgaagctcaacacggccaaagactctacgccgcagtggattcgcgctcgatgagcttatagcccacattcacggtctgcgggaagaattcatcgtccgggttctcgatacgccgcataagcaaggtcagcgcggtatccgccatgcccttgaaatccgtggccacggtggtcagcattggcacgctgtacgcaccctggctcaggccgtcgaagccgataacgcgcacatcgcccggcacgctcacgccatcatccgccagaccacgcagaataccgagcgcaataccgtcgttcaggcagtacagaccgtcgtacttgcacttgcctttcttagccaagccgcgcccggcctcgataccgccgtcaatcgaccacgaggatttgatgtaatcgcggcgctcgtcaaacggcagtccggccgcgagaatcgtctccttggcggcccgcatacgaatatcacgtgagccgggaatgatgttgggattgttgggatcgcgattgtcgccgacgatgccgatgcgcgcacagccgcgcgtaataagatgctggaccgccgcccgtgagccggcgtcgctcggcgcgttcacggtgtcgatgggcaggctggtgtcgtagttttccagcatgacggccgggtgccgcttcaggatatcgaccgcacgtggcgcattgatggcaatgatgccatccgaaaacgtgtacgacagatcgttgtcgtcggtaagataccgggacagttcgatgagcatgtgcgagccgcgcttgtgcacttcctcagccacgcacatggccagatgggaggaatagtcgccctcgatgcccgaggtaaggaaggtgatggtatcggaccgcccagaacgcagggaccggccagacaggttgattttgtagccgagtttgcgggcggcgtcacgcacgcgctgcatggtttcgggcttgacgtaatctttgcttcgcagggccgcggaggcggtggtggcggtcactccggccagttcgccgacatcctttaaggtcaccatcgttatcgtctccgcatatcacgaacctcatcgataagatacatcgtatcgcttcgctaaccgaccgactgcgttgccacatccgaaggacgcatcccccacccgcatcgacaacgagaccgaaaccatcgaccgttgcgccgcccgatacctgatggatgccatcgacgggcatccacatcatggtgtcgattatgtgccttgccgcctgatccagcgcgaatcgacgctgccgctggattgatgcttgcggctcttatccgaagagccgcacaagtcgtcgtttctcacagtcagcactatacgctcactaacgaggcgcgaccgtcagatcatagttgccaacggaatcgccatccgcttcatctggcacgctctcggaagaaaccaccggaatcacatacgaatggaattccggcgtttgtccggcaatcctctgttcaagcagatccacaatagtggcagccatctcctcatacggctgtatcaccgtaggaagcggcggatatgcgatcttatagacgaacgagccatcataaccaaatacaaataggtcatccggaatgcgacgccctcgcgaaagcgcctcacgctggaccgcgagtgcaaccagatcggccgcgaagatgccatccacgtccgggtactgatcgaggaacattttggcggtttgcaggtaggacgagaattcaaactggttgagtcgcaactcataggtaaagcattcgacaccgtggtcacgcatctgtttggcaaacaccttatgccgttgcgcggaaggagacagcaccttcgagtagcctacaaactgcaccactttcttacagccatgcttcaaaaacgcctcggccgcgatatgtccgccctgcgcatggtctgcatgcaccaccggaatgtcatcggccagggaacggtccagggatatgatcggcaaaccgatgccggagtaatcgatgtccacggaatggctgcccacgataatgccatcgaccttgttggcggtaagcatatccaggtatttgcgctcttttgccggggaatgcatggtgtcgcacagaatcatcttgtatccgcgacgatccagttcgtcctcgatgcgggaagccatggtggcaaagaacggctgcaccacatcggggatgaccaatccgacaaaattagtgcgcttggtggtcaggcttcgcgcaatctgattgggttggtagtgcagcaggtctatggcatcctgaatggcgctcttggttttttccgacatatagccgcgttcgttgagatagcgcgacaccgtgttcttggatactcccgctacccgcgcaacgtccgttatcgtggccatgagttttttcccccgttatagcaattggcggcggacgattccctacaagtctaatagggaaacgcccgccgcctatggacaagcccctagggtctgagcgcgtacccccggatatcggcaagcgcggcatcgccgccatgcggctcgaccgcgatctcattgcaggtcgcaggagcgaacacgttcagggaatgcaccacacggcctccgttgatgaagatctccagcgaactggtgtcgccgatcacttccgcttccattcgggggcttccggcgaccatcagcgggctatgggtcttccccttgctccacccatcggaatcgttgcggtcgacgctcatctcggcatgctccaagtcaaatgtgcataccgtgcgtttgccttcaccgcatcggagcagcaggtccacctgcttcgctcgcgtggcctcaaggtcaagcgcaaaggaaagatcgaaatgcacgccgtctccggcctggacgacatgcctctgcccgtcgcgcacggtcacgttttcctcggcgctcatgtccgcacgcagccgatcaagctccgccacaggacggaacgacagcgtcaggtcatcgttcaatatgacctcgcgcggcaccgaaagcgatccgcaccatccctgctggtatgtcgggccccagtctttccagaatggcatccaatcccagccgttggcccagccaacggcaatccgacgtccctgggcatccacgaacgtctgcggcgcatagaaatcgaagccccagtcggattcaccggtcaccgtgtagacaaagcggcccgtggcatagtcgatatcgccaacgaaatacaccgtggtacgctcgccggcacccatgggcgagcataggaacacccatttgtctttcagcgggaagaagtccgggcactcccacatgtatccccactcgccacgggactcgtgcatgacgttaaggaactcccaatcaagaagattctcggatcggtacaagagagcttgcgccttgccgtcgcgctgcgcgccgaccaccatgtagtacagcccttcatgctcccacatcttggggtcgcggaagtaatccgtgggaacaccgctgggggcctcgatcacgggattgccctcgtacttggtaaagtgcacaccgtcttcgctgatggctatgttctgtgtctgcacaaagccattgccatggttggcggtgccggtgtacgccacgtacagcttgccgtccttctcgatggcgctgcccgagaagcatccgccctgggggtggtcgtcgtatggctcgctgggcgccaacgccatcggcaactgggtccagtgcagcaggtcgtcgctgaccgcatggccccaatgcatctttccccagaacccgctatacgggttgaactggtagaagaaatggtactggccccggtaatagatcagaccattggggtcgttgatccagccgcacggccccataagatgataggtttggcgcatactggcctgtgctacctcgggggcgtgttcggcgatataggtcgaggccgtatcgatggcctgctgcatggactttgttgtcatgggaactctccttggtcccttaatggttagggttatgtcgccttactgcttcgcgtcgaattcttcgcgaagcttcttggcgaattgcgtgttcagctcggactcgcgacgggctttgtcttccttgatgcggaactgttcatcgcgcgcgggcttgtattccttccaccgtgccgcatatgcctcgcgggcggaacgctgctcatcggtcagctcaggctgaggcagcacacgttccggaagctgcggcactaccggcaaccggtcctcgaccggggcaatggtcagcggagtcgccgtgggcaatgtctgataccagtaagccgtggaactccaatcatcggacaggtgattggcgtgcccatgctcgatcgtgactttgagatgcttctcgaaacgcaccgggtccgtgatgtggaatcgatacgaaacctggaagccatccgtatctccctcatggacgatggtgccgaagaacggataggcattacgctgcatgccccatgcatggttgaagtaatcctcggtgccggtgccattgagcgagggatactcctccccgtcgatgaagaacatgtcgttgccctcaccccaccagctgccctggaaatgcttgacggtgagattgcagcccacgtaatgaccggtgccttcaacgtccagcacggtgtagttgtgctcgcccttgaagttggtgacgttgttgacctccgggctgttgacctgcaggtcgggaccccagccgtcgcacgggttctcacgatgccatgccgcatggaagtaagcggtgtcctcgggcagcggctcggcatacatttcataatcaatgttgaagtagagaatgaacggcagctcgttctcgttgatgatctcgatcttcgccttcttgttgaagggcatcgggaagtagcacgagaccgagcagggagccccgtaacggcctgcctcttccggcttcagcgatacgttgaacggcaacgatgagaagttgcccggatagctgttgccgatgcagaagaaatcaccgaacgggcatagcacgcttggcgtatcctcgtcatcccaggtgattcgaatgagcgccttgcggtaatagaacggatcatagtcgtcccagatcacgccaagcgcgggatggatctccattacgggagcggcagaggcctgcgcgaccggatcgagaatggagggtgcagcaaccctgcggcagctggaggtcatccacatatgcgtgatgcagcccggaccttcgatttctccaagcgtgatggtctcaccggcgggcacttcccagtagtcttggttcttgccccgctgatcccagctggcaagtcgaccattgcgagcatggtggacgctcgtcaggtctttgaacattcccgagattgcactcatggtgttctcctttgttattgattttgttgtttttttggggggtatcgatagcgacgaatgtcagcccttgaccgcgccggcgaccatgccgccgacgatcttcttctggaacaatccgtagaagatgagttcagggatgatgatcatcaccgatgaagcgactatgccgccgtaatccacggtgtaagtgcccttgaagaagctggctcccatggacagcgtatagtcggcctgattgcgcagcatcacggaagcgtacgggtattcgttccagatgtagagcacgttgaaaatcaccacggtagcgatcaccggcttggtcatgggcaggatcacccggaacatcagatcccatatcgaacagccgtcgatgacggcggcctcgtcgatctccgcgggaagcgctttgagataaccgacgaacagcagcgtgttgaaggaaatcgatgaggcgacatacggcatgatcaacgcccattgctccttgagcccgaagaacatgttgatcttgtagaccgggaacaggaggatgaacggagtcacgctcaggccggcaatgaggaaggcgtacaccgccttggtcaggccggggcgcttgtacgtcatgcgggccagagcgaaggagctgaagaaagtgatggtcagctcgatgatcagggagaccacgcacaccacgaacgtattgagatacagcctcggatagttcagcgttttcaaggcattgcggtaattgtcccaattcaacgccttaggccagctcaatgggtcggacatgatttcggcgttcgacttgaacgacatcatgagcatccacaggagcgggaacaccatcaggacggtgatcaccaccataagaatggtgaaccatgtttttgcacgtttcgacatcatggccgatcagcccctttccttggagcacaggaagtagattccggtgattgccagcgacacgaggaaggtcacggtggcgatggacatgccatagccgtactcgccggactggaaggccatcgagtagctgtaggtgaccaacgtctctgacatatggttgggcccaccgccggtagtctgctgcacgatctcgaagatcttgaagattccggtgatgatcagcacaaccacggtggaaatggtcgagcgcatcatcggtatggtcacatggatcgtgcgctgccaggcattggcgccatccacgcgcacggcttccatcacttcttccgggatcattttgagtcccgctatgaagatggtggtcaggtagccaagctgctgccagaaatagatgaacgcgatcgaatacggagacagcgtcgttccgccaatccactgctgggccaggtctcccgcgccgatggcccgcaggacgccattgatcacgccgatcttcgggtcgagaatgtacacccagatgatgcccacgataatcggagcgataatggccggcgagaacaccagcgccttggacgtatcggcaaatgccagtttgttgttgagcagcagcgccaacaggaacgaaagcaccaggagcagcaccgacgccaccacgaagatgatggcggtattggccagagatttccagaagatatcatctttgactagccgcacgtagttgtcgattccattgaaacgagctttgccgatacctgagtatttggtgaaactgtaggccactgcaatgccgataggcaaaatgatgaacactacatacaccgcaagcgtggggatcagaaaccctaccttatagcgcgttttgctaagccaatgcattacggcacactttccgcgaagaaaacaatgtgatgattaagacaacggcatggccggccggttgcgagaccggccacacccatcgaggagggagatatgcgttacttcgagttggccagcgcctcatccatcttggcgacggcatcggccggagtatgggttccctgcatgacgccgaagagcccgtcatacaacgatgcctgcaccgaggagggcaccgtcagatcaggagcggcggtaggcgacttccacccattgcccagggcctcgaccatggcattcatcgcgtacttgtccggagacggggcaagaccgtcataactggtggccgggaacatggagatcttataagacagttcagcggcatccttgctgtagtagaacttgaggaaggcataggtcgcctccttgacggcatcgttgtcggcaacggtagccggaactgcgataggcgcggaaggcaccttcatatcgatttcctgatcggccgaggaatccgtgaacttcggcccccaccagaatccgatgcgatcgccgatgttcttatcgaattcagcgcaatcccattggccggtaccgaacatcgcggctttgccatcatcgaactgctgcttggcatcgaagtattcgatggtggacatattctccgggaacgcaccggcatcggccaactccttgatcctgtcgaaggccttggccagctccgcatcggagaatgtctccttaccgtcgaggatggacgcgatgtcatctccccagccataacgagatagccaaatgttgaattcccacatggcatacgagctgttcttggaaccgatcgacagcggagtgaccccgctgtccttgagcttggcgaccatgtcaaggaactcgtcgtatgtggtgtcgtcggtcggataatcgacgccggccttatcgaaaacatccttgttgtagaagatgccctgcacattgctctggtacggcaatccatactggaccccgttgtcgtcctggaacgcggcctcggaaccattcagcgcatctttgacatcgctgttctgatcaagaaaatccgtaagatccatgagcacaccggcttcattgaattcggtgacctgtgacccctcgacccagaagacctgcggcaaggtgccgtcagaggcggcgagcttcatgttcttggcatgcgattcggtgtcagcggcaacgaactcgaccttgtacttgcccttgttggctttgttgaatgcttcaacgatgtcattggtcgccggctcctgcttggcggggttagccacattgatgccgaatttgatgacggtggcgccgctgtcgtccttggtgacctccgtgccggacccaccgcaaccggcaagcgtgccgacaacggtcaacgccgcgacgcccgcaccgatgacggacatcgcccgactcttcataatatgctgagtcatggtgctcctttgctccaatttccagttttccttttcccttgcgaccacggccgcacacaccgttccgaaaacctgttaaccgagtaacatagtacatgcatttcaacactttcactatgtcgtcgattgttttttaataaatccagaaatggcttcatttcagtctttatttgttttcacaccgctgcgttgaactcaacataacaccgtggtatcccatgtgtcaaccggttaacacattgcgtgttgcatacggcaaacgagcccggaggcttccctttttttcacctccggttttccttatgcctcaccgacctaagtccataagaattcaaggcgatattcacgcttcaggcctgcaccgatgttggcgggcacgtaaaatttctgtcatcctaagaatcataatcatgtcaaagtcggaaacgaaaacatgtcaaggttggaaacgaaactatgtcataataggaagcaagaacagataatcgttaatttttcaggagtttgccgcaatgaagcaatatagaaatcgaatttacgatacagtgctgcggcaccgtcttgaagccaaaggtgcggtattggtcgaggggccgaaatggtgcgggaaaacaacgacttgtctgcaattagcacaaagcgtgctgtacatggcacaacctgatatccgcgagcaaaacatcatgcttgcggatatgcagccttcgctgcttctgcaaggagcaacaccgcgactcatcgatgagtggcaaattgcacccaaactgtgggatgctgtccgcctcgaagtcgatcaacgcgacgaattcaatcagtttctccttaccggctcaagtgtaccgcccagctttacagacattacccacacaggaaccggcaggatcgctcgcctacgcatgaggcctatgagcttgtatgagtccggagattctacaggtgcagtatcgttcgcttcgctgttcgaaggtgaatccatgccgctctcccgggtggactccaacattgaacacattgctttcctgctgtgccgcggcggatggccgaaggcaatcgatcgaacagagcgcatcgcgctacaacagtctcgagattacttggatgccattgtcgagtcagatatctcccgagtggacgatgtgcaacgagatcctcacctggcacgtcgtttattgcgttcgtatgctcgtatggaatcctcacagtcgcaatcatcacaaattgccgcggacgtgcgaggcagtgccgaaagtcccagcgacaaaaccgtgcaatcctacatatccgcactggaaaaaatattcgttcttgaggatatgcctgcgtggaatccaaatttgcgctccaagagtgcaatacgcacttcagataccagacattttgtcgatccctccatcgcagcggcagcattaggaatcgggccagccggcctcatcaaagacttcgagacttttggactgttgtttgaaagtatgtgcgtacgagacttccgcgtatacgcagacgccctcgatggcgatgtgttccacttccgcgacagaactgggcttgagtgtgatgcggtccttcacctgcgggatggccgatacgggctcatcgaagtcaagctgggagggaaccgactcatcgaagaaggtgcggccaacctgataaagctcgccgacaaaatcgacaccaccaccatgccaaaacccagtttccttatggtggtgacgggcacaggtgaatacagtttcacccgccgagacggtgtcatggtggcccccatcagaacgcttaggccatagcattgccaggggtgaaacaacgattcttccggagtcaggcgcatcaatcgcatcaatcgatgcacgtcacgattttggcggaatcgttgttgttgctgttgggtacggctggggtcgcgcgcttacgcgccgaccagttcgagcatttggggaatgctctttttgccgaattcgacttgctgggtgccgtcggcgtgggtgatgacgatgcagggcacgctcatcgcgccgtactggtccttgagttcggggaagtgcgagacgtcgtaggcttcggcgcgcacggccgggctcagggaggcaatgcgctgggaagcaagcacggtttccgggcacatcgtgcaggtgagcgagacgaggatcatgatgttcagcgggtccgtgatggacttcgcgcgttcgatcaaatcgtcgcccagcggctggccgggaccggccgcgttgtacaggccaagcacgaacgagttgaactcatggccggaaggcacgccatggaaggccaggccggtgaagaccagcgaaccatcgcctccagccggcacgcagatgcgcacggccggacgggcgagcggcaggacgccggcgacgtcgaatgtggcgcggccggaatcgtccaacgaaccataagtgggcagttcggtgccgtccggcaaggtgacggacagcggttcgccgaccaccaaagaagtaggcacagaagcaccatccaccgccgtgatcagccctgcggcatcaacggcaaccgagttcagcttgccgccggacagcgcaaccatctcgccgatgaaaccctgcaattccgccgaaagcggagtgccgtccagttcgagagcgagcgtgaccgggcgggtcatgcgtccgaagaccacgccaagctgctgcttgacggcggcggagaacagttcgccgggcttcttggcggcgctggctgcggctgcggcatcggcgctgcgtttggcgggagccggggcgggcgtcgtgccagcggccgaggcggcggaggcggccttggcctcggactcctcataagcggaagcagtgggacgcggcggcaccaagccggttttctcgctcatctgcttggcgtaacgctccagttccacggcggcaatcgcaccgtcggcggtggcggtgaccacctggcgcaggttcttgacgcgcagatcgccggccgcgtacacgcccggcaccgaagttctgaggtagtcgtgcgtgaccacgtaaccgtggtcgtcgagctccaccacgccgcgcaccaaatcggtggcgggcacatagccggcgaacacgaagacgccgaaggtgccggcgtcggcgggcttccacgtttcggtctggccggtggcaaggttcaggattgaggcttctcgcaggcctccttggccggcggtgacgcccttcagctcgacctgataacgcacgtcgatcttcgggttgttcttggcttcggcggccactgcggcatcgcaggtgaagtccggttcgcgcacgagcacggtgactttggaggcgtatttggtcaggaacacggattcctcggctgcggcgaatccgccgccgaccaccagtacttccttgccggtgaagaactcgccgtcgcaggtggcgcagtaggccacgccgcggccggcgtactcggcctcgccctcgaagcccagcttgcgcgggctggcgccggtggcgatgaggatgccgaacgtcttgaggtcgccgcgtgaggtgtgcacggttttgatgtcaccatccacgtcgagaccggtggcttcggcggagaggaattcggcaccaaagtcctgagcctgctgacgcatggtctgggtgagcgcgcggcccgtggtgcggcccacgcccggatagttgacgacttcgttggtgatggtgatctggccgccgaaatcatctttttcaagaatcagcacacggtagcgagcgcgggccaagtacaggccggccgtcaggccagccggcccgccaccaatgacgacgacgtcatagagattgttggtctgagtcatgaaaactcccttacatacactggctcccctctctgaggggagctgtcgtagtgagactgaggggagcatatcggatcaggctagctctcgcgagcacccccccagtcgctttcagcgacagctcccctcagaaaggggggccaagattaccgcctattcagtgtcgatcacagctggccgacgaggtcgaggctgggctcgatggtttcctcgccaggggtccagttggcggggcagacctggtcgccgtgctcgtagacgaactgggaggcctgcacgcggcgcagcagctcctcggcgttgcggcccacgttggaggagatgacctcgtaggccacgaccttgccctccgggctcacgatgaagtcgccacgctcagccacgccatcggcctcgttgtaggtgtcgagatccttggccagcagggcggtcgggtcggcaagcatcgggtactcgatcttggcgatcttctcgttggcgtcgtgccaagccttgtgcacgaagtgggtgtcgcaggagacggagtagatctcgcaaccgatttccttgaacttggcgtagttctcggccaggtcttcaagctcggtggggcacacgaaggtgaagtcggccgggtagaagaagaacagggaccagtggccgagcacatcgtccttggtcacttcgtggaactcattgttctggaatgcgttcaccttgaaatcggtcagttcatgctgcagaagagtcatcatcggtcctttcgggaattgttaatcttcaagcgtttaccaccacctatcgtaatgtggtgagccacggctcgcgcgggtgtaacgtatgagccttatcacaccacccgcaacccttgtgcccaaatggccgttgccccaatcacgactatgcgcgaatactcgctaatatggcaatcagcagcccgctgataatggaggtttcatggctcagtcagactttgaacaggaatcgaccgcaaacgcaacgtggagtcgcatgctgcaaggcaaccggcgctttgccgagggcaagcccgaccatccatggcaggatcaggagacccgtcaaacgttgcttgatggccagaacccggatgccgcggtgctctcctgctcggactcgcgcgtacctccggaaatcatttttgatcagggcctgggcgacctgttcaccgtgcgcaccgccgggcaactcatcgatagcgcggttatcgcctcgctggagtacgcggtcaagaaactgcacgtcagcctgatctgtgtgctcggtcacgagcactgcggcgcaatcgaggccgccgagcaggagctggacgacctgatgcacaccatcacttccgaagccgacggctcactggaggccgcggatgcgatggacgacctcgacgagcacatcgccgccgccgaatcgattattctgcgccagaccggtatgtccgtctggcaggcgcgcgaagccgagctcgacgcgcatgaagatatcgagcgcgtgcatgtggcccacattattgaaactttggtggagcagtctcctgtcatccagcaggccctcgccgctgacaagctcatgatcgtcggcgcccgctatcagctcgattccggcaaagtggaagtgctgagcttctgagcgtgcgatccgcaatatcgccacctgcgtgggatttggcgaatccttggccatagccgcgagaaacagcctctctgcactagtaatgccgtccagcgctggaacgcatacggcatcgtcgaaggcgagcaacgcatcggaaacaccggtcgacacgtcgtccgcggtaatgataagagtgcccttccctttgccgagtttcttactgcccagccagcacaccccaatttgacgtgccactcccctagagttgaagccatgtcacttggtttgaacatcctcctgatttttgtatttctcgttatcggttccgtgttctccggcaccgagttggcattggtctctctgcgcggctcacagatcgagcaaatggagcaggaggacgctcgcggcgccaaagtcgccaaaatcgcacgtgacccgaacaccttcctgtccaccgtgcagatcggcgtgacgctctccggcttcctgtccgcctcgttcggcgcctcttccatcgccccctacctgattccggcggtcgaaagctggggcgtgcaccccggcatcgccggcggcctggtgaacatcatcctgaccctcatcatctcctactgttccatcgtgatctccgagatggtgcccaagcgcatcgccatgcagcgcaccgagcagatcgcgcgcgccgtggtgcccgccatcgacgccttcgccgccgtctgccgcccgatcatctggctcatcggcaagaacacgaacggcatcgtccgcctgctcggcttcgacccgcagcagaccgagtccgaggtgtccgacgacgagctgcgcgtgctggtcagctccaacaccaacctctccaaggacgaacgcacgattctggacgatgtgttcgacgcgtccgaaaccatcgtcgccgaggtgatgcgcccacgtgccgacgtggtcttcatcgagggcgaccagcccttggccgaggccgccgcgttcgtacgcgaccagccgtactcccgttacccggtgaccggcaaggatttcgacgacgtgatcggcttcgtgcatgtgcgcgatctgctggacgtgcgcgatccgaacgccaagatcgtgcgcgatgtggtgcgcgaaggcatctccctgcccggcacctccaagctgctgccaagcctggaactgctgcgtaagcgcggcatccatctggccgtggtcatcgacgagtacggcggcacggacggcatcgtgacgcttgaggatatgaccgaggagcttgtgggcgatattcgcgatgagtacgatctgcccagcgagaagggcggcgaacgcaccacccgcaccgcgttcgtcaatggcgtggccacgatcgaggccagcatgaccattgaggacttcgccgatctgaccggcatcgagctggaggacggcccgtacgagacggtcgccggctacttcttgtccaagaccggcaagatgggagcggtaggcgacgtgctgcattccgacgacggctacaacatggtcgtcaccaaggtggatggccgccgcatcgaaaccatcgaagtccgcaaagccggtgccccggaccatgcgccgctgccggccgaatcacaaagcgacgatgccaaatagtcgcgtgatattcaccacctattcgttcggcccggggcataaccaaaaaacgtagaatgaaagggcaacgttccacctactgaaagaaggaacattatgacacttgcatttgttgtgccgggccttgatgaagcggccagtgagaaggccatcgccatcctgcagaaccgactgagccaggagcaggaggccgctctggtcctgaagcacgcacactggaacgtgaccggcccgaacttcatcgccgttcacgagatgcttgaccccgaggtcgaggccgtgctggcccaggccgacgagaccgccgagcgcattgccactctgggcggcaccccggatggccgtgctgacgccatcgtgcgcaaccgcacgtggaaatcgttcgacgctgagggccgcgtgggcaccgaggagtatctcaaggcgctgatcgagtactatgacgccttcatcgccgacgaccgcaaggccatcgccgagctggacgagctggatgtgatcagctccaacatcatccaggaccacgtgcaggaactcgaaaagttccagtggttcatgcgctctcacctggcataagtaaaagccgtattccgtggctcccctcaaagaggggagccactttcgtctcacgtgaaatagagagtctccacatacataagttggaaaagtgtataaaactccccattttgaggttggaaaacgtagccaaaaccgcattcttatggttggaaaagtgtaaaatatgcgctataaacagttggaaaacgtgcccagcatagatgcaaggcctacaaatgactggagattctcatgctgcgaagaaaaatcgagacacagctggaagcttggagatccgcgccgaaacgcactgcactgctggtcaccggagcccgtcagattggcaaaacctatatcatcaggcactttgcccaacagcattacgaccatatcgccgagctcaatttcatcgagaaccctgacctcgttgcattattcgatcggccccgcgatgccaaaaacctactgatgaggctggaactggccgtaaatacgccattagtacccggcaaaaccctgattttctttgacgaggtccagcgttgcaaggaaatggtcaccgcaattaagttccttgtagatgatggtcggttcgattacgcgctttccggctcgctacttggagtcgagctcgaagatatacgctcggtaccggtcgggtacctgaccgagctggatatgtatccactggatttccaagagttctgctggtcgcagcatatcggcaacgacgtattcgatatgcttgccgaatgctttgccaagcaccaggaagtggatgagttcattcatcaaaggctcatggagctatactccaaatatctggtcatcggcggcatgcctgccgcagtcgactcgttcgtggcaaacggcagcgttgcggacgtgcgcactatacaagagaacataaagcgtgaatatcgccgcgatatcagccaatacgcgcgcaaagaagaccggctgcatatccgcgctatctacgatttggtgcccagcgagttaaataacccaaacaagcgctttaccttcgccaaaatcgaaaagaacatgagattccaatcggttgcttccgatttcgattggctggtcaatgcggatgtagccgtcgccgcgtacaacgtggacgaaccgtgcacaccgttggagatgagcaaggaacgtaacctcttcaaactcttttacaacgacgtgggtctgcttaccggctcgtttctcaagaaaaccgcgctcgacgtactcgacggcaaccctgatatcaactacggttcaatctatgaaaatgcggtggcccaagagctacgcgctcacggatttgacctgtactactacaacagtaagaagcttggcgagctcgatttcctcatccaagaccgcaacgatcacgtgctgccgattgaggtgaagtccggcaaatcctacaaacgccatcgcgcaatggacaacgtgctcgcccaccctgaataccatctcaatacaggctatgtgcttggcccgtgcaacgtctcagtcgaagggaatgtaacctacctgcctgtatacatggccggcatgttccataacgaatgacgggccgcacacttagtcaacaagtacatgtcggtcagatggttcggactggtcagagggcccgctctgatcagttaggtcggtctgaacggactggctgggctggtcggcctgagtagcccgtttggaccgatccggttcgcccttgctggccttcacactgcttcagctccagctgaagttcgctgatgcgccgttcgagttcgtcgatgcgccgcacgtgtggcgaagtgagactaaggggagccgagagatggctcacaggccgagggcaccggccacggccatggcctcgtgttcgggatcggcctggccgatgtgtacgttgacgtgaatttcgtcatcgcccggctcttcgagaatgtcggactgggattgcagcatgctcggcttcatgaagtggccttggcggtgggaaaggcgttccatcacctcgtcgaatgtgccctgcatgtagacgaacaccacgccttgacggcgcagcttgtcgcggtagatcttcttcaacgccgagcaggtgaccacggcgggctcgccggcggccacgcgctcgtcgatccacgcggcgatggtgtcgagccaaggccagcggtcttcgtcggtgagcgggtgtccggcggccatcgagatggtggcgcattcggaccatgcgaacgaatccgatcaggccatcagccacatcgccggcactgaagcctgacccgtcatcgtcacagcaccacgcggcggttgaggtcgcggcgcagcgtcttccagccgggtaggtaggcggtcatgcggcgctggaatccggcaccgtggccgctttcccacaaatgcgtcatctcatggaccaagacgtattccaggaattgcggttccatcagtcccaattgaaggttcagacggatgcggccggttcgcggtgtacacgatccccagcgcgaggtcatgacccgtagcgtgatatgcgtgggctgccggccgacgaccggcccccacttggccagcagctgtggcaacgcggcgttgatcgcggccgccgcttgtcgtttgcgttcgtcggtccagatttgggagcggtcaaaatacggttggacattcgtaccggcttggcctggcccggcgtcaccaattcccggacgactgatatcaccggttttcggacgaccggcaacgcctccatcatggccgctggcaccagctacaccacgacctccgttctcgaagccggcgccctcgttcaatgccatgatggagcgccgttgcgcctcagccatgcgctgctgctgggcgagaatccacgaatgtcgctctttgacgaaatccgcaatgcgactctcgctcatccgcatcggtgcggagatttcgacgcggccgctcggcggtttgatgcgcagatacaggtttttgatgggcttgcgcgtcaggtgcagatggatgccatcaatatccaacgactgcccggcggcagcggaccgaacggatttcggcgcaccggacttcggagcggtggattgacgacggcgataaggcacgcaagtcattctcgcacaacggcggacaacgatggcggcccgcccggaacctaacgttccgaacgggccgccatcagcaatgaacggtgctgtcggcaacggctacaaaccgtcaccgagccattgagtcacccaatcagcaaccggccgcggtcagcacctggtcgaggatctcgacgccctgggtcgcctcgtcggcggagatgacgcaaggaggagtgacgtggatgcggttgttgtgcacgccgagaatcaggccgcgcttgtcgccttcggccacgatctgcttcatcgtggcgtcgtccagcggctccttggtggtgcggtcggcaaccatttccacggcccagaacacgcccttgccgcgaacctcgccgatcttcgggtgcttgtcgtacagagcggtgagctgcgggccgagcacgtccttgccgatggtgtaggcgttgtcgatgctcctcttccatggcttcctgggtggccacgatggcgcccatggccagcgggtgaccggagtaggtcaggccgccggggaagacgatgtcgtcgaagcggtgggccaccgggtcgctcataatcacgccgccggcgggcacgtaaccggagttgcagcccttggcgaaggagatgatgtccggcgtgtagtcgtagtcgtcgagtgcgaaccagaagccggtgcggccgaagccggccatgacctcgtcggtgatcatcaggatgctgtacttcttggtgatctcgcgcacgcccttgaagtagtccttgggcggaatgatgatgcctgcggtgcccggcacggattcgagcagcacggcggcgatggtgtccgggccctcgaactggatcacgtgctcgaggtgagccagcgcacgctcgcactcctcttcctgggtggttgcggagaactcggagcgatacaggtacggggtgaagaagtgcacgtggccgcgagagtagtcgttgggcttacggcgccagtcaccggtggcgctgatggccgcaccggtgttgccgtggtagcagcggtaggaagacagaatcttgtcgcggccagtgaacaggcgggcggcgcgcatcgcgttttcattggcgtcggcgccagcgttggtgaagaacaccttgtcgaagccttccggagcgcggcgggccaccagggaggcggcgcggccacgggctaggttcgcgtagtcaggtccgacggtgcacaggagttccgcttgcttcttgatgccctcgatcaccttcgggtgctggtagccgatgttgacgttgacctgctggctggtgaagtcgagcatttcacggccgtcgccgtacttcagccacacgccgtgaccggttaccacttcagtgggatccaggttgcgctgtgcgtgccacgaatggaatacgtgtgcgcggtccagcttgtaagcgtcgtcccagatttccgcatcctgcgaaagatcatgccccatgatgtgtcctttcctcgatattttctcgaagtgcccgatgccgtctcccgtggatcggggcagggcagcaacgcgctgtgaatgtcattatgagagttgaacatttcgcgtcaaactcgaacatttaataatgttacagtagtggcgaatacgaaatcattttgaaacataggaacaagaacaataattgtatccagattatgtaatgtttatgttattcaaaaacatactcattgcacaatgcggcgctaacatttgactaccgttgccacagtgaccgttactatcggcagtcaagcagccagcaacaagccggcaaccgccatcgatcatcagccggcggcaatcggcaacattcacgcagacgcgcgctcatcacgctcgccgccaagatccgggaggcagatcatggatacgccatcgccatcaaccgcatcaacaaccgcacatgccgtcggctacaacgatgagccaagcattacggccgctcccctgcgttccaccgacgacctggccgttgatgccggccagttatcctcactcatcctcaccaccgaggcgacggccaccccgcaacgcatcgtcgaatcggtcacctcgctgacctcctccggcatacttgcggaaggccagcgcatgcccaccgtacgcgatctcgcccgactgctacgcaccagtccggccaccgtctccagtgcctaccatgccctcgccaggtccggcatactgcgctcccgcgggcgcgccggaacattcgtactgcggcagtcgcgcacgcatcgctacgatgccggcgacttgctggccgaagccccggccaccgcgccggaccgaccgattatcgacctgtccaagggcacgccggacctttcgctgctgccggacatccgcccgtttctcggcaagctcggcacgcacaaggcattcgtcaattcatacgacgggccgaccatcctgcccatgctggaacagattttgcgacgcaactggccgtatgagccggaggcgatgactatggcatccggcgcgggcgacggtttggcgcacaccatgaacgcttttgttcagccgggtgattttgtgattaccgaggcaccggaatatccgctgattctcgacatgatcgaggcacatggcgcgatggcgttcggcgtgccgatggacgggttcggtatgctgcccgacgcactcgaccgtgcgctgaccatgctggaatcgcagcgtctggcggtgccgcacggcggccatcaggtcagtatgatcctgctgcagccgcgcgcccagaaccctaccggggccagcttcagcccgcaacgcatcgacgctttggcggacgtgctgctcgcgcactacccgaatggcgttggtatgccgctgattgtggaagacgatcacagtggcgatgtggccaatgcgtatgcgacatcgttggcgcaacgattgccgcaacacgtggtgcatatccgcagtttttcgaagtcgcacgggccggatctgcgcttggctgcgctgtctgggccggaggatgccgtggaggcgattatcacccaacgacgcttgggatcgggatgggtgagccggttcctgcaagagattctgtatgaaatgctggccgacaaagaggcgttccacacggtgaccaacgcccggcatatctacgccacccggcaaaagacgatgcacgcgctgctgctgcgtcaaagtttggacgtgcataccggtgacggactgaatctgtggattccggtgcgcgacgagccggcggcgctgcgactgctggccgaacagggcatccgtgtggccgccggcaagccgttcctgccgagcctgcgtatcagcgccgacgccaccggagccgacgcgggggccggtgcgggcgtggacgcgcatgccagtcgaggcatccgcgtcaccatcgcacagcagggagccgtcaacgaacaagtggccgccgccctggctcaggcggcggccgtaacgccgaagacttcgacgaatcactcgtaattcttcatgaactgcgttcgtacgcgcggcgaggagccgccccgtctgtacggggtgatcaacgggctgctgcgcatgcgcaacgggctgcgcaggtcgcaggagctcgacgacctggtcgacgtgctggcctcctccatcggcgccctgaccaatccgcgtaccaactgcccacaccggagaaggtcgcgcaggagaagcctcgctgctcgagatcgacgacagcttccagaagatcgtcctcgtacgcgacgtggtcaaacccgtccgcgacgagcacggcatcctcacgatgagcgtctacgatttcctcctcgacccggacagcctgacgatgtgacgccgtggattggctacaacgtattagacagtccgatgagggacgaatgacatgagattggaggccgacgatggccgacccgaaacatccccgccactacgacgaggcgttcaaacggcagatcgtgcagttgtacgagagcggcaagccatcccggaagatccgccgtcgtggcccgacatcctcaggaccatcgagctgggctactccgacgccaggctcgaggcgtccgacaacaggatcaaggtcaccatccgcatggcctacggcttccaccacgcgaacagcctcatcgcactcgtcatgctccgctgcgccggcaatcatggcgcaagcgacaatcgcgacacgccgttattgacataccgccgttcaatggtattgtaatcacttgtgcgcttttgaagcgtatggatcgggcccgtagctcagctggttagagcgcatccctgataaggatgaggtcggaggttcaagtcctcccgggcccacaggaaaaatgaagcggccgcgagccgctctttttttctcacggggctatagcgcagctggtagcgcatctgctttgcaagcagagggtcgccggttcgaacccggctagctccacagacacaacaaaacccttggaatcagtccgattccaagggtttttgttcttgcattttctgcgtattgcaacaaaaagatgacgacacgccgatagcgtatctcacgagaaaagtcttattgcctcacgactgtcgaggccaccggaagtcggcataggcattccaatcggccactaaatcgaccgatgcccgatccctgagccaaacggacccgaatgccgttcatcatcgacaaagcagtccgcgcctcgcgacgaggatctgccaaaccgtcacgctcgactgctcgggttaaggtgtccatcacgcgatgttctcgtttttggtaatactcataggcaggatgatgctcgttcaacgattcgccttgtagcacggtatatacaaccgcaccatctctggctgagccgcattgcgctccataagggcagcacagatatcacgaatgccgaactgcgcgttgccgctccacatatcctcaggttcaacgccaagagaatgggcaaacgtagccatgtcttcccgatcacgatgctccagcacggcaatcagcaagccgactttgttcttgaaatggtatatgaccgccggctcggtcaatccgcatgcttcggctacctgacgaacggaaaagccccaaaacccgttctgtgaatcacatgcgacgtcacgtcgatgatctgttcacggcgttccgcacattctgattctgctcaagacagatccagctcgttgttgtccttggctttgctcaccgtatcagtcaaatcggggtcgtccacagacaccgcgttctgctggctgagcgtcaacgacagcgaacctttgtaggagtcgccgtattcgtccttgccggacacgcttacggcaatcgagctcatcagacgcttcctgccgtagttcagatccacggtgatagtcggcatatccggctcttcatccgtgccgaagtcccagttgcgcacattgtcgagcgcctgacggtactcgccttcagcatcgcccacaccggtatcctcgatctgctgaatcacccatgatttcagatgcggatactgcgcttcatggctgatccagtaattcacaaagtgctgggtcaatgccttgacatcgatttgatacgagagctgcgtgttgccggcagacttggcagacgatgtattcgggaacagctggctgcgcacattcttatcttccagctccacgccgagatattgttggatgaatttgctggcctcggccttcacctcggcagacgttttcgtgcccttggcccggtcgatgtcgttcgagtacccatcgtcgttcatcttgtccagctgatcgtagaacgttcgctccgcgccggtgatgtcccaagcaccgttcttgaccaacgcatccttgacgttcaatatcaagtccgccacatcactaccaacgccgttccttaagtcatcttcatattggtcggccgggtagtagatgtagtaggggtcgtcatcataccaaacgtttttcccggcgaatgcgcctttgtgccaagcgagggttgttgcctgttcatctgtcttgatggtcacagacgcggaggagtcattggtggttttgccccagcgaatacatgccagacatccgcgcgtcaagggagtcgtcagtgctgctgtgggttctgagttcgtatttggtgctgcgcagagtggacagcgagttgatcgcgtcgaaggtgacgaccagcggattggtgggctggaagcccagcatcgctttgacggcggtgaagttggggacgatgaatgccaaggccgccaccagaatcgtcgcaagcaatgcgcagagaacggcgatcagcttcttgctggatttgcgcggcggtgccaggacggcggttgcatcagtcgcctgatatgcggcaggagcgggaatcggcaaagctggcaagggagcagttggtgccggctgtggggcagcggacgcggcgtaaaccgatggggcaaccggcgcggctggtatcgatggtggtactgaaggcgctggcacagcaggtgccggtatcgacgcagtcggtacggctgacgatgcggccggcactggtacagacgcaaccggtgcgctgtctacagacgctccacatgccgggcaaaatcgtgccggcctatcaactctatttccgcagtggccgcagtacgccatcgtgtgcttctcttcctcaaatcggcttgattgccattgcttcaatgttactcttcagcattacgcctcagccagcccctacgcgtaacgatacgaaacgcggcagccttaatgcggttgttttgacgcgatgtcaacttgaggctagactgtgccgtgagagaaattgacgctgcgtcaacatagcggcgtctataggcgtctcagcaacccaatggaggactgcgaggcgcacagcgcacacacggaaaggaccgcttatgctgtttcaggtctacggcgacaacgccatctaccaatggatcggatggatactcgtcttctgctgtcttatcggcgccaacgaactggcccgccgcaccaaaaccggtggcgttatcgccttcctcgtcataccggccgtgctgaccgtctacttcatcaccatctacacggccgccgccatgggtgccgactgggccctcaacaacccgacctacgtacacatgaccagctggttccactatgccaagctgtacgcggccaccatcggctgcatcggtttcatggccctcaaatacaagtggggatccatcggcaaatcgcactggttcaagtgcttcccgttcgtgatcgtggccatcaacatcctcattgccgtagtgtccgacttcgaatccgccatccgcggctggggcaccacgtggatctccaccgaaggcgtgaccctgtacggtggctggcacaacgtcttcaacggcgtggccggcctgctcaacatcttctgcatgaccggctggttcggcatctacgcctccaagaagaaggacgacatgctctggccggacatgacctgggtgttcatcgtggcctacgacctgtggaacttctgctacacctacaactgcctgcccacccacgcctggtattgcggcctggcgctgctgctggcacccaccgtggccaacttcttctggaacaagggcggttggattcagaaccgcgccaacacgctggccatctggtgcatgttcgcgcaggtgttcccgatgttccaggactattccatgttctccacccagtccgtgaacaatccgaatgtgaaccttgcagtctcgttaatcgcgttggcggccaatgtgctggcacttggctacatcctgctacgcgccaagaagcagggcatcaacccgtggaccaaggaagtgttcaaaggcaccaaggattacgagcaggccatcgctcgcgccgacgagtctgaattggcggcctagcctcgctttaagcctcaggccaacacctccatggggtgataagtggcggtgtggtgtccggtgatggggttccatacccgttcggcgaatgcgcgcagacgggcgacgccctcacgcagctcgccggcatctccggcgtaggagaggcgcacgaagccgcgcccctcctcgccgaaggcctcgccggggaccacggccacgtgctcttcgtccagtagacggtctgcgaattcaccggagtcaaggccagtcaggcgtacgtccacaaaggcgtagaacgcaccttgcggttcaatcaagcgcaataccgggcatccggccagaccgtccagcacgatctggcgcttggcgcggtattcctcgcgcatggcggccacatgatcctgcggaccggccagtgctgccacgcctgcgtattgcgccaaggagttcaccgaggagtgcatgagttcggcgattttaccggtctgttcgatgaccgcttcgggtgccagcaggtagccgatgcgccagccggtcatcgcgtaggttttcgacaggctttccaccacaatggtgcggtctttcatgcccggcaccgcggcaatcgatggtgccacggctgcctctcccccaagcgtttccccgaacgtttccccaaacacgaacggatggtaaacctcgtcggagatggcccaaatattgtgctgcttgcatacttcggcaatacgcgccagttcagcggcagaagttaccgcgccggtcggattgccgggtgagttgatgattacggcgcgggtgcgcggggtgatcgccgcttcgatgtccgccgcgttcacgcgcatgccgtgctccggacgcagcgccacggtgaccgggcggccgccgcacagcatcacttcggcgtcataggaagtgaagaacggcgagggaataatcacttcatcgccggtgcctaccacggctttcagcgccagaaacaggccaatcgtggcaccgtcaacggcttgaatctcggtttcgggatcataagtgagtcccttcacacgggcggagtaatcggccacggccttgcggtattcggggacgccgagcacgttggtgtaccgagtgcggccagcctgtgcggcctcgcaagcggccgccacgatatgcggcgcggccgtggcgctgggctcccccacggtcagtgaaatcgcgtcaggcacgcgctctacacggtcgaatacgtctcggatgccggagcgcgggatattcagggcttcggcggacaagctcgcgggcttggcggtcggcacagcaacccgtctggcagcaggcacagcagcagatgcaacttcggacagaggcatgttggaaaacttctgcatatcatccctcctcaatggaattatttcgtcgttctcttatttcagaaggaattattacattcaattaggactttaggcataaacattccaccacacaacagaaaacacaggaagaactactgaaattaccaggcaaaatcggaaagccatcgcattccggcaacaggtacagtgaacacagagcacaacgaacggagaagacaccatgaccgcgattgacgagaccgaccagcgcatcctcaccatgctggaggccgacggccgcgccacgctcgcgcaactggcccaggcgaccggactgtccgtctccgccgcccagtcgcgcgtgcagaagctggagaagcgcggcatcatcaagggatacaaggccatcatcgaccaagagcagcgcggcttgcccatcagcgcgttcgtcaacgtgaccccgctcgactactcagccgaatcctcgattccggacaagctgaacaatatcgacggcatcgtctcctgctattcggtggccggcgcccccagcttcgtactggtggtacgcgtggcctcccccaccgcccttgaggaattgctcaatctcatccaccgcacggtgccggtaagcaccgagaccacgatgattctgcagacctacttcgcgcactgaccgcgaacccggtaacctgcgcgccgaagacctcggcccctacggcgcacgattcccaacgggcacatccgacatcacccaagtccacctttatgtccactatatgaacgcaccttcggtgtgatgcagcttccatttcgacccgattcacgcacagacagacatccagcaatcgccgaaaaatctaacaaacggaaacttgaaccaccccataaccacgccgatagctttcccgttatccgagcgagactctatgcagcaagggcctgcgcgcatagaataaaaccgtcttaattccctagcaaatcgaggagaatcatgctcactgacgagtacatcaagcgtgtctacgaccaggtcgttgcccgtgacggcgatcagccggagttcctgcaagccgttcgcgaggtcttcgagaccctgcagccggttgtcgagaagcacccggagtacgagaaggccggtgtactggagcgcatcgtcgagccggagcgcaccatcaagttccgcgtggcctgggttgacgacgagggcaaggttcaggtgaaccgcggctaccgtatccagttcaactccgccattggcccgtacaagggcggactacgcttccacccgaccgtgaccgagtccgtcgtcaagttccttggcttcgagcagattctcaagaactccctgaccacgctgccgatgggcggcggcaagggcggttccgacttcaacccgaagggcaagtccgacgctgaggtcatgcgcttctgccaggccttcatgactgagctgagccgccacatcggccagttcaccgacgttcccgccggcgacatcaacgtcggtggtcgtgagatcggctacctgttcggccagtacaagcgcatccgcgacgagtactccggcgtcctgaccggtaagggtctggaattcggcggctccctggcccgcaccgaggccaccggttacggcgtatgctactacacccaggaagccctgcgcgtgctgcgcaacgactccttcgagggcaagaccgtcgtgatctccggctccggcaacgtggccacctacgccgctcagaaggctgagcagttgggcgccaaggtcgtcaccgtctccgactccaacggctacatctacgacccgaacggcatcaacgtcgaggtcgtcaagcagatcaaggaagtcgagcgcggccgcatcaaggaatacgccgagcgcgttccgggctccgagtaccacgagggcagcaagggcgtgtggaccgtcaagggcgacatcgctctgccgtgcgccacccagaacgaggttgatggcgaatccgcacagaagctcgtggacaacggcgtgaccgtggtcgtcgagggtgcgaacatgccgtccaccccggaggccatcgaggtctaccagaagaacggcgtgctgtacggcccggccaaggctgccaacgccggtggcgtggccgtctccggcctggagatgagccagaacagctaccgcctgtcttggaccttcgaagaggtcgacgccaagctcaagtccatcatggaagaaatcgtcgccaactccctggccgccgccaaggaatacggtcacgagggtgacctgatgctcggtgccaacgccgcaggcttcgtcaaggtcgccaacgccatggttgcccagggcgtgctgtgacgcttgccgctgagcaatcgctgagcagtgctgagcaatactaagcagtactaagcagtagcgtaatgcccttgcttccccgtgaggaggcaagggcattgctatatgtacaacgagcaacaagtgctatcccaaatacgtaagcattacgcaccactatacgagtgaattcttggatatgatcatcgatccaagctaactgcattcagaggggtactgaatatgggaaaccccgagtataaacgccgtcattgcaacgcttatactcgaggtttcgtggttcaggtacccctttgaaagcagttggctttctgcaaagccatcaatgtacctctttcaacggagatagccccccgtctacaaggtcaccaggtccggttcgcagcaacgctttcaatcactgctggcgattgcggcgcactgctaccagcgccaagccagcaacgagcagcggcacggcgactacaaccaccgcaatgatggccgagccggtttccggcatggtgtcggccttggccgccgaatccgcgttaggcgaggcgttgccgcccggctgagtcggctgcacatcagtgccggtcgagtagttcgggtcgtaagcgaatggccacgcgccatccggcacaacccactgaccagccgccgagccgaagcccagtgccgcgagcaattcagcacgcttcgcctgcacctgagcctcatccaaagcagacatcgagccgagcacgacgttcttataatcagccggatcaagcagcgcgccggtttcatcgtggctggcgtattccgcgaatcgcacatcatcgtggaaggtcacgtccacgcttttgccgctctggttcttgctggtccacacattccaacgattcttggtgatcttgctggacatcgtgctgtcgaggtaggtcacggccgaggaagtgtccgtatacgccgagttcttcgtacccaaatccacgccggtcacatagctgctgccgtcgcccttacgcacctgcgtgtactgcgcgaacgtctgccacgggcggcccagcgaaagcttggcatcgtcgtcatatgctgcggcaacggtcaagttgcagcggtcaaacaccaggcccacgccggacttcttggtgttggcggcggtgaagtagccgttgttcttgccggcgaacgcggccatgtgcagctcggtgccggcgaagtaggcgttggcgtcgccgaacacgaaatcaaccgtgccttcgatgtagccgccgtccacgtacacgcggttgccggcgccctgcacgtacagagtgtcctgacggccgatgatgcggctgttcttcaggtacaccttgtctgcctgggtgttcagcgccacggccggcgtctgctcgcccgccgccgtgtgatccaccacgttgtaatcgttctggaaggtgatgccgtaggcggagaaacctgtggcacccgcgccaatggtcacggtggcgcacttgttggtgccaaggtcgaattcatcctgcggcacaaacttgccgtcggcatcgaatgtgttggacgaatagtagctggcgcgaatcgtcaccgcgcgcttggcggtcacgtcggcgttggcgaaggtgacgcccggcttggtcacggtgatcttctcgcgatagtcgcccggagtgatcttcagcactagtcggtcggtttcggaagagtcgttagcatccagagcggcttgaatggtccggtactggccgttcgggcccacggtgaccgtgtggctggtggcggcgggggagccggccgcgtagtcgatggcgatgccggtcaggtacaggctgcccgtgccttcaacggagagcggcacgtagcgcgtgctgtcggttgcgatggttacagcagtgccggtggtgatgtccgtaccgtcgagcttgagcgtaggaccgtacagctggcccttcacggtgactgtagcgccgccctcggcctgtgcgaccggaatgtacaggatggttccagcgttcacctgagtatcgctgccgccgcttgccgcggtagtacgcgggttgaacttggcgccttgcgcccgagcgtcgatggcgacgccttggtagttgtcggtaggccctgcacggccggtcgatcgatgccggtttccgtgaagtcccagttcgtgtctttggccgcgaccgtgggcgtaccggggaactcgggttccggctgctgttcggcaagggcgatgccgttgagataggtctgggcagtgaaggtgacgtttaccgtacgagccgactccgcagcaggcaaggcgataactgtgttgtcgctgctcacttcaccggcatccgcggtaatagtggtggtgccgccggacaacgcaagggtgatggtggctgtattggtgtgggctggcaccgggatgctgatgatggttccggcgttgatctgggtgtcattggcgcgcggcgcaaacttggcaccgtttgcagtggcatcgatggtcagcccgtcgaacgtctgggatccgccttgtatagtgccgagagccgccagctcagtgttgttcgcaggattcagcacccattcgcgattgatggattccgcggcttgcgtgctgctggtggtgccggtgctcggcgacgttgcttccgcggccgatgcagtggctgccgcaccgccaaatatcatgcttgcagccaacagcacaccggcagcacgaataatggtgtttttcatgggtgttctctcttatgtatcgatgtacaacaacgaaagccgctttcggaacacccgagtcggttttgcagcctgaaagcagggcttcacctgctgaggggaacacgactatcgggcatttcccagcctgtcttcgcgttcaaaatatcaccgaaaaaaatgcgactggaaccccgtagcacaacaagaaaaaaagggggtgcaccccatgtgttgggatgcacccctaagtggtcaataagggggagttggaatgggactcatgactcccccccccccccagcggcgccaagctggcgggttctagtgatcgttgcaacacctgacctaccgcaaggagggtcaggtgaccagaagccaccgaaacgaagaccgtggcggggaacaccgttggacgttcaacggcgtcgaatatccgacgagatcgtcgacgagatcaacaaccgccccatgcgcgtgctcggctaccgcacgcccgccgaggcgttcgccgacgaactgttagaattacaggaccaacaagggtgttgcacttctaaatagacatcggggtaggctccgcccgcaagtcacagtggtacaattttcaggtttgagactgtagcaagttgagtcgctttatcagtaagtctgtatttggaggtatcgatggcccatcgtccgcttatcggcgtggtcccgttgtgggacgacacactgaatagcctgtggatgctgcccggctatttcgacggcatcatcgaagccggcggcatcccggtgatgctgccgctgaccgacgacgagactacaatcgaacagctggtcagccaatgcgatgggttcctggtcaccggcggccacgacgtggatccagaacggtatggcgaggcggccggccccaagacggtcaaactatgcaaggcccgcgaccggatggaggagcgcctgatcccctccgtcatcgcggcggacaagccattgctgggcatctgccgcggcatccagagcctcaacgtcgccttgggtggcacgttgtggcaggatctgccggacgaacatcccagcccggtcgtgcatcatggcgacaagccgccgtatgacccggtggtccacgaagtgtcgatcgcgcccgattcgccgttggcccgcgcgttgtggccgctgggagacaacggcccgagtgaggcggaggccgatgaggtcgattccttcggcaggccgtatcatccgcgcgcctatacgctgggcgtcaacagttatcaccatcaggcgattcgcacgctgggccagggactggaaccgatggccactgcgccggacagcatcgtggaggcggtctggatgccggccaagcgtttcgtctgggccgtccaatggcatcctgagttctctcaccgcgccgatagcaaccaacgtcgcatcctcagcgccttcatcgacgcctgctgacgcaagctcccgccaatctcgacgaaacgtcttccaagaaatggcttgcccgcatccgcagccccctaccacgacatgagcgcccttgacaacgtcaccctcggcatgcgcttcacccgtgacagcaaacaggtcaggcagcgcaaggccaaggccatgctctcccggctcggactcggccatgtcgcgggagacaagatcatgaccctctccggcggtgaacagcagcgcgtcgccctcgcacgatgcatattgaagcccggggatttgatccctcgccgacgagcccaccggcgcgctcgaccgcgatctcgcccaacatgtcttcgacgaaatgctccgcctccagcacgaatacggcaagaccctcatcatcgtcacccacgatcttggcatcgccgcacaatgcgacaacaccatcgagctacaggcggtttgacggagatattccggcagctttggtctaccgaagtcacgtgttgcccttcaatctcctcggaaatctaggtggcccatttttcaaagaatgcgatcggacgtaacgccccgtaaggagacctgcaatatgaaacgttgaatcgtcatctaaagatgacgttttcgtagatcttccggaatcgccagtcatctgcgatccggatatggcaccggtccggctcgatcgagcccggacgaccatggagaaaacgaacgatcgaatccgaacgcgggtaaagagcctgcgcgacaccattgataaagccaaatttaagaaaacagatcagtatgcataagttttacatgccttcagcctcgtcaaccggcagcgggccccagaatccagtcacagccaggcagagcgtacaacatactgcgtagtacatggcgcgaatcccaatgaccaccatcgattgatgacggccacgaatactcgtactcagccttactgctttggctcatttctgttcacttcacgctggagtaccgagacacgttgagcggaaataccggtaattcacgtacggttaccgaccattggcctgaatggtactcagcatccgcagtcacttggggtatggtcatgacggagagccatcatgaccgatctctcgttattctgggatgaatccggcgaagccggaactgaatctaaatattaaaacgcatgatgcacacgtcgcggaattagtccaccagaacttcggcatattcggcaggttcagcgggttcgatgtgtcgggcacgcatggcatcgagtgcggcagccaagtcggccgggtactgggaccggaccgtggtccagacgcgggtgcggggatgacggaattcgagcttcatggcgtgcagccactgccggtcaagtcccaaggcctcagacagcaccggattggcaccatacatggggtcgccgcacaggggatgcccaatcgaggagaaatgcacgcgaatctgatgagtacgtccggtctccagattcacggataccagagtggcctcatggccgaaacgctccagcacatcccagtgcgtaacggccggtttgccggccggagtcacgcagaagcggaaatcggacactttggcgcgcccgatcggtgcctcaatggttgctttgttctctttaagaccaccctgcacgagcgcatgataggttttctttacctcatgctcggcgaactgccgacgcatctcggtgtacgcaaggtcggacttgcacaccaacatcaagccggaagtgcctacatcaaggcgagaaacgatgccctcacgcccggccgcaccataggaagtgatatgcacgccgcggtcacgcagtgatccgagcacggttggaccggtccagccaaccgaggcatgcgccgccacgcctacaggcttatcgactacaacgacatcatcgtcttcgtagacaacggccatatcagttgcgataggctcaggctcggcctgttcctccgccaaatcaaattcgacggtctcccccgcctgcaatgtgctggaccgtgcaacttcacgccctaaaacgcgcgcctgcccggagtcaaccagatcggcggctttagatcgtgaaatacccagcattttggccacggctacgtcgaaacgcttacccaccaatgcatcgggagcagggactattcgactcattacttgtcgtccgcctccggctcagactgtagggattcgtcggattgctcgatgagatccttgtgcgagaacggctcccccataagaatcagaatcaccaggaccacaccggcgactaccagatagatatccgccacattgccaacggaccagccatagttaaggaaatccaccactttgccgttgaggaagccgtcagcgtacataacacggtcaatcaggttgcccagagcgcctgcaaacgcgaaagaaatcgccaccgaccatttcatggagacagtgcgcaccccagccacagcaagggccacgcaagccacaacggccaacagactgattacccaagtagcgcctgatcccatgcccaaggacgcgcccggattacgcaccaaggtgaaggacagcagtccgggaatcactcgaatggtctgaccgttggataacgcggccatcgcccaagccttggtgagctgatcgacaatcagcgcagccgcggccacacatgcaaagacggccacgcgggtgcgcagccgtccctgttggttcgtcatacgacctgtacctgcctacgctcagttggtcttggacgaggtctggtcgacgtagttgttcgactcggaaacctgcgatgccagctggccgaggtactcggtgaggcgggcgcggtattcagtctcgaactgcttgaggctctggatgttgccctcgacgaccttggactgagcctgaaggttgtcgcgcacctgctcggcatacgtatcggctgcagagcgggtgttcttgtcgtacgcatcagccgcggaacgagtgttcttgtcatactcggcggcacgctgctgcacttccttctcgtagttgtcagcgtcatcgtgctgagacttggagtagttgtccgcatcctgacgagtcttgacggagtatgcgtcggcctcagaacgggtgttctgggagtaggtctcggcatccgcgtgagtctggtcacggtaagcgtcggcctcggagcgggtacgatccgaataggtgtcggcgtcggaacgagtacgagtggagtagtcgtcggcctcggaacgggtacgctcggagtagttgttggccttggtgaccagatcgttgtacttgttctggctggcctcggtgatttccttggccttgttcttgcccttctccacgtactgatcgtgcagctgcatagccagggtcagcatggcggtggcgcgctcgggctcggtgcccggcatggaagcggcgccagcgatcttctgcagagaaccggtctcggtgctcggctcaaccttggaaacctgagcacgaagctggttttcacgctgcttggcttcttcgagctgacgggacagctcagcgatctgagcggactgctgctgagcggcggaaccctgctgctgagcggcggcgagctgacgggacagctcctcattggccgcgcggaactgatcacgttcctgctgaatggcggcgatctgctgaccgacagcctcctggtcaccggaggcctgagcagcctgagcggtgagctgatcgatttgagcgttcagctgatcgacctgacccttgagctgctcattctgggaggacagcgcgcggttggattcctcggcttcgctgagcttggcagagacaagctgtgctgcctgatcattgccagcctgagcggcctgctgggcctgagccacagcgttcttcaaaccagcattctccgactcgagttgctgcacctgaccggtaagatcggagatcttcgcattaaggttggtcacgtcaggacccagagactgggtggcctgaccgccggctaccgcctgacgtccaagagcctcgacggtttccgtgacctgatcaaggaagtcatcgacctcgtcgacatcataaccttccttgaatcgaacagtctggaaggtatgctccctaatatccttcggcgtcaacagagccataaatcttgcacctcgctttggggcatcgcccgcacttacgttggtctcaagtcagaatgctatcacgaccccatcgtttcagaacattcgacgtgggtttttatgccagatatatgcctccggcgggtcaaaaacggcctcagaacactatcagaacaacactttccagtaccaccagcgcaaaatacagcacaatgaagctgacatcaagataaatcgaaccgagcggcaatgggcgaatatagcgacgtagccagcgcagagggggttcggtaatggaatacacaatattgatcagctgggccaccacaccacgtggataccagtttcgtgcgagaacggagacccagtccagaatcatgcgcacgaacagaaccgtgatatacgcgttgatgagccatgcaagaatgcggccgatcaaagagaacactaaggaaagcatgctgacagactaacaaccgcgcatgaaaagtttgctcggagcacaataagaatcggccgactccttgctgggagtcggccgaataccgatataacgtcgaatgcgaaaactactgaaccggtcagtcagcgaacaaatcgtgtgccgaggctggttttgtcggctcttcgaccttgatgttcacctgcgccgggctcaacaggaacacgcgcggagtgacacgctcgagggaaccacgcacgccgaacaccacgccggcggagaagtccacgatgcgatatgccacggcttcggccacaccggtgagattcagtacgaccggaacaccgtcacgcaatgcacggccgaccagttgagcatcctcatatgacttcggatggatggtggtgattctgttcacacgaccaccggggaacggcttggtagtcgacgatgcggcaggcgcggtggttgacgccagcggcgtgaccgtatggtcggaatcaaatgcggacttcgaagccggcttctgctcctcgtcctcctcgatgtagtcgtcctcatcgtccacaacgtcactcatgcccagataggacatcgcgtttttcatgaacccagccatggatcaatcctttcagcgcaggaagtcagggatgtcgagatcgccagccggatcgttcacggcgatattcggatgagcggaagtcggatcatcaaaaggcaacgatgcggagtcaccggtagccggtgtgaatgccggttgggcagtggcagcgggctgtgcagccggtgccggtgctggagctggctgtgccacgggagtcgcaggatcggcggcggttggcacaaccggcgtcaccgtgctctgagtgtcgtcatcttgagcggcgacggggtcaaaaccagcagcaataacagtgacacgcacttcatcgccataagcatcgtccagagcaagaccccaaataatctgggcttcagggtgaatggccttgcgcaccagttcggtggcagcagaggcctcctgcaacttcaggtcggtcggaccggcgatgttgatcagcgcaccgtgtgcgccttcgatgctttcctcaagcagcggagagctgatggcgatttcggcggcctgcgtggcacgatcctctccccgtgcggaaccgataccaaacagcgcagtaccagcaccacgaagaatggagttcacatcgttgaagtcgacgtgaatataggagttcatcgaaatcaggtcagtgatgccctgaacaccggcaagcagtgcggtatcagcggtcttgaaggcctcaatgatgccgatggaacggtcggaaagctcgagcaggcgatcgttcggaatgacgatcagcgcgtcgacttccttgcgcaggttgtcgatgccgtattcggcggaagcggaacgctgagggccttcgaagctgaacggacgagtaacaaccgcgatggtgagagcaccctgttgatgagccgcacgagcgacgatcgggctggcgccagtaccggtgccaccgccctcgccgcaggtgacgaacaccatgtcggcacccctaagcgcctcttcgatatccgactggtggtcctgggccgccttggctccacgctccgggtcggcaccagcaccgagaccacgactggacttatcggaaagggaaatcttgacatccgcatcagagcgcagaagatccttcgcatcggtatttaccgccacaaattcaacattctgtaatccctcggcaatcatgcgattgacggcattaccgccggcaccgccgacgccaacaaccttgatgttggtcttgtcgttgaactcattctgcgcgatctcgctcacgtttggctcctgtcacttcacggttacacccaagagtagcgcaaacaggctactcttggagggaaattcacgcgcagaatggcgcgtgttgcgtgtattttcagtattttctcagtaactggcgtccattgggtcgtcaccgaagagcgcctcacgctcttcgtgggtggtggtacgcgattccaaccagccatacggcaagtgcaccttcttggcgaaacgcacgcggccgcgcggtttgtcgaccacgcgtggcgggtattcgatagtcgggtcgagcttgccgatctcgcggtccacatcggccaggctctcgcattccataaaggccttgcgggtggagccgcccaccgggaatcctttcagataccaggcgatgtgcttgcgcagatcgtggacggccatcatctcatcgccctcataaaactcggtaagcagctcggcatgacggtgaatcacgcggcagacctcgcccagattcgggttgagccgttcgggcttgccctcgaaggcgtttttgatgttggcgaacagccacggccggccctggcatccgcggccgatggccacaccgtcgcagccggtctcgcgcaccatttcgagcgcatcctcggcaccccagatatcgccattgccgaataccggaatgttgaggtgttccttgagctcgccgatgcgggaccagtcggaatgaccgccatagtattcggcggtggtacgggcatgcagggttacggccttgcagccctcctcctgcgcgatgtgtccggcttcgaggaaggtctcatggttatggtcgatgccgacgcggatcttcgcggtgacggggatgcccgccggctcgcatacggcgaccacgcgctgtaatagctcagtgaaaatgtcggttttccaaggcaaggccgaaccaccgcctcgacgagtgaccttgggcaccgggcaaccgaagttcagatccacatggtcggccatgttgccgtcgaccacgattttcgccgcctgttcggtgatggaggggttcacgccgtacaactgcagtgaacggattttttcgcttttggcgaaatgacagaggcgcagtgctttcgggttatgcgccacgagggctcgagcggtgatcatctcggccacgtagagtccatcgggaccatattcctcgcaaatcacgcggaagggccagttggtcactcccgccatcggcgagagcaccaccggggtcggcacggtgatgttgccgagttggaccggggcgatatgcaccggggtcccggggcgcgccggcgcgtccgtacgtgggtcgaggttgtcggtctcgtgatgctcggtgagcactgtttcggattcggattgtgccatgtgattcctaagaaaataagtaggggctcccctgagagaggagccccggcgtctatcgccgccacttcgcctacaaacagcccactgggatgtcttccttacggctcagcccacagaggggagcccaagttgtgcgactccggcttagtacaggccgccggcttcctgaacgccggactcaggccaaggctcaccgcccatttccacaggcttcaggggcacgcgggtgcgcttctcgccgatgcgggcggccacgtaatcggccaccttgtcaagagcgacgcgctcctgggccatggtgtcacgctcacggatggtcacagcgtggtcctcgagggtgtcgaagtccacggtgatgcacagcggggtgccgatctcgtcctgacgacggtaacgacgaccgatggcaccggactcgtcgtagtcgatcatccactcgttgaagcgcaggtcgtcggccaggttctgggccacggtctgcagttcaggcttcttgctcagcggcagcacggcggccttgaccggggccagacgcgggtcgagacgcagcacggtgcgcttgtcaacgccgcccttggtgttcggggcctcgtccacatcgtaggcgtccacgaggaagcacatcagggagcgggtcaggccggcggccggttcgatgacgtacggcacgtacttctcgccggtggcctggttgaagtagctcaggtcttcgccggagtgcttggagtgcgcgctcaaatcgtaatcggtacggttggcgatgccttcgagctcgccccagtcggaaccctggaagccgaacttgtattcgatgtccacggtgcgcttggagtagtgggagagcttctccttcggatgctcgtagtggcgcaggttctccggcttgacgccgaggtcgatgtaccagcgggtgcgggcgtcgatccagtactggtgccattcctcatcggtgccgggcgtgacgaagaactccatctccatctgctcgaactcacgggtgcggaagatgaagttacccggggtgatctcgttacggaaggacttacccatgttggcgatgccgaacggcggcctggaacgggaagaggtcatcacgttcttgaagtccacgaagatgccctgtgcagtctccggacgcaggtagtgcaggctgttctcgtcctcgaccgggccgaggtgggtgcgcagcatcatgttgaagtcgcgcggttcggtccactggccacgggtgccgcagttcgggcagacgatgtccttcatgccgttttccggcatcttgtcgccgtgcttctcggcgtaggattcctcgagcttgtcggcgcggttgcgcttgtggcagttgagacactcgacgagcggatcgttgaacacgctcacgtggccggacgccacccacacttcgggcggcagaatgatggaagtgtcgacaccgacgacatcaggacgggtgacgaccatggagcgccaccattcacgcttgatattgtccttgagagcgacgccgagagggccgtaatcccaagcggaacgggtgccgccgtaaatttcgccggcggggaacacgaagccgcgacgcttcgcaagggatacgacttcatcgagtttggactgagccacaatgcaccttctggtttgaacggtttggggtctaataacaaccgcttcaggatagccgtatatggtgacaggtcaggcggcattgtccggtatatgttccgcgtctcacgagcgaccgttcgcagcgattcctatatcgcaacacctccatattgttcctgttgttttacccttcccgaatttgtgccactgacatcgcgtcagcgtcacaaattcgggagatgttgctcggcggaggcgtctatgtatcacgaatggacggggacgcgccagacctgacgacacgtatcgaacaaatccgtcacgataatgtccatgttggcgcatagcgtcggcactgtaatgcaggggaactcgcatgtggttcgcgagttgagaaaggcctgagcctgacccttagaacctgttggttaagaccatcgtagggagcagtaaatgagcaatagtgcatcatcgtttaccggcgtgtccagcggttataccgccgggactccggttccagccgattcacccatccgtgacaatatcgccgatgccgttcgccgcgtacgcgagacgactccgttggcccagtcattcaccaattttgtgaccatcaatttggttgccaacgcgcaactggcggccggcggcactgcggccatgagtttcctgccggacgacgtgatcgaaaccgcgaaaatcgcgggcgcgaactacatcaacgtgggcacgctgctgccgttctataaggacgcactgcccgaaatcgcccagcgactcaactacttggacaagccgtgggtgctcgacccggtggccgccggcatcggccgcacccgtaccgccattcttcaggccttcaaggccgctcccccgaccatgattcgcgcgaatgcatccgaggtaatcgcgctggcgaacatgtgggggctcaataccgaaaccgtgggggacgcttccgagcaccgccccgccggagtggaatccgtcgacgacgtggagtccgcaaccggcgcggcggtggcgctggcacagtatctgaccgaacagcacgccaagcattcctcccatgacgcttccacccgctgcgccgtggccgtgtccggcatcgccgatctggtgaccgatggcgaaaccgtgtaccgactgccgggcggcagcgcgatgatgaccaagatcatcggtgccggctgctcgctgggcggcgtggctgccacgtatttggcggtctccgatccgttgaccgccgccctgtccgcgtctctgctgtacaaccgcgcgggagaggtggccgatacaacttcgcacggaccgggctcgttccaagttgcgttccttgacgcgctgtggaatgtgaccgccgaacaggtggcggaatccgagatattggtgcagtagtttcagttccctctgatgagggagctcataacagttttttccaataagacttccacaagaaacaacaaaagcaggaataataatgagtaatgaatacccatacgcctccatgcgcgacagcttcgacctgtccgcgtacttcgtggtggggccggaggactgcaaaggccgtccgctgaccgacgtggtggatcaggctctgcacggcggcgcaaccttcatccaactgcgcgccaaggaggccgatgcctctgagctgaccgacatggctcgcgacatcgcgcaaatcatcgaggacaatgagaagtccgattccgtggcctttgtgatcgacgaccgtgccgacgtggtgtggcaggcccgccgcaagggcatcaaggtggacggtgtgcacatcggccagaccgacatggagccgcgcgaagcccgcgccctgctcggcgacgaggccatcgtgggcctgtcggctgagaccgaaagcctcgttcggctcatcaacgagctgcccgacggctgcatcgactacattggcgccggtcctctgcacgtctccaccaccaagcccgaggcttccgtgggcggcaacgacggctccggcaagacgctggacgccgcccagatcaacaccatctgcgttgccagcgaattcccggtggtcgtgggcggcggcgtgaccgcagccgatatggccatgctcgccgataccaaggctgctggctggttcgtggtctccgccatcgcgggtgccgagaacccggaagaggccgcgcgcaccatggtcgaaggctggaaggccgtccgcggcgacaagaagcacggctacgctccgcgcgtcgtaacccacacccccgctactgacactcaggctgctcaggaaggggccgcgaagcccggttccgaggccactgagaagaagttcaccaacgccaaggacgccaaggatgcccagaagcttgccaagcagcagcgcgtggacatcgccgcccgtggttccaagcagcgcgacaaggcgcacatccgcaagaccaagtccgtaccgttcacctatcagtatggttcctacgacctggaagtgccgtacaccgaaatcaagctgagcgacacgcccggcgtgggcccgaacccgccgttccgcgactacaacaccgaaggccccaagtgcgacccgaaggaaggcttgaagcccctgcgtctcgactggatccgcgaccgcggcgacatcgaagactacgagggccgccgccgcaaccttgaggacgatggcaagcgcgccatcaagcgcggccgcgccaccaaggaatggcgtggacgcaagcatgagccgatgcgtgccaaggaccacccgatcacccagatgtggtacgcccgccacggcatcatcaccccggagatgcagtacgtggccacccgcgagaactgcgatgtggagctcgtgcgctccgagctggccgccggccgcgcggtgatgccctgcaacatcaaccaccccgaggccgagccgatgattatcggatccgccttcctgaccaagctcaacgccaacatgggcaactcggccgtcacctcctccatcgatgaggaagtggagaagctgacgtgggccaccaagtggggcgccgataccgtgatggacctgtccaccggtaacgacatccataccacccgtgagtggattcttcgcaactcccccgtgccgatcggcaccgtgccgatgtaccaggccctcgaaaaggtcgaggatgatgcctccaagctgagctgggaactgttccgcgacaccgtaatcgaacagtgcgagcaaggtgtggattacatgaccatccacgccggcgtgctgctgcgttacgtgccgctgaccgccaaccgcgtgaccggcatcgtctcccgcggtggctccatcatggccgactggtgcctgcgccaccaccaggagagcttcctgtacacgcacttcgacgagctgtgcgacatcttcgccaagtacgacgtggcgttctctctgggcgatggcctgcgccccggctccctagccgacgcgaacgacgccgcgcagctttccgagctcatgactctgggcgagctgaccgagcgcgcctgggccaaggacgtgcaggtgatgatcgagggcccgggccacgtgccgttcgacaccgtacgcatgaacatcgagctggagaaggccgtgtgccacaacgccccgttctacaccctcggaccgctgaccaccgataccgctccgggttacgatcacatcacctccgctatcggcgccaccgagatcggtcgttacggcaccgctatgctgtgctacgtgaccccgaaggaacacctcggcctgccgaacaaggatgatgtgaagcagggcgtgattgcctacaagatcgcctgccacgccgcagacatcgccaagcaccacccgcacgcgatggatcgcgacaatgcgatttccaaggctcgcttcgagttccgttggctcgaccagttcaatctgtcctacgatccggacaccgccatcgccttccacgacgataccctgcccgccgagccggccaagatggcgcacttctgctcgatgtgcggcccgaagttctgctcgatggccatctcccagaacatccgcaaggcattcggtggcgaggccgctcagcagcaaatcgtgaaggaggctgctgcaggcatcgactccgaggcactggctacggccaaggccaatgtcgataacggcgtggtgtccgccaacgtgctcagccccgaagaaatcctcgccggcatggatgcgatgagcgaaaagtacaccgcccagggcggcaagctctactccaccgcccaggagtaaacctctctggctcccctctctgaggggagccaattattatgcccggtggtgtcttaattcgggacgacgctcgactcgctcgaaggcggtgccgaagtgtgcgccatctggaccgaggccgtcggaagtctccaggaccacgccttcgttgagcgcacggcgcacgatgcccacacgaggcttcaacggccacacatcatgcggcactttgcgatagaaatccgtaccgacgagcaacacgtcgcccacatcgaacacttcctgacgcggaaatgtgagctgtgtggtgtgtccgttaggcattacgccaaaatatgcggtgcgttccggtgatgcgcaccaagacgccgtcacggcgcagtacatcgttatcagccatgcctcctcccgaacatttcatgaatcaatcgcaatcagcaaaccttccccgtctcaccacaggagcggcaaaacatcaaggaaaaccgctccgaaaaacatcatgggccccacttagaatgaacactatggcacaaattgcaacatctacacttcccgctgttctcgcgatctccggctccgactcgtccggcggtgccggcatgcaggccgatctgaagaccatgctggcctgcggcgtgttcggcatgagcgccatcaccgcgctcaccgcacagaacaccaccggcgtgcgttccattcaggacaccaaaccggacattctcgccgaccagatcaacatggtgtttgaggatattccgccggtcgcggtgaaaatcggcatggtgtctgccactgacatcatcgacgtcatcgctgaacgactcaccttccatcacgccacgaacatcgtgctcgacccggttatggtggccacttccggtgccaatctcatcagtgacgatgccattgcggccttgaccggcaagctgttcccgatggccacggtcgtgactccgaacattcccgaggccgaagtgctgaccgatacgctgattcgcgatcaggaggatatggaggccgccgcccaccgcctcgtggagcgttatggctgtgccgcgctggtcaagggtggtcatggcaccgaggatgccaacgatgtgcttgccgagacggatggaaccgtgacctggtttgatggcgcgcgtatcaataatccgaacacgcacggcaccggatgcacgctgagctccgccatcgcctcgtatctggcgcttggcgacacattgcccaaggccatcaagcatgcgaagaagtatctgaccggtgcactgaaggcccagctgaatcttggccacggctccggcccgatggatcatttctggaagtatcgctgagtcctactggctctcctctctgaggggagccaagtaataaaaggagaattatgattattgaccgtaatgccgttactcaggaagtgccgatcgacccggaaaccggcaaaccgtacctcaataccgtggccgccattcaggtgtcggccaatggcgtgggctccgaggtttcgccatacgtggctcaggccgtcgaggtgattcgcgaatccggcctgccgcaggaaaccaacgccctgttcaccaacgtggaaggcgatctggacgacgtgctcaaggtggccggtgaggccgccaagaagctcgccgagcagggctaccgcacttctctggtgctgcacatggatatccgccccggcttcaccggccagctgaccgaaaagcccaagctggtggatgagatcctcgccgacaagcaggcgaagtagcaaagcatcgcttccaccagcaagggcatgctttgttattacacgtttcatggggcggtagctcacccatggggtggtaaaaccctcatggggcggtagtcgaaaacggctctattctacggaaaggcataatccgctaaccgccccatgggccaaataccgccccatgagtgttttaccgccccatgggaatcacggttctgccttctttcgacggggtaagagcgtaagtggggcatatataggagcgtcacaacctctgttatcgttcacgatgtgaccgcaacgcggcgtgccacaaaatcgaacctatagttaagccccatgtagtgagctatctcacaacgattggctcgctacgtagaattcaagacttggatcgcaaacgtcgttcatcccacacaatgggagggcgaacggaacacacagtccaatcaagagttcgctcgccgcaacaccattgagcagttgcacgcgggcaggtttgcaagaagagggctcaaatatgactgctgctgaacagcagatttccggcaatcccgcggctatggaaaacgcacaagcacgtaccaccgtgacggatcaagccaaggttcaggatattatctcgcgcatggatcgcgcacatgaaaccccgatgttccatcgcatcgtgacgctggtcgccgctggcatgctgatggacagcatcgacgtatatattggcagcgccgtcgcctccagcacgttggctacccgctggtccaccgttgcgcaaaattccacctttatgtccgcgggcttcctgggtctgctggtcggttcgctgctggccggcttcgtcggtgacctgaagggccgccgcgtggcttaccaaatcaacctgctgctgtttggcggcttcaccttcctcggcgcattcgccccgaacatggctgtgctgtccctgtgccgtctgggtgccggcctgggcctcggcgctgaaatcgtcaccggcttcgccatggtcaacgagttcgcaccgatgaaccgccgtggccactggtgcgcgattgtctcgctcgtggccaactgcggtgtgccaatcgctatgctgctgtgtgcatggatcatcccccgctggtcctggcgtccgctgttcgtggccatcggcctggtggccgccatcatctggtggctgcgccgcgacatccccgaatccccgcgttggctcgccgtgcgcggccgttacgatgaggccgacgccatcgtcaagcagcttgaggccaacggttccgaaccgatcgacgcagccgccaaggccgacaccagcgacacccgcaacgccggaggccgttcgctcggcatctgcctgcttgtggctgtggttgctgtggccgccacgaacgtgtgctcctacgccttcacttcttgggttccgacgattctggtcaagcgtggtattaacctgtccagctcgctgctcacctccacggtgatgatgctcggtgccccggtcggctgcctgattggctctctgcttatcgaccgtatcggccgcaagcgcacgattgtgccggccttcctgttcactggcgtgttcggtttgatgtatgccttccagacctctaccgtgagcgcaattatcgttggcttcctgctcatgatgtgcctgtacgtgcttatggcttccgtggtggctgtgtacgctccggaactgttcgccaccaaggttcgcttccgttgcgtcggcttcgcgaacgccgtggccaagctgctcaatgtgttgatgccgatggtggtgggctggatgcttacctcgcttggtgccacgtccatctttgtggccatcagcgcgattgctattgcatcgatgctgattgtcggcttctttggcgcggagactgcgcagaagtcggttgggtgatcggtttcctcacagtggaataactgctgataatgtccattcggcgtcttgcgtggtgatatgcagggcgccgttttgttgttctagtaattgttggtaacggttgaggccggtgccggtggataggtctgcgtctccagcggacaatcagcgtctgtgatgtcacatgcaatgccaggagcggcatcaacggtcgaatcatgcggagtcactgcactgtgcgccgcttctcccctgccttcaatcacatcaatgacttgatgcgtgcgatccaatgcgcccatagacatatccgtaaccagcacgtcaggccgcttggtggggctcaggcatcggctgatggccacagcacccaaatcgcaggtctatatcacggcaaaatcgctggacatacgttcgattagcgcgccgaacactttcagcgcatatgggtcattgtccacaatgccgatgcgtatgttgcggttgcgcgcttcttccattacattcaccccttcagtgtgcccgacgccgaactactccgtcctgacacgtcatggtcactatgacaactatcattccacatttcctgcgtgatttacgatggaatcatcatcaatccttgacaaggcggtaaaggaggacggcaatgaaccgtgcacaagcactcagcaagctcaacaggagcgatatgcgcaatgccgccgccgagcgcgggatgcaacgactgttcacatggaaccgcgcgcattggattggcatggttgtactgatagcggtgttgctgctactgcagtggagctcatcaatgtatctcatgcccgacgaggttcttgacagggctgccaaaaacctgttcgtatggttccccggtatggttctgcactggccattggtgttgggaatcaccaacttgatactcggttcgacacgatccggcagtctgtctttcccgttggcgagcgcaatcatcggaccactggcattcggctggaccaatcttcgcttacggccggggttcccataccgttcctgggctcaagggaaagccgcaatataatgaaaacagcgatttcatgcaatgatgcacgagccgatccaagcaaaggggccaaccatgagcgagcaactgatggaacagtaccggttgcgcggacaacgcaaatgccgtaacgcttgtatcgccgccatcgtgacagtagtgcttgtccttgccgtcgccggcggcgtatggtggacggccggcgatggcagcgcattggttcgcaatatgttcaagccgaaggccacgcctgccacgcagccggtagtcaacagcaccgcaaccttcgcctaccgcaccgcaccggaattcctggcgatggaagccggcgaccgaggcaccggcaatgtgaactactctcctgcttcgatgtggatggcgttggccatcgccgcgcagggcgccaatggcacgacccgctcgcaactgaacgaactgctgggctccggttcgctgaccgatagcgactaccaatcgctgctaagttcgatcaacgggcaatattcgggggcgaaatccgagatgagcgccgcgaactcgctgtggattgatgacgactactctcttgccagcgattaccaatccaccgtcaagaagatgttcgaggccgaagtcaccacgttaccgttcgacgatcaggccgccgcaaagatgtccgattggatcgccaagcatacgaatggttcgctcaagccgaagatcacgctgcgtgaccgtgaagtcctgtccatcatcaacaccgtctatgcggatggccgttggaaggatccgttcgaagagcagtccaccggcaacggcaccttccacggcgaagccggagatgctcaggtgccgatgatgcaccggaccttcagccaaatggcttacggacatgatgagtacaacacttggcagcgggtggagattccgttcgacaacggcggcaatctggccatcgtgctgccggccgaagggcatttcgacgagttggccggcgatgccgagaagctcagttgggcgttcggtacatgctcgacggcttcccttggcgagggcgcaatgggttgcgccgcggacagtatgcccggatggggcgtctccgtcaactcggtcatggtgaacgtcacgctaccgcgattcaccatcgacagcatgttcgactcggaagccaccatcaaggcattcgaaaaactgggggtgaccgatgcgttcagtgcaggcgacgccgacttcaccaagatgatcgacaccggttcgcacggcgagaacctgtatatcggctcgattctgcaaggcacgcgcatcgaggtgaacgaagccggcgccaaggccatgtccttcaccaaggtcggcgcagactccgttagcgcgccggtggacaacgtcgagttcacggtggatcgcccatttctgtattcgtacgtcaccccggacggcataccattattcatcggtgcggtgcgcaacctcggcggagtcggtggagaaaactgatactttcctggcagtccgtcaattagggtgtatcgtttgacgcatggttacgatgaaggaaatcgcgaacaaggcgggggtttccgtctctacggtatcgctggtgctcaacggacgcgacgaggggcgcgtaaagtccaaaattgcggacaatgtgcgcgccatcgccaccaagctcggctaccagtcgaatccgctggccagttcgctgcgtacaggcaggacgcacatcctcggtttcatcagtgaggaggtggccaccaccccgtacgccggcggtatgattctgggcgcgcagaccgctgcaagccagttcggctatatgctcatcaccgtgagcgccgacggcgagaacagcgagagcgaggaaatcgccgcactcaagcgatacggcaccgacggctttctgtacgccaagatgtcgaaccgcatcacccatgtgccttcctcgctggccaagacgccactggtgttggtggatgccaccgactcgcttggcaaaatcccgagcgtggaaccggacgagttccaaatcggctacgacgccaccaccagattggttaaggccggatgcgcacgtatcgcctatgtgggttgcttggagccgctgattgcgcaggacgatcgtttggaaggctatcaggcggcgctcagggacgccggcctcgactatgacgatcatctggtcgtcaatgtgctcaacaacgggccggcactgaccgcagtcagcgatttgttcgatgccgagcatccggacggattcttctgcttcaacgatgcccgcgcctggtatgtgtacgaatgcgccgcacgccgaggactcacggtcggcaaggacatctccgtggtcggcgtggacaaccatcgcgtgttcgccgaaacgctggaaccgatgctcaccactgtggaactgccgcatttcgagatgggctactgggccgtggccaagctggtgtcgattatcgaaggacgctcgatggacgacgtctcatggccagcgaccaccgctcccctgccgccgatcgacgcgccgattccggcgaagatccactgcacgctgatcgaaaaggcctcggtgaagtaaccgagtcccacacgatttctcaaggcctccgttcagcacggaggccttttgcgtgtcgaacggatacgacacgccgatttacgccaatcgattgacgtaaatcgattgacgtcgcataataattactacgcaacaacttctacaaaggcacggccgcccgagcagaagcgttacataaccaataaccaaccaagtagtaatcaaaggatgattatggcaagtgcaaccaaatctgcatggaagaatccttcctatctgcagagctctttcggcatcttcatgttcttctgctcctggggcatctggtggtccttcttccagcgctggctcatctcaggcgttggattgaccaatgctgaagtcggcaccatctactccatcaactcgctggccaccctggtcatcatgtttgtgtacggcgtgattcaggatcagctcggcatcaagcgcaagctcgtcatcgtagtctcggtaatcgccgcctgcgttggcccattcgtccaattcgtttacgccccgatgatcctcgccggtggcaccacccgctggatcggcgcactcatcggctccatcgttctgtctgccggcttcatgtccggctgctccctgttcgaggccgtcaccgaacgctactcccgtaaattcggtttcgaatatggccagtcccgtgcttggggctccttcggttacgccatcgtggcgctgtgcgccggcttcctgttcaacatcaacccgctgatcaacttctgggtcggctccgcattcggccttggcatgctcctcgtgtacgccttctgggtcccggccgagcagaaggaagagctcaagaaggaaaccgacccgaacgcagcccccaccaacccgtccctcaaggaaatggtcgccgttctcaagatgccgaccctgtgggtgctcatcgtcttcatgctgctgaccaacaccttctacaccgtgttcgatcagcagatgttcccgacctactacgccaacctcttccccactgaagaaatcggcaacgccacctacggcaccctgaacggtttccaggtcttccttgagtccgcaatgatgggcgtggtcccgatcatcatgaagaagatcggcgtgcgcaacgctctgctgctcggcgctaccgtgatgttcctgcgcatcggcttgtgcggcgtgttccacgacccgatcaccgtctccatcgtcaagctgttccactccatcgaagtgccgctgttctgcctgccggcattccgctacttcactctgcacttcgacaccaagctctctgccacgctgtacatggtgggcttccagatcgcttcccaagtgggtcaggtcatcttctcgacccctctgggtgccttccacgacaagatggctcagattctgccgaacaacgacatgggatcccgcgtgaccttctgggtcatctccggcatcgtgctgtgcgcgctgatctacggcttcttcgtcatcaagcgcgatgatcaggaagtcggcggcgacccgttctacaccgacaagcagctgcgccagatggaagcggccaaagcctgaaaggacagccatgactgacttcactcccgaaacccctgttctcacccccatccgcgaccacgctgctgaactggcaaaagccgaagccggcgtggctgagatggccgccaagcgcaacaaccgctggtacccgaagtatcacatcgcctccaacggtggctggatcaacgacccgaacggcctgtgcttctacaagggcctctggcacgtgttctaccagctgcacccctacggcacccagtggggtccgatgcactggggccacgtctcctccaccgacatgctcagctggaagcgcgagcccatcatgttcgcaccgtctctagagcaggagaaggacggcgtgttctccggttccgccgtcatcgacgacaacggcgaccttcgcttctactacaccggccaccgttgggccaacggccacgacaacaccggcggcgactggcaggtgcagatgaccgcgctgccggacaatgacgagctcacctccgccaccaagcagggcatgatcatcgactgcccgaccgacaaggtcgaccaccactaccgcgacccgaaggtctggaagaccggcgacacctggtacatgaccttcggtgtctcctctgcggacaagcgcggccagatgtggctgttctcctccaaggacatggtccgctgggaatacgagcgcgtgctcttccagcacccggatccggatgtgttcatgctcgaatgccccgacttcttccccatcaaagacaaggacggcaacgagaagtgggtcattggcttctccgccatggggtccaagcccagcggcttcatgaaccgcaacgtcagcaacgccggctacatgatcggcacgtgggagccgggcggcgaattcaagccggaaaccgagttccgcctgtgggattgcggccacaactactacgccccgcagtccttcaatgtggacggccgtcagatcgtctatggctggatgagcccgttcgtgcagccgattcccatggaggatgacggctggtgtggccagctcaccctgccgcgcgagatcacccttggcgatgacggcgacgtggtcaccgcgccggtcgccgaaatggaaggcctgcgcgaggataccctcgaccatggttcggtcacactcgacatggatggcgagcagatcatcgccgacgacgccgaggccgtggaaatcgaaatgaccatcgacttggctgcctccactgccgagcgtgcgggtctgaagattcacgccactgaggacggtgcctacacctacgtggcttatgacggccagatcggccgcgtggtggtggatcgtcaggccatggccaacggcgatcgcggctaccgcgccgccccactgaccgacgccgaactggcctccggcaagctggacctgcgcgtgttcgtggatcgcggctccgtggaggtctacgtcaacggtggccaccaagtgctgagctcctactcctacgcctccgaaggcccgcgcgccatcaagctcgtcgccgagtccggtagtctcaaggtggattccctgaagctccaccacatgaagtccatcggactggagtagctctttcacctccctctgacgagggaggtttttttgtgcgccctgtcgttcgccttcgcctatactgatggacggcatataacacaatccatcacacgaccggcaggcgcgcaggctcctcaccttactgttccacgccccggccgcaagcgccaccagcaaaccggactggcgcggaaagcaaggtgacatcccatgtccatcgccaagcgcctcaagcgccgcatgcccaccgtcatcgccgtcatcgtattgctggcagtctgggaaacgtgggtggatctaggacatgtctcccccacgatgatctccgcgccaagcgagattttcgccgccaccatcgaaacatggaacacgctcggcccggccgcggcaatcaccggctatgagggcgtggttggattcctgtttgccgtgttcttcggcattatgatcggcattgcactgtactgctcgcacacgttcaacgcggcgttctatccgctgcttgccgccgcacaaaccatgccgctgatttccatcgccccgttgttcctgatttggttcggttttgagatttccggcaaaatcgtaatcgtggcggtattcggcctcttccccatcgccgtgcagactgtgcgcggactagaagcagtgccccagttctattccgacgtcgcattgacctgcggcgcgaccccggtctggacgctctggcacgtgaagctgcgcgttgccgcacgtcagatctatggcggtatccgagtatctgccgcatacatcttcgccacggcatccaccgctgaataccttggcgcacgcaagggccttggcatctggctgcaggctgcctacaattcattccgcacgccgctgatcttctccgccaccatcgtcattatcctgatgacatgcgtactgatgctggcggtaaacgccagcgagcgcatcctgctcggcccgcccggcgacgacgaagaccccgacgcggaccagtagttctttttttaccgtcaaaggcacgagccggcggccaggaccgactgaacgaagcggcttctcatgaggtctccaaccctgtctctataatggaacagctttaccagcgtgtggcaaaccggctttcccgagctttcatagggaatgtcgggggcgctggtcgaacggaaatcaaggccctccatatcgttttctgccgacttccgttcgaagcaatcccagagaacgatagagagacaacgaattagggaaccatcattatgaagaaaagccttgtatccaaggccgctgccctcgtgggcgcccttgccatgactttcggtttcgccgcatgtggccagaccaacaccgccggctcctccaactccaacacctccgacctcaagaaggtcactttcatgctttcctgggcacccgataccaaccacatcggcgtgtacgtggccaagaacaagggctacttcaaggacgccggccttgacgtggatatcgtggccgtggcccaggccggtgccgaacaggccgtgaacaacggtgtggccgacttcgccctgtccaacctgaccaacgtgggcgtctacacgctgaagggcgctcacatcaagcaggtgctgcaggtgcagcagaagccgagcgccatttggtgcgcactggcgtccaacaccgccatcaagtcccctaaggatttggatggcaagaccttcgccaccttcggctccaacgagtccgatgccgtggtgcgccgcatgatccaaaccgatggcggcaagggcgaattcgacaaggtgaccgtcggcacctccaccttccagaccatggaatccggcaaggccgatttcggcggcttctacgccacgtgggaaggcgtgcaagccgacatgtacggcccgaagctcaactgcttcaccgagcctgactatggcgtgcccggcaacgccgacaccatcggcatcatcaccaatgacaagaccatcaagaacaatcccgacctggtcaagaagttcactcaggccactcaaaagggttacgagtacgcgtacgccaacccggatgacgccgcgcagattctcgtggacgaagcccctgacgccaacctcaagcccgaattcgtcaagaagagcatgcaggttatcgtcgacggccagtactggggcgatccggccaagatcaaggacggctctttcgtgctcggcaccaacgacttcaagggcgctcaggaatacttcgacttcctggctgaagaagacgcatacaccgacagtcatgacaagataattcatgaggccccgcaggccaaggaccttgccaccgacgaattcatcggcaagtaatttccgatattccgagtttgaatctacgcaaaaatgcgtccttcccatgaggaaaggacgcatttttgcgtatcggccgataaggttattcatagcggattacgctaacaaggagacgattctatggtccaatgtcctgaccgcattattgccagcatagatacgggtgttgatgatgcgttggcgttggcgtatttgttggggtcgacggatgagtgcgagttgggtggcgtgattgccagttatggcaatgtggatgcgaacacggcttatgccaatacttgcgcggtgcttgatttgtttggtcgggcggatattccagtgtttttagggtctgagcatccttcttgggctgatgcgtttattcctgatgcagggtgtgcccagttccacggggatgatggactggggaatactcggctggcagggtccggggctctggctgatggagcttgtgtgcctggtgatgatatgtctggtgatgatatgtctggtgatgatatgtctggtgatgatatgtctggtgatgatatgtctgtggatgtgcccgatgaggttgtttctgttggcgggtatttggcgggggatgttcatgctcatccggcgttgggtgcttgttctcgtgtgaaccgctctcagtcggtggaccatccccagtcggctatgccgacagctctcgccagcgggggcaaaaggaggtgctccgttgatgctgcggatgggattgagtatctgattgagcaggttcgcgagtttggccgagacgttaccgtgctggctaccgggccgttgacggatgtggatgcggctattactcgagcaccggatattgcatcgaaactcaggctggtgatgatgggcggtacgcttacccaacccggtaattgttgggatgcggtagctgagacgaatatcatccaagaccctgaggccgcgaatcgtgtatttcattccggcgcagacatcacaatggtgggacttgatgtgactcaccagtgtttgctaccgcaatcggcggccgaccggtggcgtgcgacggggaccaagcgcgggcggttcttggctgatctcgcggacttttccatcaaggcaaatttggaagccgaccccgcactgttctctggcggcatgccgttgcatgatccgttggcggcggcggttgcacttgattcttcactggtcgattgttttgatcttgcgttgcgcgcggagaccaataccggtgatttcaatggagtacgaggccggaccaccggagacccggttgggctggtgaatcattccatgccgcatgtgcatgtggcacttggtgtggattcgggacgttttttggatgagtttgtagagaggatggctgaggtgtgccggtaactcccctcagtccgctacacgggcagctcgaccgcaattacggacaagctgccgctcgcattcttctggctcgactctcgtctcgccttcgcctacaaacagtccaccgggcgtttgctttacggctcagcccgtcagagggggcctaacaaggactatttcacacccccagcaatcaaggaccggcttcgccggactcatcattacctggtcatgtcctatcggcctcggccaggcggcgtgaacgaacagtccactggactgttctttatttcacgccgccaaatcggcgatcgcggtggatgtaatggtcgatggagcgccatagcacgtcacggccgcagtccgggaagagttcgggcacgaagtcgagctcggcgtaggcggcctcccacggcaggaagttggaggtgcgctgttcgccggaagtacggatcaccaagtcgcaatcgggaatgtccggattgtacagatggtcggcaatcatcttctcagtcacacggtcgccggaaatcttgccatcgcgcacttcgcgagcgatggcggcgcaggcgtcggcgatttcagcacggccaccatagttgatgcagaacaccacatcgatgaccttgttgttcttggtgcgctcctcggcggcttcaagctcgtcgatcaccgacttccacagcttggggcgacggccggaccagcgcacgcgcacaccccactcgtccatctgttccacacgacggtggatgatttcacgcgagaaacccatgaggaagcgcacttcctgtggcgagcgcttccagttttcagtggagaacgtgtacaggctcaaataccgtacaccggcttcgatggcaccggcgatagtgtcgaacaccaccggttcggcggcctgatggccattggtgcggaccatgccgcgctgcttggcccaacgaccattaccgtccataatcacaccgatatggcggggtaccttgttcttggggaagtcgggaatacgagcggggtcgctgaacggagctgcgggaatgtccaacgacgtgtaatcaacgttctcaaaagccatactcatgaatctatcaagcgcagcgaacgaatcgggcgttcgaggtaatactccccccaatcttcaaccaactcctgcacaacccgctccacaggcgcggcatcaagcaccgaccaatcgccacgaatcagtgcatcgaactggtttaacacgaacggtgcgatacggcgcgcatcggtagtgtggtcggcttcgcacatcacaccgccggacgcgatggacaggtacgccggctccgccttgccgcataccacgcaagtgcccaatcgtggcgtccaaccggccaaggccaaggcgcgcatcacataggagtcgcctatggcttgcggggcgtgggattgtttggcgagcgcgttcaacgcgccgatgagcagccgatattggttcggcagctgctcatgttcggtgctggcgattttatcgatagtctcaacgatgacgttggcggcctcatacgccgcataatccgccgcgatcggagcaccataagcggcgaccgcttcagcttgggagaccacgtcaagcgagcggccttcagcgataagcacatcgactcgcatgaacggctcgagcctggcaccaaagcgtgatttggtgcgacgtacgcctttggcgaccgcccgaatcttgccatgcccacgcgtcaggatggtgatgatacgatcagcctcgcccagtttggaggtgcgcaacaccacaccttcgtctcggtacagcgacatctcatctcctttcccgcgacgcctggcagactctactcaatgaagtagtcagtaaataaacagaccccagaaggcgaacaccaacagtatgtacagcatggtgaaggccaccagccagaacaggattcggcccagacgggtggaggccagtaccgggtcagcaccggtgacgatgtctcgaacggattcgcgacgagggggtatctgaatcaggccgcggacggaagcgacttctatcagatgcataaagacgcgggaccaagcccatagcaccagcacggacaccacttggatgaccggccagctccaatacatgacacccggcgtctcggtaggtgcgccaccccatgcaagtttgaccacgcccatgatcacctgcccgagtccggcgaagaagatgagcaatgtggcaagagtggtgagggtcaaagtcagcagcgcattgccgaaaccatgtgcgaaaccgagtaccacaggccgttccggtatcagcatgcccgcacgtttggcctcgcgcttctctcgccgccatcgggcatccgccgcgattttgcgacccagcgccaccagtgccagcacgatggatgcgagcagcagcagtaccaccgtgacgtgcagaatcacaccatatatggtgccgacgcgtcttgccttcaaagcgcccggcagaccgattgattggtacagattggcgccggccaccttttcgctggtctgcgtgagtccggcggaagtgccgacggcccagtcgatgagatcgtccacataggcgtccgcaaacggggtgcccgcttcggactcatctcccaaacgcagcacatggttggcgaccgggtagctgcgcacggtcacattccagttatcggctttgtgggcgttgtagagaatcgcacgcacgccgtcgacctgcgctgtcatcacgtctttcgaaccgtaagccacataggtgggtacggcgtaggcggcgggtttgagtgtggcgaggtcgaaattgttcagtccgaacaggcctgtgtccgcgctgaatacacgttggacgatggattgatagccttcgttcgcgccaacaagggtgaagtcttgggtgacgaaaaatcccagcgattggcgtgggctgaacaccatcgggctcaggagaatctggaaggcgacgtccggatcgtcctcgagcagatacgaggagatccatgtcgattcggaggtggcatagatgccgaccttggcctcgtctacatcgctttggtctcgcaggtattcgatgacctgatcataagccttggctgaggccggataatcgcggttgatgtcggtggtgttccagacgggtttgtcgagcactgcggtcacaaagccggccgaagccataccggaggccacgtcgccaaaggagttgtcacaggtgccgtatccggcaccgtgcatgaacaccacgccggggcgcttgcctgatgcgttctgaggttcccgaatcaataccttgatggcttggacgccgtccgcattggccttgccccgagcaccggactccttggtcagattgccgtcgccggtcatgttcagcgtgatgtatcgctcggtgacctcatacgtgccttttgccggcagcgtttctccggacgggttatcgaaggtgacttcggtatcgtcggtgaacgtggccatcgactggccggtgggttcgatgttccaaggcaccgtggtcagattggaaatggagaccagcacgccaatcaggataatgaagatgggcaggctgaccatcagccggtgggtgctggtccacggcttggatcgaacagtcaggcgatgctcttcttcttgcggcacgtgcgctattgtaatctgaccgcgatatttatgccgagggcctattcggccgaatcagtgaccggggtgctggattgggaccacgaccgggccggtggaattgacggggacttgaccgtcggcctccatttgggcggcgatatcgttcgctatggtgagcagcgtgtcgacgatctggtcttcgggcacggtcttgatgaccttgcccttgatgaagatctggcccttgccattgccggaggccacgccgaggtcggcttcgcgtgcctcgcccggaccgttgacgatgcagcccatgacggccactcggatcggcgcggtcacgtccttcaggccttcggtgacggcggaggcgagctggatcacatccacttgggcgcggccgcagctcggacaggagatgatgtcgaacttgcgggggcgcaatcccatgtattccaagagtttgcaacccaccttgacctcttcggccggcggcgcggagagagacacgcgaatcgtgtcgccaatgccctcggccaagagcgcaccgaacgccaggcaggatttgatggtgccttgccaagcggggccggcctcggtgacgccgaggtgcagcggccaatcgcccttggaagcgagcagtcggtacgtttcgaccatggtgatgacgtcatggtgtttgacggagatcttgaaatcgtggaagccgacgtcctcgaacatgtgcgcttccttcaaggcagaggccaccaatgcttccggagtcgggccaccgtatttggcgtagagttccttgtccagcgagccggcgttcacaccgatacgcagcgagatgcccgcgtcggtggcggccttgcagatgtccgggccgacttcgtcgaacttacggatgttgccggggttcacgcgcacggccgcgcagccggcgtcgatggcctggaacacgtatttggactggaagtggatatcggcgatgaccggaatcggcgatttgcggcagatttccggcagtgcgtcggcatcgtcctgactcggcacggccacgcgcacgatgtcgcagccggcggcggtcagttcggcgatctgctgcaacgtggcaggtacgttggccgtgagcgtgttggtcatcgactgcacggagatgggcgcgcccccgcccaccggcaccgggcccaccatgatgcggcgggacttgcggcgcgggtgcaagggcgattcgctggtcaggtcgaccggatcaccggttttgcggaacggcttttcgatgggattttccgtattcaaggtattcatcattgcttgtttatcaggtcgtcggcgcgtcggcgggcttcaagctcaagctggttcatttcctccacgtccgtgaacagcgggttaccacgaagctcggcgtccatctggtccagcacggctttgaccgtgtccacgatgccgaggtatggcagacgatgctcgaggaaggcatgcacggcctgttcattggcagcattgagcaccgccgtatgcttctcggaggcggccaggcagtggcgggccagttgcacggcagggaacgcctcatcgtccaacggttcaaaggtccaagttgcggcttgcgtccagtcgcacgcggcggccacattggtcatgcggtccggcgcggacagacccagcgcgatgggcagacgcatgtctggcggcgaagcttggcaaatcgtggcgccatccacaaattcgaccatggaatggacgatggactgcgggtgcacggtcacatcgatgcgttcaggcggcacgttgaacaagcgggacgcctcgatgacttcgaggcccttgttcatcagtgtggaggagttgatggtgacaaccggccccatgttccacgtcggatgatgcagcgcctgctcgggagtgatgttctccatgtcggcacgtttccagccgcggaacggtccgccggaggcggtgaccacaagcttggcgacttcggcgtgggttccggagcgcagggattgccagatggcggaatgctcggaatcgaccgggttgatttggttctcgcgcacttgcgcgctgaacagcagatgcccgcccgcaactacggactccttgttggccaatgccagctgggaaccggccttgagcgccgcgatcgacggttcgaggccgatggagccggtgatgccgttcaatacgacattcgcaccggagccggccatggcgatgaccgaatccggaccgccggtcacgcggacaccttgtgcgccggcctgtgcgagagctgcttgcagcgctggaaccttggtctcatcaaacaccgcgacttcggacacatggaactgtgcggcctgttgcgccagcagctcgatatgtgctccgcccgccgccagaccggtgacggtaaatcgttcaggatgacgcgagatgacgtcaagtccttgggtgccgatggatccggtggatccgagaatgatgacagtggagttggaggctatgctcactgttccttcttcgtatcgtcattgttcagtgtggggaacgacaggtcggggatatccgaatcgaagttaccgccaagcgggaacagcagcgggaacgaatcgctggaatcgtgcttatcctgtgacggctgagctgcttccgtgtcatgggaggcggcaacgtattcagatgattccgcagccggacgggagatcgtgctgtctgcaggctgactatcggatacgcgaaccggaatagagttcgtgttacgatccggcttgctggtgggagcaaaggagaccggcatggcagcggacgcagcctcgtcagcagtgctattcacaggctgtactgccggggcggagggtgccggggatgaaaccgaacccggtacctcattcaatttcagcgcattcggtgcatcaaggctgggcatcttaggagcgaaggacggtgcatccactgccggaagttcctgagaaaccgcagccatgtgggcgagagcggccaaagaggaatcgttctgcaccatatccacgggctgttccgcgaacaccgacggggtcgatgacggagctgcgggttcgtgagctgcctgtgccggagcaaacgaggggacgctgccagcggtcacaccggaaaccggcgcggacggggcactgacgggaggctcagccgcagcaactgcggtaggagccacggaaggcgtctcggagacgggcttcgccgcagactcgttggacgcatgcaccgggtatgctgcgggagcaaaggaaaccggctgttccgcattggtgctattggtgcttgtggaagcatcgaacgatgcaggagccggcgcataggagatcggcgccgccgcggccggcgttgcgggagcaaccggagccggagccgtgaacaagctctgctcggcctgatgcagggcatcgaatgattcgtcatgagcaacggcagccggagcaaaacgttcgtcagttgccgggcgctgcgttccggaagcgaacaacggtgagacgccgttcgcttgaacggtcacgttcgtggcggtctgggcaggaaccgcaggctcgccggacacgaaatcggccacacgggcataggattccaagcgactcagcaactgcacgcaggcgttcaggaagtaatcgacctgtcgctcgtcataacctttcttgcccttgcgctgggtgaagatcacattgttgaccgtattcgcattgagatcggccaaagaccgtacatcgtcttcggtaacgccgtcaacgcccaatgcggccgccgccttgtccacaatctggtcgaccagacgatccacctgcttcttatcgtacgaaggctgcttgggcgctccggacttgaagcgttcgcgctcgttacgctccgcatggttctggacttcgtgatacagcttctcggtcttcgccttccacgtcacacgcccatgctgtgcgatctcccatgtggtctgcttatcgaccacggcacgttccagacgtccaagcgcggcgtcaacctgtgcgatcacatagccgttcttgcgcaaatcaaaggacacgttctgaatgtcatgctgggtgagattcatgccctcgctgtcatacaaagcatgggcgcgctccaggaaagcgtccacctgagcggggtcatacccccacttgcgcttgcccgcacgtgcgatgcccgacttgccgtccccttcacgaagttcctgcgccatcggctattcgacctcctgctggatataaacactctgccacaactttacgtgactattgagacgcatctgaccaagaagaccgaaattcacgattttgtagcagtactgccggtttccttctgcacgcatctcattgagatttcagaacccttgccgaagactgtcagggaatatcgtcacagcctatatccgtggaatgaggggattccatgaagcgatgaaaaatgaaagtgggcaatgagggactcgaacccccgacatccaccgtgtaaaggtggcgctctaaccaactgagctaattgcccgcaaatgacaacaatagcgtatggccagcactgcgcgacacgtggtgtcgcatacgcgtgccgtagcgctcaatcgcaatgacattcagtcacgcccagcagcactacgcagcacacgacgccggtcaacacgcttaaagtcaagcgtattgattgaggcttatcagcggcccttgccgaatgcgcgcaggcggatgccgttccagtccgagctgacggtcagcggggtggcggcgttcataccggcggtctgtgcagcggactgcacggtggacgagctggcggcacccgggcggccgggcttgggagtcagtatccacagcgggccgtcattgcccagtaccgcgtaggcgtcaacgatcgtatcggacaattcgtcctcatcatcgccgtcgcgccaccatacgatgacgccgtccacagcggagtcgtagtcctcgtccacgagatcctcgcccgtgagctcttcaatctgggcacgaatggaatcgtccacgtcgtcgtcccagagccactcctggacgatatcgccgggctcgaaaccaaattcttcagcgttctgtgatgccgtttgattcacaggggacacattagcaagtcttcgcgaacaaatgcgttaacgcggccgaaaatcgccgcattgtgggcagacccatgcgagtcgtctcaccagaaacaacgactggccgcgcgtgtcatgcctcgcaatgaggcaaatcgtcggcctgccccttgccgatggccaccaacgcctgatacgcctcgttcagcgtggcgaccttgacgtcgcgcagaccatccggcacgcggcctgccacatccaaacaattcgacgcgggggccaggaaccatgtggcgccatcgcgcttggcgccaagcatcttcagctctatgccgccgattctgccgactttgccgtccttgtctatggtgccggtgccggcgatggtcttgccgccgctctcgttggcgggggtgagtttgtcgatgagaccgagcgtgtacatcatgcctgcggacggcccgccgatgctgtccacgtgcatcgtcaccttggcgtgttgcaatgcactggcgtcaatgtccagttcgtccgcatgggctttggcatacgccagaccgacggcactggccgaatcctgggaaccggccatgtcttgttcgactttcttctgatactggtccgcactctggcccaccggtaccgtggcctcacgcggcatgacctccacctgcggattgccccaaccccagacggcctgcgcgttgatgatcgggtacccgggcacgccggacgcgttcaccgtggtcagcagcagcttgccggaatccttatacgtcgtcacgccggtaccagtgatgtcgataaccgcaccatcctcaactttgcccagcacatcctgggtgggtccgggcatctcgatgacgtacgggctgggcagcagcagaatcaccacaccaagcaacacggcgaatgcaccgacgaaatggcgtttcgaacgagcggccgcataggcccgagcacggctgattccacgagataggcgcgaatcatgcttcacttcgaacgatggcatgtgctcatctcccgcttccgaatccgcagtcgggctctcctgctcctggacgaggtctggttcctgattcctgtggcgtgcaaacataccctacagtgtaagcggagggccgaaatcggccgaaaacgaacataaaccgaaaataatgctcggccacaagcgaacaggcccgggcagaccctacacttggggtaacacaccgcggcaaagaaggatacgcatggacgacaacgcgattcacgagtggctgatcaaatgcttcggccccattcagggtgagatggcctggcagcagatcagccagttgcctgaggagatccgtgaacagctgatgagtcaggaccccagccgactgcccaatccatctgaagtccagcagatgatggccgcgttcagcgccggcggactcaacacgatgggtgatatgcagcgcactgtcgaggaagggccgatcaacgtcaagctcgccaagtcgattgccttgcagcaggccaacgcctccggttctgcatccagcgtgtccgccgtggatggcgaggcggctcgccgcgcgatgagtgaggcgaacctgtggctggataccgcctgcgagttcaatcccgcacccggcgatccggatgtgctgacccgcgccggctgggtggaaggcaccatcgaccagtgggcgaagttcgcagctcctgtggccgagtcgatgaacgacgctttggcttcggtgatttcggagcgtcttggcggcgcgttcggcgatggcgagattgccggcatgttcgccggaccggtgccgattccgattcccgacggtatgaaagacccagcccaactgatgaagctgctgggcaacacgtcctttgccatgcagttggggcatgcggccggcaatctgagccatgaagtgcatggcagcttcgatcagggcatcgcgttgctgaagaacccggctggtggactgattgcccagaacgccaccgaatacgcgaagatgctgaacggtgaggcttctgcggccgaggccgacacggccggcacttcaaccgactcggtcaatccgttctccacatccaccgacgcttctgccaatcccattggcttcacttcggccggcaacagcgatactccggcaactgacggtaccgcccaagtctccggctctgatgcttccgccgataccgccgacgccgccgcgttcgaggctgcgctctccggattcgagaccaccgagaaaatccccgaatctgaagtgctttccttcctggccctgcaggaaatggctcacgcccgcctgtatgcctcggtaccgtggctgatgccgcgtttcgaggcgctcatcggcaagtacgcacgcggcatctccattgatctggatgcgatggaggaacagctgcgtgacgccacgtcaatggatccggagtcgatttccggcgcggtgaatctcaccaaggtcggcatccccgacactcccgaacagcgcgaggcgctggcttcgctggaatcgctgctggcgatggtcgagggctgggtggattgcgtggtgtggcgcgccggtatggcccatctgcctcatatcgaacagttgcgtgagatgatgcgccgcgagcgcgcgatgggtggccccgccgagcgtacgttcgaaagtctgctcggtttgcagctgcgtcccaagcgcatgcgcgaggccaccgggatatgggagatgatcaccgccgccgaaggccctgaaggccgtgacgccaagtggtcgcatcccgatctgctgccttcgctgcctggcgacaagcccgcagatggcgcgtctccgtcatccgacgccccttcaggttcttcttccgatgccaacggttccgcttctcaccctgccgcagatggcaagaccggcgatatcgattgggatgccgaactgtccaagctgctcggcgaagacggcgaagacggtgaaaacggcaactcggaggatacgcaggcatagtcaaccggccttcagccaattcccgctcctgaacgttcaggagcattcagtatgcgttacagacgcccgtcacaaaaatcgtgatgggcgtctgtgctgcgctccataaccatccttggtccgcgcatacgacaaatgcagcgaatcctcagctcgggtgatgcccacatacataagccggcgttcctcttccagcgtattccccgtttccggcgaaccgtacggcaagagcccttccgaacagccgatcagaaacacgtgcttgaattccagacccttggatgcgtggatcgtggaaatcgtaaccccgggatcgtcgtttgcggcaagtccggtggcgtccaaacccatcgcctccaatagtgcgcgtttggacgcggcatcgtcggcgagcgcggatgattgccatcccgaatccttgcggacgcgatatttcagtctcgcagcgcgcaaggcggcaccgaatacaggctgttgggcgttgatgcgggtgaggatcgcgcaatcggacggcttggccccgttggcaaccaaccgggctatgcgtgccgccacgccctgtgcctcttccatatcgctctcataagcggttcgggtaacgcgcgggccggattcacgggcggaaaccagtttcaggtaatcctcacggttcggcgcggccgcaagcacccggttggcgaggttcacgacttccggcgtcgaacgatagtcggtgttgagattgacatcggcggcaagcggcccgaattcatcggcgaaacgcagcagatcccagctggaggcaccggcaaacgagtagatggtctgggccggatcgcccacgacgcatacgttgcggttcattgcgctcttgccgtcaggtcctcccccgcccagccacagggtcagcagcctgtgttgcaggggcgagacgtcctgatactcgtcgacggtgagccagccgatggtggaacgaatttgggcggcggcttcgggaaaaccatccatgatatggcatacgagcaacagaatatcgtcaaaatcgatttcgccacgcgaggtcttttcctgctcgtaggcgctgtagacgtcggcgaaccgagcggtgtcgagtccggcgggcggctgcctatgggcgatggcacatgcccgggcataatcttccaccgccaccaacgagattttggcccaattgatttcggcgagcacatcgcgaacggtcagcggatcggcatcggtacgtgcggtggcgcggatgatcgcgcgggagacgacgtcacgctgatcttcgatcacatgcggaaatggagcctcgcatatgtctgcccagacgctgttgagctgatgcaatgccgctgagtggaaggtcgcggccgtgactccggcagttcccgcacccgaaccggaacgtccagtacctccccctacgccgagctggcccaatcgtgcgcgcatttccgccgccgcttttaccgaaaaggtgacggcaagcacccgctccggcttccatgccccggtggcgcaggcataggcgattcgccgcgtgaccgtgcgtgttttaccggcacctgcgccggcgataatgcgcaccggcccttgcaacgtagtcgcggcggtacgctgccgctcatcgagcccctcaagaatcccctgcgcctgttccatgcgtccattgtggcacgattcgcgctcacggcacgactcatgcctatggctgaatcgggctcacgacaaaacatcgccagaatcatgcgttttgcgtgtcattctgcggtgcgaatcgccacggatgtattagtgtggaagggtgatgaaacgtagcgattatatgttggcggcactcgcctcagccgtcctgccgaatctgggggtggccggcgtacgcgagaacgtgcaggccagcgcaaccgacgaggccaaaggcatcgatcagaccgtgattcaagatgcctcaggcaagttgtacgacgtatacgccactgacaccaaggaagggcgtacgcgtctgattcgccgtgtgaaagcggcgcagacactggcagccgcgcgcgagcctggtggcctcggcttcgatatggaccgtgtggtcgcgttcgccccgggagacgtttcccgacccggccagacggccaccgcacaggccgtggggcagcagactcaggcggagtccacaccgctgaccccgcgcaagcccggtcccacaggcgagacgaccgtgatgattgccgtccaccgtgatggccaggcgcggcctctcgacctgttgacattggatgactgcgcggccgtcggcaccgccatcggagccattcatcgcctgccttcgacttttctggccaatgccaaatatccggtagttaccaccggtcagattcgttcgcagctgaccgcctggattcgccgcttacgctccgccggccatgttccccaagaaatcaccgacagctgggcgcgcatcatggacaccgagggattgtggtcgttctccacctgcacggttcacggcggattttccgacggcgacttcctgttctccggttccaccatcaccacggtgaccaactggcaggatatgcaggtcaacgatccggcacgagaccttgcctggattttcggcaagctcgacgaatcccatcgcaacgccgtgctttccgcatacggccgcatgatgggctctcgacttgacgatctcatcatgctcagggccaacctgtggctgcagatggaacaggtgggcgaattcattcaggcgttgaaccgtgcggacaacgatcacatcatgcagttcaaggcacaggtcgaacgactcgcacaccagttgggcgtgatcaagcacactccggcaccggccccagccgcagggtcgaccgccgcctcgtcaacgaagcccggtttgccttccacaatcaccgtcggcacattgttgcaggacgaccgtcatcaggcacccgcacaaccgcagcagtccgacaccggtaccgcggcggccgaggtctcggacgacacgcccgatcccgatcgcaccggttccgctgatatcgtggccgctggcgacgtggatcttaccccggaagtcgaacccgatgctgaccggaccgccaatcacccgcaagcgaatgtctccggcatcgcaaccggtacgggatcgaccaaaccgcagccctcacatggcgcttcccattcttcggtgacgatcacgctgaaggagctcctcagtatgaacgggcatagcggcacgacgtcaaccgacgcttcccctgcgtctcaatccgccgccccgaccgacgatgcggtgaatgacgatactccggacagtctcgttcagtacggagcctcgagtgcccaaaccacggtgattccgctgttggagcgggaagaacgcgctctgcgcgatgcccgtgccgggttggacgggtatgacagcgagggcaatccgctggccgaatcgtccacatcatccaaataatgtcgtgtacggtgttccgcgccacgccgagcgcgtaacaccgcacatgacgacgcagacacgcggcacaatagagtacagaacctcggccggcgacggccacttaccatgatgttcgtcacaaagacggcagaacaaggagccttatatggatatcgaactgggcattcagaacgtggcacgaccggtgaacttcagcaccgacgaatcagccgacaatgtgagccaggccatcgcgcaggccgtggccgacaacacgacgatcgatctgaccgatgacaagggccgtcgcatcatcgtgcccgccaaggcactcggttacgcgatcatcggctccgaaaccaagcacgccgtcggcttcggcacgctgtgaccatgaatcgcgcataagcggccttgggcattatctcaaggccgcttttgtattgctgaatcaccgatatagcggaagcacgccgcgatgaacgatctcttcgacagtggcctcgtcggtgaggttctcccccagtttgttcggtttgcctttgccatgccagtcagacccaccggtgaccagcagctggtgccggcggcagatggtgagcagccgttctcgttgctccggtgaattgccacggtgccatacctccagcccgtccagtccttcgctgatcaatgcctcgatctggtcatcggacaacagtctgcggttacggctcacatcaccggcatgggcgatcagaatcacaccgcccgctcccttgacggcggccaccacttcatgagaggtcggcgaaggcgtgggaatatagtatttggatgaggcgctgaccgcatccgcaaacgcttccgaacgagtccgatatacgccggcactcaccaaagcatcagcgatgtgaggccggccaatggtggttttgccaccctccttgacttgggcgagcacggattgccaggtaatcggataatcacgagacaacaattcgaccatgcgctgcgtgcgttgcaaccgtgcggctcgagtattggcgaacaagtccgtgatgcgctgattcgtgggatcatactggtagccgagcatgtgcacggagacgttctcatccgtggcggtgatctcggtgccgcggagcaacggcaaaccgaccctatgagccgcggcttcggcctccggccagccggcggtggtgtcatgatcggaaatggccacgcccttgagtcccaatgccttggattgttcggccaacgtggccggcgtttccgtgccatccgagaaggcggtatggcagtggatgtcccacccgacggcgggcggttccaaaggcatcacatatccagtcataccttccatcgtaacctcatttcagcattcccacgcaaggcgcagacaggtcgtcaccttctgccaacggccgaaaccagacattcggcacccagctgacaaccgcagaggctaatctggagcgcagcgctatcgaaagggacatgatgactcgtaacaccgcaaccgacacatcatccagcaccacgaacaccacgccgcttggcttggcggaggcacgaccgttgattggatggcgccacagtgccacttggacatatctcatcatgctgattgcctcggcagtggcgttgggggcctcgctcattctgtccgctgagactttgcaattggctcggcatccggagtccgcgctcggctgcgatctgaactcggcggtgtcctgttcggcggtggcccagtcctggcaggcggaaatcgtgaaattcggcgggctgagctatccgaacgcgttcttcggcatcgccgccgaatcggtgttcattaccatcgcggtgatcggtttggcgcgtgtgaaggtgccgcgttggttcgcgacctgcacgtggctgggcggactggccgctttggcttactcgtactggctgagcacgcagtcgctgttcgtgattcacgcgctgtgcccgtggtgcctgaccctgatgttctccaccaccatccagttcatggcgttgagccatgcgaccgtggccgtgcagggattgccgtcgcgtaaggctgtggcggctgatgatagcgacggtgaggctgaggtcgcggcggtgccggccggactcaataagtattaccgcctcaacatcgacctcatggtcgacatactgtggatcgtggcgatcgtggtactcatcatcgtcaccgaaggcgcggccctgttcgctgcctgattcctttacaacaaatcgatatcggcgaccagcgtggctgctccggtcagctttacgtcgctgtcggtgacgtccacgcgcagggtgccgccacgtacggtgatgtcccagtggctgatgccggtcttggcctgcagcacaatgcctgtggcgcacaggccggtgccgcaggacagggtttcgccgcagccacgttcgttgacgcgcatcgtggcttcacccacgccggtgctctgatcgatgtcgtcgacccgcacgaattccacgttctggtcggattcgatgaccggagccaccactggtttggtgaccaaatccagtgattcaaccactggcagggacgcgaaggcatcctcgatcaccgcgaccacatgcgggttgcccatatccacaaacgtaccgcgcgccgagccctcagtgccggggatggtgacctcgtaggcgtcggtttcgccgatcttccactcccccatttcgacctggaacacgttggctccgtacggcctcatattgccgcgtggcgtcagaatcttgacgccggcacgggtgccgaggcggaacggctcggtggagtcggccaccccctcacgctgagcgaacaaggtgatggcgcgtgtaccgttgccgcacatctccgccaacgatccatccgcattgcgatagtccatgaaccatttcgcgcccccggccagtacgtccgaaagctgatcatcgcttaaatcagacacgaaatcaggccgtgtcaggcgaatcaggccgtcaccgccaatgccgaagtgacggtcgcacaggaatcggacctcatcggcggtaggctcgaatttgccggacttgtcgaggtataccacgaaatcattgccggttgcgtgtgtcttggttactcgttgcggaagactcatggctttcagagtactctagggagcgaaacaacaccacaaaacaatcggctttgtgatcggtcgcggcaacatacggttgcaggcatggctatagggaggattcaggcatgagctcttcggctccaatcggcgtattcgattcgggtcttggcggtatttccgtggctcgccaaatcgccaaggatatgccggccgagcatgtgctgtattttggtgattcggccaacgcaccgtacggcatcaagacgcctgaacaagtgagggccctgagtttcgatattgtcgaacggttcgtgcgtcaaggcgtcaaggccgtggtcatcgcatgcaacaccgccacttccgccgcggtgaacgatttgcgcgaacactacgatattccgatcatcggcatggagccggccctgaaagtggcgtgcgaccgtggtgacgtgccttccgacccgcatcatattccccagagggtgattgtggcggccactcccctgaccttgcgtgagcggaagttcgccaaactgatggatcgattcgattccaacaacacgattttcaaggagccttgccccgacttggtggagatcgtggaatccgggcggctcggcgaccatgacctggtgatgcgcacgctgcacggctacttcgaccagtacgacatggagcatatcgactcggtggtgctgggctgcacgcatttcgtgttctaccgcgactacttccgcgagctgctgcccgaacgggctgctgtcatcgacggcaatgagggtaccgtgcgccatctgggcgtggtgttggagtccctgggcaaactggcacccgaagacgcgaccggcggcgtggagctcgccaattccgatccgtccgaacggattgccgagttgtcacgcaaattgctgaacgtatgagccgttcttggctcccctctctgagggaagccaaggaagaaccagacaaattcacagcacactgcccatatcgttgtccgtgcagcacgcgtaagctcataccagattcaagtgaacagggggttggtatgacaaagacggcgatgattgatgtcggcggcgggttccgcgcgattttcggctgtggtgttatggaccgcatgctggaggacggcatcgacgtggatatgtgctacggcgtttccgccggcgcggccaatatgacctcattcatcgcacgccagcacggccgcaaccacaccttctacaccaagtacgccttccgcaaggagtacgcgagtgcggaaagcttcttcaagaaccacaactttgccaacctcgactacatctacggcacgctgagcaatcacgatggcgagaatccgttggatttcgcggcgttcgaggccaatgagaccgggttcaccgtggtggcctgcaatgccgaggacggctcgaccaagtacttcgacaaatcgcgcgtgcgttttgatgatttcgacatcatcaaggcttcgtccgccgtgccggtggcctgcgagccgtatgtggtggatggtgtgccgtatttcgatggcggcatcgccgatccggtgccggtgcagaaggcgctggaggacggctacgatcgcgtgattctgattctgtctcgcttgcgtgacgaagtgcgcaagcagcagaaggatttggctccggcccgcatcctcgaacgctcccaccccgccgcggccgagaagctgcgcatgcgctacaagacctacaacgacgaactcgaactcgccaagcattacgaggcggaaggcaaagtgctgattctcgcacccgaagacctgtatggtctcaacaccctgaagaagaacttcgagggcctggaaatgatgtatcgcaagggatacgcggcggccgaggccattccggcattccttcaggcatagcgatagtgaagtccctcgcttggaggggcttcactatcgatggatggggattcgcaaacggggtgattacttcgtctcggaagcggtgagcatggccttggtgacctgctcgtagagatcctgataaccgccgggcgtggaggcgggcagcaccacggtcttggtgttgttcgattcggacagcgagcgcatcacgtcgaggtactggttgaacagcaccacgttgttcacgtcgttgatgttcatgcccacagcctgcagactcttgatctggtcgacgataccgttggcgatctcgcggcggtaattggcctggccctcaccctgcaagcgagtcttctccgcatcggcggcggcttgggtctcgatctggatacgctgggcctcggcacgctgacgggtggcttccttttcacgctgggcggcattgatggagtccatcgcgttcttgacctgtgggctcgggtcgatggcggtgatcagcgtcttgaccacggtgaagccgaaacggctcatttcggcgcccacggtcttctgcacgtcgaacgccacatcgtccttgcgggcaaaggcatcgtccaaagacagtgcggggatagcggaacgcagcgcgtcctccatgtaggagcgcagctgaccggccgggtcacgcagctcgtagtaggcggtggccacatcgttcgggttcacgcggaactgggtggaggccaccacggtgacgaacacgttgtcgagcgtcttggtttccagctgcacgttaagctggttgacgcgcatgttcgttttcatggcgatgcggtccacaaacggaatgcggatatggatgccggcgaactgcaccttaaggaacttgccgaatcgctcaatgatgtaggcctgctgctgcggcacgacgaagagtgcggcagacagcagaacaatgagtagcacgatgataatcagcggaccagcaaagaatacggccatgatgttttcccttcacccacgtcgaaaccgccctcggcctcgactcgtgatttccatcgtatcagcgttcaaaacaaagcggtagacatcgtacgcatatgtgtacaactgttcactatgtgtgcatgctggcttcttataaaaaagtgcggcatccaatcagtatgctgcggccatgcctgagccgacagccacggcgccgataccgtcctccagcgcggcaagccgcttttccagtgcatcgacagtgggattggccacacgggagtactcgaagccgtcgatgtcaccgcccgcgagcgcatcgccgcgcgccgcgtcacccaggtcgaatgcggccgaggcatagattggcggcacagcggcacggccgttatccagcggctcgtagccggcgtggatggcttgcgttcggaaatcaacgcccattaatccttcttcctcatgccgctctattgtggcgggctcgactctattcccgaacttagcaagtcatggtacgcgacaccggcacatcggtatcgcaattgtcaatgcgcgcttataagcaatggctatagaatatccgccgaatgccggaacacaccaagctgcctagccctctttcagcacctcggccgcaatattacgctgcctcaaataattcaaagccgcgtcaatccgtaccggttcatcatcgaaaatggccacgatgccctctaccggagtatccgcgacgatgtcgatatctccaaagattatgttgacatcgatgccgacccctttagtaatttgcgacaccaacgcttcagaaacttccttggacacatattgcatccggaccaatcgttggccttcagacaatctcatcaaaagggagtcatggttctcttttcatatctggcgataacgcatatcaaatcagcaatcagcgcaaagacgctcggtcgctccatccggataacaactttgccgtttcgcctaaggtgtcgatgacatggtcaaccggtgcgtcagaaagagcttcagcatagttctcgatgcgatagtcgaaataacgatcggcgcccagcgcgctgctctccgaaagcaccgggacgaacgccgtcagcattcgtaacgccttgggagcgctcaaacgcgcggggctcatcaccgtggcacgcggaaccggcggcgccgaacttgcccacaccccccaaggaaatcactctgctcgatatccatcaggcagtggaatccacgaacctcgatgatgtgatcggcatccacgagagagggaatcacacatgccccgtggctcggaatatccacgacgttctcaaagatgcgtatgctccagtggccaaagccatgtcggattccatgagggaagttacgcttgccaatatgcttgccgactaccgaaatcgcattggggtcaaagcccggcaattggaacagtagtgggcaccgaagcgtaagccccccctactctctgatccacataaacagataaggcgtgcgccatcaagaccgatcgatgacgcacgccttatgcagctcagaccacggattcctagtcagccagcagccccagctcctgcagcttgttcttgatatccactgcagagggttccacttggaacgagccgtcatcgtaccgcaccaccggaatgtgcatctggccgctgatcgccacggcacggtcggcggcaccttcctcttcctcgatgttgtgccaagtgtatgccgcgcccagtttgtcgagagtgttctttgcctggcggcagtcgccacaccatgtggcaccgtagacgtcgatggtcatatcgggtcctttctttgttccgccgcgcttgacttttacgcggtgcactatcaaaccgtattcatcgtaacggggatgctgtgatatcgcggttggcataatgcgggcggtccgcttaaccaccccagtcggctacgccgacagccctctgccagcggaggcggaaccagagcataaaaaagcggctccggtgtggcacaaccgacgccgctccccaggagtagaaaaataggcagaaaagaattagatcaggcaaacaccccccgaagtcagctgttggaacacgtcgaagtcggcatgccgatcgatgtaacgggcgtaagcgatatcgaacgcctggccgagatcttcgatcagatcgttggcgtcctcgatgccaacggcgagacgcaccaattcatcggtgatgccgatcttcagacgctcctcgcgaggcagttcgaaatgcgtcatacgacacggcagctcggcaagagactccaccgcacccaacgacacagcaagacggaacaggtgcaggttgttgagcacgtcagccggatcaacgccaggcacgacctcgaagctcaacacgccaccggcccccttgagacctttggcagccagacgctggtcgcctgcgccgggcagacccgggtaatgcaccgccttaaccagcggatgcaccagcaggtagcgggcgatggcattggcattctcctgctgacgatccatgcgaagggccagcgtctgaatgccgcggcgcaccgcgtcgcactcagcaggagccaacacaccacccaaacggttctgcgcgaagtacacgcggctcgccagatcctcaccggaaacgaccaccagaccggcgttcacatcagaatgaccggccagatacttggtggcggagtgaatcaccacatcggcacccaaagcaagcggcttctgcagatacggggtcacgaacgtgttatccacaatcgaaagcgccccgaaacggtgggccaccgtggagatggcgcgcacgtcgttcaccttgagtagaggattggtcagggtttcaaagtagacggcttgggcaggcacgatgccgttcgcgcggtcgcccttgacggcggcctccaatgctgcgatgtcctgagtgtcgacggcctcgacgaggattccccagcgagtgaagaactcattgagctgggaatacgatccgccataaatattgtcaccgaccacgatgcggtcgccgggcttgaaaatgctcagcaccgcgtgaatcgccgcgagaccggaggcgaacgcaaaaccacgcgttccctgctcgagctgggcgatctgctgttccaggaagtcacgtgtgggattgccgctgcgcgcatagtcgtaacggggcatcgcgtcgaccttctcgaaggcatatgtcgttgagttgtagatcggcgggttcacggctccggtgttgttgtctccaaccggcagtccgtggacgagctgagtgttgaacctggtcattgcgcacccccttaaagtgttgcgtcatctgcgcgaagccgttccccgcgcggcacgattacgaccttaacgcaaaacgccggcccgaaggccggcgttgctatatgtgttggttatggacgggtataatcagacctctccgtcctgcaagaatggacggcctgacgaccggcccaacacacctcgccgctgccgcggctcggcgtcgcctacggacagtccaccggactgtccgtcagacggctccgccttctaccacgatgtcatcggggttgacttcgttgccgtagaccggctccagagtctcctggtaatccttgtggaagaagttgtctttgccgagcttgacgatctcgtcgttcacgaagttcagcagttcggtgttgcccttctgcacggcgggcgcgatggtgtcgtcgtcaccaaggtgggtgatgccaaccttgaagcccttgttggacttggcccaggcgagcacctcggtgttgtcggtggagaaggcgtcaccacggccgtccagcagcgcgttgtaggcatcggcgtactggtcgtacttctgcagcttgacgttcggcgcgttcttctcgaaccaggtttcggcggtggtgcccttagcgatgatcagggtcttgccgtcgagctgactgacatcggtgatctgggcgctctccggggagaccacaccaagcgccaccttcatgtacggcttggcgaagtcgaccttctccttgcgctcatcggtgacggtgaaattggcgagcaccagatcgaccttgttggaggtgagcacgtccacacgggcagccgggtcaaccgacgtgtattccggctccacacccagatccttggccagctgttcggcgaagtagacgtcatagccctggtacttgccgtccttgtccacgtagccgaatggcgccttgtcggagaagacggcaatcttgatcttgccgctcttcttgatctcgtcgaggctgcgggccttggcattggcgctggagctggtgcccgtgtcagaggacttcgcttcgctcggggtgcctgccgacggaccgcatgcggccatggacgccgccattaccaatgccgcgcctgcggcaatcagtgctttgaatgatttcccaaccttgatactcattgggttctccttctcttgttgttattgatatttcttctcaaatacgtcgatatggcacaatcgaatcactcgaattcgaaggtgtgcaggaactgctgcgcacgttcggtttgcgggtgttcgaagaacgcctgcgcatcatacgattcctcgacgatgcgcccgccgtccagcaagatgatgtggtcggcgatggctcgcgcgaactgcatttcgtgggtgacgataagcatcgtctgcccggacttggccagttcgagcaccacgtcgagcacttcacgcaccatttcggggtcgagagccgccgtaatctcatcgagcagcagtacttccgggtgcagaatcagcgcacggcaaatggccacacgctggcgctgaccgccggacaattcgtgcggccaagagtccttgcgatcggcaagtcccacgcggccaagcaaccggatcgcttcagcctccacctcggacttatcgcgtttctgcacgagcaccggcgccatggtgatgttgccgagcaccgttttgttcgggaacaaatcgtagctttggaacaccatgccgatacgcgtgcgcagttcactggaccggtcggatcgtccggctcgttccgtgccaggcttgccggcatcgatcacctgattgttgatggaaatcgtgccgccctgaatcggttccagaccggcgatggtgcgcagcagcgtcgacttgcccgagccggaaggacccagcaccacgagcaccgaaccatgctccaccttgaaggagatgtcatccagcaccggcttgtcggcattcgcatactgtttgaccagatgattcacctcgaaacccttgcaggtcgtttcgggttcagtcattcgaccacctcttttccagtcggcgggccacaatggacagcggccagcacacgatgaagtacataaagaaaatcacgccataaatccacaaggttccggtcgggaactggaatcggttcgcgtcgataatctgctggccgaccttgatgacctcgaccacaccgagcagcacggccaatgatgtcgttttgacgatacgtgtcgccaagtttacggatgccggcagcatacggcgaacagcctgcggcagaatcacccgggagaaggtctgccacgggctcaaccccagtacgtagctcgattcgtactgcactttgggaatcgactgcaatgcgccacgcaccagatcgcccagctcggcgcctccccacaggatgaacaccagcacgcaggcaccggtggcatcgagattccaatcgaaccatcgagcaaaaccgtagtaggcaaggaacagcaacgccagctgaggcataatgcggatgaagtcgaggtagatgcgcatcgcggcccggatcacgggattcttcagcgtcatcaaccagcccatcaacaggccgaccgggatggacgcgcctacggatacgccggctatccacacggtgacccacaggccttgcaacagacgtgggaatacgcctggctggagcagtatttcagcgccgctcataatcgaacctccgctccaaccatgtgccgaagatggaaatcggcagcagaatcaccagataggccacgaccagcatgaacaacgactcataggtgctgtaatacatgccgatcagatccttggccatgtacatcacgtcggcgagcgcaatggcggagacgacgctcgattccttaaacaggaagatcacattggccactacgccgggaatggcggtggacactgcttgcggcagaatgactcgggtgatggtttgcgtggaagtcagtcccagcacgtacgcggtttcgcgctgcacgttgggcaccgcttccaatccgccgcgcattgcctcggccatgtaggaaccgcccaagaatccaaggccgactatcgcgcaggtttcggcggaccatactacgccgagtttgggcaggccgaagtacagaaagtacagctgtaccagcaatggcgtattgcggctaagttcgatgtagattctcacgatttgccgggcgaccgggatacgcgcgatttccacgccagcgcagaccagacccaccgcgatggcaagcaatatgccaaacacggatatgaataaggtcatcaatgtgccgttgacgaagaaaggcgcgtaacgctgcacgaacgaccaatcgaatgtcattgggcgcgctccttcctttgcttctcgtttcttctcctgcgcataaacggccttagccacccatgtacgatttcgggggccgaacatacctgtccccctgccgtgtcatcgtagagtatcagaacacgtggcacggccgctgcgctatacgcattacttatgggacgttactcgatgggcgaacatcagggcattattgtcgcccaaacggtggatacactgaggctatgaagatcaccaaagctctgacccgtttgaccggtcctgaaaccaccccggtgttcgtgctgttgcacggctggggttccaatgaatacgatttgcccgatctgctgaactattgcggtgccggttcggctgattatgccagtttgcaggcacccatcgcctatggcatgggatatacatggttcggtgcgtgggcgcatgaaggtgtgccggagggcgaatcattggacaagcaggcggctgaggccgcccaagccattgatgcatgggttgcggagcatattcccgccactcggccggtggttgccatgggattctcgcagggcggcctcttggccgcgcatcttttgcgatgcaatccgcaacggtatgcggcagcggtctcctgctccggctggttggctccggggccggtctctggagacgccgagctggctgcgttgaagccgccggtgttctacgggcatggtgctgcagacgacatcttcccgaaagccgatgtgacggcgatgggtgagttctggcacgagcacggcacgttgaccgaacaagtgtatccgggcatggcccattccattaatatgccggaaatgcgcgatattcaacggttcttggagaccaacggattcattcggccgcagatttggtagtcaccacctcacatggcgtagtcgacgtgggcgaattcggggactttataccatttgacggggtagccggcaccgtgggcgcagaagaccgagtcgggggtgttgtccagatctgcttcgggatcgtaagcggcggctgcgatgacctgttcggcgtcatggcatggcttgtagccgctgaaagtggcggagaaacggccatggccgtgcgtgtactggttcacatccatcgcatagtcgcgcatctcggacaccggcgcctcgccttcgatcacggcgtattcgccatcggtgaccggggattcgaaggtgccggccatgcgctggatgtcgctcatggcacggccgatcatgtctgctggcacttcgagccggaaccgataccacggttccagcagtcggcagttgccctcccctgcggtgtccggacggctctcgaccggcgtctcgggccggccactgactccagctctggcttccataagcccctgacgaatcgcacgataggtggcttggcggaagtcgccgccttcggtatgcttcagatgcgcgcggccagccaccaaagtcatcttgatatcggtgagcggcgcgccaacgagcacaccgagatgctcacgctcggtcagatgggtcagaatcagccgttgccaattgcggtccaaatcgttttcggacagggccgaggccacagtgactccgctgcccggctcccctggttccagcaggatatgtgcttcggcataatgacggagcggctcgaaatgacctgcgccttcgatcggcgcagtgatggtctcacggtacaggatggagccggggccaaacgacacatccagaccgaaccggtcgtgcagggtctgctggatgatctccagctggaccgcgcccatcaattgcacatgaatctcggccaaccgctccacccagaccacatgcaacaacgggtcttcgtcttccagctcacgcaatgcggtgatgaccttatgcaaggtcagatcatcgaactggggacgggccggcgagctattgtccgccgcggtctggccggcggtgtcgttctcctcattgcggccggttcccgacttggcggcatcatgctcggcatcgtcctgattcacgttgttatggccggcgtcaccgcgtttggccgctcccgaggtgccggccgtatcggattccgctccggcgggcaacaccgtgtaggtcaacacgggttgcagcgacggtgattcggcgtccggttccgctcccagcccttcgccggggaaggtccgcgtcagtccggtcaccgcacacaccgatccggcaggcacctcggtgaccgtctcgaatttggcgccattgtagacgcgcacctgatcgactttctcggaccataccgtgccatcatccccctgtaccggcgacggtgctgatgacgccgcagcgcacgaggatgaagagacgatctccttggctttgagcgcaccaccggtgacgcgcagccacgtcatacggttgtgctggccgtcgtgggcgattttgaacacgcgtgcggcgaaggcggccggccattcacgttcgcgggtgaacgtctccagcccgtccaggaattcctcgaccccttcgagtttcaatgccgagccgaaatatacggggaacagttcgcgtacggcgatcatcgctcgcaatctgcccacggacagcgcgccatgttccagatagtcgttcatcgcctcctcgtccagggtggcaatgtcttcggcgaacgcgtccaacggtaccgcgctgccctcagtggactgctccattgccggcagcggatatatcgcatcgctcaggcgtttgcgcaactgtgccagaatggcctcgcggtcgaatccggcggcgtcgcacttgttgacgaagatgaacgtcggcacaccgtatctggccagcagacgccatagtgtctcggtatggccttgcacgccatccgtgccggagaccacaagaatcgcgtaatcaagcacacgcagcacacgttcggtttcggctgcgaagtccacgtgccccggcgtatccagcaaggtcaggcgcaggtcgccgtgttccaccaatgcctggtgcgcgaaaatcgtgatgcctcgcgccttctccaaggaattggtgtccagaaacgcatcgccgtgatccactcgccccaatttgcggatctcaccggtacggtagagcagagcctcggacagcgtggtcttgcccgcgtccacatgcgcaacgatgcctgccactatctgtttcatcagctgtgctcccttcccgatgcgccgcgcaattgccggccgcctaaccaatatatccgagaaaatccgggagggaaaaattgtaccgacagaccgggctgccggtacaataagtcaccgaacaccgactgatatgaggagcctccgtgaccacttccggcattaccgttttcggccaaccatcccagcccaatcatggtgccggcgggcgaatcgccatggacgatgccgtcttccccaccgattatgtggcgctggatttggagaccaccggcttttacccgaacagttgcgccatcacggaaatcggtgccgtgcgcgtgcgggaggggcatatcgtcgatcaattccagcagctggtgaatcccttgcggccgattccgcgtcagatcaccacgctgaccggcatcaccgatgcgatggtggccgatctcgatccgattgacgaggtgcttccccgattcatcgcatggctcgctaccccggctgccggtcccgccgttgagccgattgtcggccataacgtcagcttcgatctgcgattcctggattacaacacccggcatatcgccggctgcggctttgcctgcgcggattatgacacgatgcagatcagccgcgccctgttccccgcgcagcggcatcaccgtctggccgacctgatcgtacgcttcggcatcgcggacaatgaggagcaccgcgcattaagcgatgccatccaaacccagcagtgcttcgaatggatgcggcattacgtcaccgagcatcacgaaaccgaagcaatccgctggaagcaggcgccggccaaaaacagcgccgaaatcctccaccagcagttggtggtaaagaggtagtttacagcccgtattccttggcgatgacggaccagaggtcggcagcggcctgatcgacggtttcgttgacgatggtgacgtcgaattcgctttcggcggcgagctccaccttggcggtctccaagcgacgggcctgctgttcggcggtttcggtgccgcggccgatcaggcggcgctcgagctcttcgaagcttggcggcgcgatgaacacgtacaccacttcgaggtcgagctcggcggcgcgctgcttgacgcggcgggcaccctgcaggtcgatttccagaatcgtgggcacaccggcggccagatgttcctccacaggcttcaacaaggtgccataatgggccatgccgtgcaccactgcagtttccaggaactcaccggccgcctcacgggccaggaactcgtcttcagtgaggaaccaatagttgacgccatcaacctcgcccgggcgcggagcgcgtgtggtggcggagacggacacccacacttcggggtggtcggcgcgcagcttggcttccacggtgcccttacctactgcggtggggccagtcaggacgattagacggccagcatgggtgttttcagtcatgggttcctccggagatgatgtggtgtgcagcgattatgaatccaacgtggtaacggctcaccggcgagatgaccggtaactgctacagccccgacgaacagggaagaatatgaatcgtgatgcgacgtacgcgatgagatagacacgtacgcatgccgcgacatctgattccgttctgattactggttttccgagccttcgacagtggcttccatcagcgcctgacgtacgtcaagcgcaatcgactcggtggcttggctcagtgcggcgatatccggcccatgcgaggcgataaagcgggacacggtgaccagcacgttgccgcgcgtaccgcggaacacggttttcagatccttggcctcggcaccctgccaaccgtaaccgggggaaagaatcggaccggtgaacttggaggggtccacgccggaatcctgcatccattggccgatggtggcaccgatgatcagacccaccgagcccatgccttcgatatccacgttatgcttctgcgcggtggaggcgatgccgtaggccacggtacgtcccttgtaatcgccgctctggcgcaacgcggtctgcagactcatgccttccgggttggaggtcagggaggcgatgaacacgccgcgtccgttttccagcgcttcggtaatcaggccgttcaacgaacgcgcgccatagtacggcagcagcgtgatggcgtcggccagcaacggtgcaccgggcttgaaataggcgtctgcgatggcggaaatcgtggtggacaggccgccgcgcaggcaatcgacgatggtgatgacgcccatttgtcgtgccgcgtagagcacgcgctcgagcgcttcgaaacctttggctccgtagcgctcgaacatcggcgtctggaatttgactgctgcggcgcgcccgttggcggcctgcagcatacgcatggagaagagttcggcgccttcggcgtcgacgttgtatccccagtcggtgaggagcttgcgatgcgggtcaatgcccacacacagcggcccgtatttggccattgaattgcttaatcgcagaccgaaatccgaacgttgtgcctgcaattcctcactgctgagtgtagtcatcagaactcccgtcgctccaattcgaacagctgcttcgaatgctcctgaatgctcatgatctgataatcattatgcttcacggcctcgatagcgagcagtgcggcctggaactcggtgatggtggtgaactgcggcagatcggcggcaatggcggcggcacggatggagtagccgtcggaacgggagccgcgcgagttcggcgtgttgaggatcatgtcgatcttgccttcctcgataagctgaaccacgttcttgcccacggatccggcagcgtgatgcacctcgaccggggcttccggatcggtatccacgcgggtgctgatcttgtccacgatgttcgactcgatgccgtaacggcgaagcacggaggcggtgccctcggtggcccagagcttgaatccaagctcctcgagacgaacggcgatcaacggcagctgacgcttgtcggtgtcgttcacggagatgaacacgttgccgtgggtcggcaggccaccgtcgtaggcggcgagctggctcttggcgaaggcgtgcgggaagtcacggtcgaagcccatgacctcaccggtggaacgcatctcaggtccgagcaggatgtcgacggtcttgcccaccggggtgcggaagcgcttgaacggcagcacggattccttaaccgcgacctgctggccggggtggatgtcgccgccgtcgcccttgggcagcagcagaccgttggcacgctgatcggcgatggtttcgccggccatgatgcgggcagcagccttggccagtgccacgccggtggccttggaggcgaatggcacggtacgggaggcgcgcgggttggcttcgatcacgtacagcgtgttggccatgaaggcgtactgcacgttgatcaggccctgcacatggcagcccttggcgatggcgtaggtgccttcacgcaggcgacgaatctggtcgtcggacagggtggacggaggcagggtgcaggcggcgtcaccggaatggacaccggcctcctcgacgtgctccataatgccgccgatgtatagttcctcgccgtcgaacagtgcgtcgacatcgatttcgatggcgtcttgcaggaacttgtcgatgagcagcggggagggcaggcggccggagaccacggtatcggccttggcctcggcaagtgcgcggtccacgtacttgttgagctgcttgtcgtcgtagacgatttccatgccacggccgccgagcacgtagctcgggcgcacgagcaccgggtaaccgatgcggtgggcggcttccttggcctcttcgaggctcagggcggtgccgtaacgcggggcgttcatctccgccttcttgagcacttcgccgaacagctcacggttctcggccaagtcgatggattccggggtggtgccgagaatcggcacgccggcggccttcagacgcgcggccaaggacagcggggtctggccgccgagctggacgatgacgcccttgaccgggcccatcttcttctcggcctcgtagatctcgagcacgtcctcgaaggtgagcggctcgaagtagaggcggtcggacatgtcgtaatcggtggacacggtctccgggttgcagttgaccatgatggtgtcatagtccttgccaagctcctgcacggcgtgcacgcacgtgtagtcgaactcgatgccctgaccgatgcggttcgggccggagccgaggatgatcacagcctcgcgttcgcgcgggcgcagctcggtttcgtcggcgtagcagctgtagtagtacggcgtggcggcgtcgaactcggcggcgcaggtgtcgacggtcttgtagaccgggcgcagaccgtaggtccagcgcagttcgcggatggtgttctcgccttcatcgcccaaaccacgcaggtgggccacctgcacgtcggacagaccggcgagcttggccttcttgagcagcttcggggtgagggtttcagcctcgcgcaccgtcatggcggtctcattgatgaggaagatctgcttcaggaaccacgggtcgatcttggtggccgcgaacacctgctccagcgtggcgccgccccagatggcgcgcatgagctgcaggtaacggtgttcggtcggggtgtggatggtctcaagcagttcggccacttcttcggcggacggcttctcgccatcccaattgaagcccatgtggcgcttgtcgatggagcgcatggccttgccgagggactcctggaagttgccggccagggccatggcctcgcccacggacttcatggaggtggtcagggtggggtcggcgcccgggaacttctcgaaagcgaagcgcggcaccttggtgaccacgtagtcgatggtcggctcgaaggaggccggcgtggactgggtgatgtcgttgcgaatctcgtcgagcgtgtagccgagagccagcttggtggcgatcttggcgatcgggaagccggtggccttggaggccagtgcggaggaacgggagacgcgcgggttcatctcgatgacgatgatgcggccggtgtccggatgaacggcgaactggatgttgcagccgccggtgtccacgcccacgccacggatgatggcgatgccgatgtcacgcagcttctggtattcgcggtcggtcagggtgaagcagggggccacggtgatggagtcaccggtgtgcacgccgaccgggtcgacgttctcgatcgggcagacgaccacgacgttgtcgttgcggtcgcgcatgagctcgagctcgaattccttccagccctcgatgccctcttcgatcaggacttcgtcggtgggcgagtaatggatgccggcgccggcgatgcggtgcagctcctcctcgttgtgggcgatgccggagcccaggccacccatggtgaagctcgggcgcacgaccagcgggtagccgaacttctcggcgatcttgtcgacttcctcgatgctgtgggcgatgtcggagcgggcggattcggcgccggcctcgtcaacgaccttcttgaacagttcacggtcctcgccacggtcgatggcttccagggaagcaccgatcagttcgacgttgtacttcttcaggacgccggcctcgcccagcgccatggcggcgttgagcgcggtctggccgcccaaggtgggcaggagcgcgtcggggcgttccttggcgatgatctgctcgaggatcggggtggcgatcggctcgatgtaggtggcgtcagccatctccgggtcggtcatgatggtggccgggttggagttgacgaggatgacgcggatgccttcctcacgaaggacgcggcatgcctgggtgcccgagtaatcgaactccgcagcctgaccgatcacgatcgggccggagccgatgaccatcacggatttgatgtcggtgcgcttcggcatatcacttaccttccttggagttgttcttcataagttcgcagaaacggtcgaacaggtaggccgcatcgtgcgggcctgctgcggcctccgggtggtactgcacggagaatgcggggatgtccacgcactgcaggccttcgaccacgtcgtcgttcagatcgatgtgggagacgaacaccttgccgtacttgccgttttcaaacggcgcgtcgacctgcttgccgatcggggcgtcgaccgcgaagccgtggttgtgggcggtgacctcgaccttgccggtggtcagatccttgaccggctggttgatgccgcggtggccgaacttgagcttgtaggtgccgaagccgagtgcgcggccgagcagctggttgccaaagcagatgccgaagaacgggtagccggcgtcaagtacctggcgcagcagctcgatttcgggaccggcctgttccggatcgcccggaccgttggagaagaagacgccgtccgggttcaggttctcgatttcggcgaaggtgatggtggagggcaccacgtgcacgcggcagccgcgttcggccatgcggtgcggggtcatgcccttgataccgaggtccacagcggccacggtgtacagcggctccttgccttcgtactcgccgcacggttcgatggtgtaggtctccttggtggacacctcgtcgtacaggctcagaccctgcatctgcggggtgttcttgacgtcttcgagcagctgctcgatggtcttgagcgcgccggtggcctgatcggtcagggcgtcgccggagaagatgccggcgcgcatcacgcctgcggaacgcaggtggcgcaccagcttgcgggtgtcgatgtggctcaggccgacgatgccgttcttggcgaggtcgtcgtccaggctgccttcggcacgccagttgctcacgttcggagagggatcacgcacaatgtatccggcaacccagatgcgggaggactcagggtcttcgctgttgacgccggtatcgccgatgtgcgggaacgtctgcacaacgatctggcgatcgtagctcggatcggtgagcgtctcctggtatccggtcataccggtggcgaagacgatctcaccggtcgtctcgccgagggcgccgtatggctcccccacatatacctgtccgtcttccaaaacgaggactgcatcgtccttgtcatacatcggaattgcgatggtcccggactcgttctggctcaccaaaacccccttatgtttttcgggtattcgtaccaaggttaacggccagcgcagactcacacgccgttggacgcaaagtctcacccccgctggcggggctgtcggcaaggtgccgacttgagaatgtacggcggcacaagtgtccgcccatgaaaaagcctcccgaatggggaggctgaacaacaaatgactaatcgaccgtcggctgaatctcagcggacggggcagcaggctcgtcggatgcaccggacgaatcgggcgaatcggaaacatcgccctcatcggtcggctcggatgcggcggcagcggaatcggacgattcctcatcggcctcttctgccacggactccggtgccggtgctgcattcttggcggtgcacaccgcagacagcaggccatggatgaaagcgggcgaatcgtcatcgcacagggtcttggccaatgccagagcctcgtcgatggcgaccttgtccggcacatcatcggtgaacagaatctcccaagcggcgatacgcagaatgttgcgatcgaccacgcccatacggcggaccttccaacccgtggagtgttcgtccagggtcatgtcgatctgacgacggtgctcggccacgcccttgacgatttcaatggcatagtcgggaagcggggtctgggcaccgggatgtgcgatgcgctcgtcaagcagggagagaatatcctggcttttttcgtcggcttcgtacagggtgttcagagcccttttgcgcgcggtggaacgtgccatactgctgctgtcctagtcctttatacggtcggtcgtctgttgaggatgcggagatcagttgttctcgcggccggtgtaggaaccgtcctcggtgttgatcttgacgcggtcgccctcattgatgaacagcgggacctgaatctcggctccggtctcaacggtggccggcttggtgccggcgttggagcggttgccctgcaggcccggctcggtgtgggtgatggtcaggaccacggagcccggcagatcgacgctcagcggggtgccgtcgtggaaggagaccaggcagtcggtgccttcgagcaggaacttggccttgtcgcccagaagggtcttcggaaccatgatctgatcgtaggtggtcatgtccatgaacacgaagttgtcaccgtcctcgtaggagtactggagagtgcggttgtccacggtctcgaattccatcttcatgcccgcgttgaaggtcttgtcgacgatcttgccggagagcacgttcttgatggtggtgcgcacgaaggcggggcccttgcccggcttgacgtgctggaacttcatgacggtccacagctgcccgtcgaggttcaggacggatccgttcttgatgtcgttagtagtctgtgccacgttattcacctatttcaaattcaaactagcttaggcaaagcccaaaaattgcctcggctattatgccacaccgggtatacaggaagtgaacgctggggtttcccatgtgcccccggctagactggatgaatatgcgatccttcttcgaagccatatccgtgtcctgcgtcatccccgcgcaatcgccggcggacgacgaacgcacggtgttcgagaacctgtcctttgctgtggagcgcggcgagatcgtcgatctggtgggaccgtccggctccggcaagtcgagtctgctgaccgcgtgcgcccggctcaacccgcatgcgcacggcgcgttcgcccttgaaggcaagggcagcggcgagttcacgccgcagcagtggcggcgggatgtcgcctacctgccgcagaagccgattctgacgggcaagaacgtggccgaggcgatccgcctgccctggacgctcgcgattcgcggcaagggcggcaagggcgagcatctgctgcccgacgagcgcatccgcacgacgttggacgcgatgggctgcgaggacatcgatctggagcgcgccccgcacgacctgtccggcgggcagacggcccgcgtggccctggcccgcacactgctcaccgacccgaaggtgctgctggccgacgaggtagatgccggtctcgacgacgacaacgcagccaaggtggctacgatcatggcggatgccgccacacgcggcatggcgatcatccgcatccgccaccgtccgccggacggacgggccacccgcacgctgacgctggacaaggggcggctgaccgaacgcgagatgacggattcggcggcgcaggacgcgaacgcggtgcctgacggcgccgatgaaaatgaggagacgcaggcatgagcggcgatctgggcaattcctacaacatcgatatctggggtctgctcatcgcgctgggcatggtggccgtggcggccatcatcagcgaactgatgcacatgggcatcggcaagaccctgatgtggtcgtcgtgccgcgcattggtgcagctgtgcgccatgggcttcatcatcggctacgtgatccggtcgaacaacgtgtggatggtgttctccctgatggcggtcatgctggtggcggccgtgcagatcgtgatgtcccgcgcacgcggcatccccaagggccttgccgggccgatcttcctgagcctggtcatcaccatgctgctgatgctggcgctggtcaccgagctcatcgtgcgcccgcacccgtggtacgcgccccagctggtggtgcccctgaccggcatgctgctgggcaacaccgtaaccgccttggcggtgggattgagccgtttctacgagagcatggaggagcggcgtgacgaggtggatatgatgctggcgctgggagcgaccccgtgggagtcggcccgcccgtccatcgtctcgtcgattcgcttgggcctgctgcccaccaccgcctcgctggcgtccagcggcatcgtgacgatcccgggcatgatggccggtcaggtgatcgccggcggcgacccgctcaacgccgccaagtaccagttcgtggtcctcgacgccatcgccgcgctgaccctgctggccgacggcctgatcatggtcatgatctaccgcacctgcttcaccgccgacgaccaataccgcccgcccgaagcgcgctaatcagctaagctccctctgataagctccctctgacgagggagctgtcgagcgcaacgagactgagggagagaccaccctacgcgatggtgaccagcgtgccgtccggcacctggtcatagaaccattgcgcgtcggccacggccaggcgcacgcagccgtgcgaggcgggctggccgagtttggcaccctcctccggcagatagtcgccgaaggcctcgccggtcggcaccgagtggaacaggtacgaaccgtagaactgcacccaatagtcggcgcccatgccttcttcggcattgtagaagtgttcaccgcgcgtatcgatggtgtacgagccgtgcggggtggcgtcgtcgacgccggtactggcgatcatcgtataaatggtctggccaccggacttgacgtacacccgttgtttggcgagactgacctccacgctcaggtcggagtactgggataggtcgggctgtttgccggtcggtcccttccagtccacgctttgcgcggctttgtcatcgccgttctgcgtgttctgcgtcttccgcgacccgccctgtttgccgctatcgggaacctgcttgcgggtaacggccgtgggctcgttcgccgctgcggttgcggcggcggttgcggtgtcggctcgcggccagctgcgctgcgccgccgcggtctcgactccggcgccgatcaggcagaacaggatacagcaggcgaccactccgcgccgaatcacgtagacccgatcgcgactccaattcacgttcaacgtcggcagcctcaccatatgcctcttctcaccacaaagaccattcgggtcgattgtaaacaggcattgcgacgccctacgcctcggtttcagccgtgatctcgactgcaggaacggcatcgtccggggaatcttcgcccgacgccggcaccgtccagcgccgccgcagcagcatccacaggccgatgatcatggtcaccgcaccaagcccgatgccgaacagtcccgaggattgcgccgcatatgcaaatgccatcgcaatcggaaacagcgcagcagccagcggcatcaccgcaagcccagtagcgaggtcaacccacagctggcggcgcgggaaacaggtcgcgccgcccagtacgcgaatccggcgagcttctaccgagtcgcgaggaagaagaaacgtgggaaggggaagatgatgctgccgtccgactgtgtggggtattcctcgcggacttgggcgaacacttcggcctcgaacttcttgcgcccggcgtcgtcaagcgcttgcagatacggcctcatgccggtgccacgataccagtccataatcgcctcatgcgagggcagcgtgtgcatgtacgtgaccttccacatgcggaaggcgctggcatgcgcatgcagcagctcccagtattcgggcggcgtgaggttgtagaactcgcgttgctgcggcagcttgtccgcgaacgcgggcgagtgcacgataccaccgatgatgcggtgaatcggctcctcatagttcatcggcgtctgcacagccagcactcccccgaccctgagccgggcgagcagtccgggaatcagatgcggatggtccggcacccattggatgcaggcattggagaagaccacgtcgaagtcggccggcagctcgtccagccgcgcggacacgtcgcacagctggaaatcgatgtcgggataggttttgcgcgctgtctcgatcatgaccggcgagctgtcgacgccgagaatcttggcatggggatagcgctcgcgcagcacggccgtgctgttgcccggcccgcagccaatatccagcacgcgcgtgacgctgccgtcgtccggcggcagctgcatcgccagatcacgcgccggctgcgtgcgctcccgtttgaatcgcagatactgttccgaatcccaggtaaccatgctccccacgctaatcagccattcacatatcggccgatattatctcacaattcagccgagcagggcgtcgcggcggacgatgagcccgtcaatcgcggcctcgccttcgatgacggtgaaggtcagggacttgcgttcgctggcctgcggggcgatggcgtgcaggtcgccgcgctgctcgtgccagccgcggccatggacgctggagttcgagggttcgaggccgaccacgtagtcgcccgcacccgtcgacttccattccatgaagtatgggaagaggctggcgtcgaagtcgatgacgactccgagtccgagcttgcggttgaccacggcggcgaagctgcggccgttctcgtcggcggcgagctcgtgcaggtacacgctttcgggactgatcgtcgcggaaggattcgttggtcacctcatcctcgaccgtgatcgacagccggccgtacacgctggtgattgtgcgacgcagtacgaggttctcgccgcggtattcgaactggcagacgtcgagggcgcggtcggccatggacacgaaacgcaacggaccgttcttcacctcgatggccttgaggccgtgggctcggccttcctagtattcgatcgggcgcacgtaggcggcctgctgaaggctgcccatatgggccagcatgtcggctcgcgtgctgtgttctgtggacgtcatcgtcgtcaccgatccttgatatttatgcctcacgcctgcgcagcggcggcatccgcggcgtcgttcttcagcgcgcgcagcagggccttgttgcgggattcgatgatgcgcttgccgtcctcgccctgccaggagaagaagccctggccggttttggcgccgagattgccttccctgaccttctcggcgagcagcgggctcgggccggtgccgttgtccatatcgtcgaacaggtaagtgctgatgttatagaacacatcgaggccgccgaggtcgatgctggcgagggggccgaccagattccagcgacggccgagactgtacttcatcacgtcgtccacggtggccgcgtccgcgatgccctgctggacgatgtagaacgcctcgcgcagcacggccagttgcaggcggttgcccacaaagcccagcgattccttcttgatcttcgccggcttcttgccgatcttggccatgaggtcgaaggtgatgtccaccaccttcggatcggtcttctcacccggcaccacttcgaccagcggcatcaactgcgcggggttccagaagtgcgccaccacgaagcgttcgggcttcttcagcaccgactgcagcgcggtggggctcaggccggaggtgttcgtggacagaatcgcgtccttgggggcggcgtgctccacttcggcccagacggacttcttgatgtcaaggttctcggccacggattcgatgacgaagtccacgtccgccacgccgctcgcatagtcggcgtaaccggtgatgcgggccagcaccgcgtccaaggtgtcgccatccttgagtagtccggcttcggcaaagtcctcggcatccgaacgaatcgccttcatcgccttctccagcgaggcctcgccgcggccgaccagatgcaccggatatccggacaacgcgaactgcaacgtgatcgcgtggcccatggttcccgtgccgacgttcgcaatcgtcttgatatcgtccactgtctcaatcacggagaccccttctttccggcggttcgtctggcgttggtgtacgcatgaacagcaccgtgccgttatgcgtttgctcgcattctatgccgatttcgctacgtgaacatttactgaacatttcgcggattcgactagtacaaatccccatatcagcacaaaagcgtggtgccgcaacaccgaagtgttccagcaccacgctgaaatgttcatgtcgttacgctgctatcgcgcacccacagcggaatcgataggaaacctcaccggagtaggtgaacacgggggcgaccagcatggacggaccgaacatatactgacggtccagcgtgcggcatgccgggtcatcggggaactccacgaacatggaacgcatgaccggagtaccgttcacatgaggctgcaggccaagctggtagacatacggcatgagttcaagcttgagcttggtgaactcgcgcaccacatccacggcggtctggccgggcaccaatgcgacgccgttcttctcgtcctcctcgtcgaacagccacggcacacggtacacggtggaaccgtgcagtcgcgagtgggagccgagcatgccgaacgccacccaacgcttgtagacggccggatccgggaacgcaccttcgaagccaccgatgtcgtgactccagaagccgaagccggaggaggtcagcgacaggccggcacgcaaggactgggccatgccattgaaggtggactcgcagtcaccgccccaatgcacgggctgctgctggccgccgacggtggcggagcgcgcatacaggcaggcgttgcccttgccgtaggtttcttcgatggcttcgaacacggcctggttgtacagctgggtgtaccagttgtgcatggagagcttcggagagccgtcataccagacgacgtcgcgcgggatacgctcgccgaaatcggtcttgatggcgtccacgccctgattcagcaacgccttgaccttgtccttgaaccattcacgggcggccgggttggtgaagtccaccaagcccatgccggcctgccagaagtcggtctgccagacttcgccattgggcttgcgcaccagatagcccttgtctcggccctccttgaacatttcgccgcgctggccgatatacgggttgatccaagcgcagatgtgcaggcccttgtcctcgtgcaggcgcttcagcgtggattcgatgtcgccgaagaaacgcttgtcccactcgaaatcgcaccaatggaactcgcgcatccagtagcagtcgcagtggaaggccgccagcggaatatcacgttcggccataccgtcgatgaaggagttgatggtggcctcgtcgtatttggtggtgaacgaggtggtcaaccacagaccgtaactccatgcgggcacattcgccggacgtccgacgagcttggtgtagcagtcgagaatctgcttgggggtggggccatagatcacgcagaagtcgatggcctcgccgggcacggagaactgcacggcctcggtgttctcggaaccgatctcaaaggagacatggccgcggttgttgaccagtacgccatacccattggaggtcatgtagaacgggatgtccttgtagccctgctcggaagcagtgccgccatcctcattccagatgtcgacgctctgaccattcttcacgtaagcgccgaagcgttcgcccaagccgtatacgtcttcgccaaccgacagatgcagctggatggcaatgaacacgtcggattcatcacgggcggaaccgtccatggtcacaccgaattcgctgaccggctgggcggtgacgttcgattcggcaccgagcttgaatcggcccagcgacttgcctgcggactcagtgagcaccttgccgtcctcgccgatgaaggtcaggttccagggggcgcccttgacgaccttcacggtaagtccgccagtggtcagcgtgacatccgcgccattgacgccgacttcgccgtcgccattgccgttcgcctgaacggtcacgtaatcacggttgccgggttcgtcggcattgagcgggaatccggggtattcggtggcgccttgccagtgttcggcacacacacgaatcacgccttccgcaggtgtggtgatgtccacattgaatgtgggcaggttcagggtatcgtatcggccgcgtaccacggaggtcggggcgaggacgttgaggctttcggtggtggcatccgccgccagttcgtaggcttcacgagcatagagggcgtcgacgccgtcacgaatcatccagtagccgttggtgaacttcattgttgctgctccttggtggagaggtggtttcgaccgccagggaacaaggcagccgaaaccaaaatcaatatgtgctgcttgttgattgaattgcctgttgtgcgaatgaccttacttcaccgcgccggtggtgatgccgtaccagtcgccggagcccatcatgccttgctcatcgtacttgccggtgtcggccaaggaaccggtgataatcttgtcccagccatattcggacacgtaatcgttgaggttggtgagcaggccttggctggcgagcaggccggacgtggcgttgcccttgttgtattccgtaacgtccggagcgtcgtcggagttgaggacctgggaggcgttctggcgaatctgttcgaaggccttcttctcgaattcgaccttgacgccggtctcacacattttcatgctttatgcaaaaaatgtgaggcatacgcacatttcccatcaaacgcacaggtgcaagaatggcagcaattcgccatttttgaaatcaccatgtgcgtttgacggcgcgtaagcctcacattgttctcagcaggaccgaatttctgcgagccccccctatagcgctcccctacgcaatatgtccgcaaacgaccacaccacatgggcgatacgcgccaattcggcgtaacggccgatggacagccactgcacacggtaccgttcgaaccacaactccaaatcggcggcaagacgggcgcggcgcgaggcatccagcgcacggccggtcacatccttggtgtcacaggcgtcctcgccgccagccaataccagcagttcctcacccagtctattgaacaaccgctgcccatccagcatcacccacagcagctccgggttcaatcctcctcgtgccgagccatcgagcaccgcgacaaccgcactgccgcaatcaatcaacgcccggtcgcaatcccggcgtcgttcgagacgggcatggttccgcaggagcaatcggcggcgcgcgtcggcgcatcccagcgcacggtcaaacatgagctctcccccgcacgaccgttccacatacgatgccacatccgtattcagcatgccggtgccggaaccgtattccagttccagcacttgcacggcgaggtcccaggggaacgacactccatcggagtcgatgcgagcgagtgaatccataagccaaccggattcgtcgccatacgccagattagaaatccgatggttcatttcgcatgcgtcaattgcaaccgggttccacgcgttttgcgcaccgtagcacagtcccggcacgctcaaccgcggatcattgacatgcccatagtcaccccaatcggtgaccaccatgccttccgcaccatatttgagcccagccaccgccatgcggtacgtgttcagccaggcaccgtcatagtcggggaagaaccggctccacgcacgcacggcagggcacacgaattggcggcggccttgtgatgcgatggtctggatcttgctttcgtcgatatccggctcatacatccagttgagcatcgtgatgtcgccgggcagcaagtccatggtgtgcggattctcgagcgcgatatccgcccacagcatcggttgtagaccacgatgggcaagcgtgctgcataggtctttgacgaaatcggcatacagctcatcgcgactggcgcccggcgagtcctgtacggaccggccacggcccaagtcgaaagtctcatcgccaccaatattgaaggactgcgagcggaacagcggcgcgtattcctcgattaggcgcgaggcgaaatcgtgcgacttggggttggctgcgttcagtgtgtggtgttccattcgttcgatgaaactgaacggacggtcggcgtcttcggggaactctcccagtccacgatgttcacgggtgcgcaggttcatatacatgtgcccgaaagtggccaaggacggcaccagttcgatgccgtggtgtgcgcagtattcgtccaggaacatgatgtcgtcggccgtgagcgggtcagtgccgcgccacgcttcgctgagctcgccgaaagcgaaggcatgttccacgtacagctggaattggttgtacttatacaacgccagctggtcgatgaaccaggtgaggaacgccatcgtcggcacacgcccgcgcgtcacgtcaagactgtaggcgcgcaccgcgaacgcaggcttgtcttggatatgcaggcagggcaaggtccgcgaggtttgcctgatcatctgccgcagtgtctgcatgccgtaccgcaatccgctttcgctgccaccacgcacggcgatggtatctgaggcgaacacatccagcgtgtattcgtcatgcgccaatcgcgcatccacacacagcaatatgacggtgccgttcatcgctgccggcgcacccgcgcccgcacccgcacccacgcccgcatctcgcgctttttcggcggcattggcaccggcgtcggcttcatctgtggctgtgagtactcggtgcgtacggacggcgacgccgcagtaacgctcgagttcgctggacagctgctcgattggcagcgtttcccaggtctcatcggcatcttcggtgacggcatattcgggaattcgtttctcgatcgtcaccaaggacccgatcatagccgtgccatgcgtgtattccaatgtcaccggagcgggaatcagggtgagacacggcgttgcggcatcagccttatattcgaatgtgggcacagctgttcctttcatactgtttttattatcgttcatccgctgacggcaggcgacacgcggtcacgccgccatcagcggacgaatcgtttggtgaggtacggcggcatacgctatttcacggcaccggtcgtcacacccttcatgatgttgcgctggatgagcatgaagaacaccaccaccggcaacgagaaggtcaccgaagcggccatctgcccgccgaaatcggtgcccatggtgggtgtcgagaaggacgacagccataccggcagcgtgtacttcgactggtccttcatgaacgtataggcgatcatgtagtcgttccaggcgttgatgaacgcgaacaccgaggtcgagacgatgccgggcgcggccagcgggaaggtgatcttccacaggatctgccagtcgttcgcgccttccacggccgcggattcgaagatgtccttcgggatgttcaggaagaacccgcgcatgttccagatcgcgaacggcagcaccatggcgatgtacgccaggatcaggccgctgtatttgttgagcaggccgagctggttgtagatgatgatctgcgggatgatgccgccagaggtcatctggatggccagcacgaacaccatgatcggcttgcgcccgcggaagcggtacagggtcagggccgtgcacgcgaagaacgcgacaataatcgacaggacgatcgagaggtgcatgggccagaacacgggggtcgtggtcatgatctcatcgcgcggctttacggcggtgataatcatccagtagaccgggaagaaccatacgacgcagaacagcagggcgaggatagtggtgccggcgcggcgcgcgatcttgccggggttggttcggcggcggggcggtgcagactgcgctgcgccatgcgatacggcccgtggattctcaacacatttcataaggacgacccgctatttcagggattcgccaatatcagcgtgccagtcgccatttccggcgtcggctatggcagcgccaccccttccccaccgtcgacatcgacaaccgactcgcttcacgcaagctcaccgagcatatgttggggcgcgggtatcgacgaatcgcctatatcatcggaccgtcgtacttgccgacgtcgacgccgacgccagcgtgcccgcagctgaccaccgtgcgccagccaatggacgcattcggcgtcagcttggctaccctagtgcttgaccagatcgaggaccggccgttccagcgcacggggctcctgcccaccgaggtcgtagccagataggcgcgcagagaacggttctcaataatgtctgtgcacacttctctacgcccgaagcacacatggaatatgccctaatcactgccatgtcgccatttgcgatgatgtgagattgttatgttcttgttcatttgagcgcacagatactactgagaaccgttctctgcgcaaatagacaatgtggataactccataagctggaaccacattgccctgcctggcttgcattcaagtccaaatcagctttacggtcgcaccatgagctcttttatgcatgaggatattgtcggccgacgccgagcagaacgtgaacgctgcaatgatgctgcgcgccgttcgaaaggtccattgctggtgggatacatcaatgcggccaactactacggcgcgcccatcccccgacattgcacgctatctgttgatgccgtgcacgcctgtgtttccagtgccaacaaacgcagacgaatcaaaggcgtggtcttccatgtgtttaagggaaaactggatatccgcaaaaaggattatgaacagttctggattgcctcgccggtcatgatgtgggctcagatggcccaatactctacattggaggaacttgcggccattggagcctctttgatgagccgcgataaacggcgcagaatggccactcgcaaggatttcgatacttacttggaaatcagtccgcggttcataggtcgtaacaaatgccacgaggcactgccctacatgacagagaacacggattctccgccggaaaacacgctgtttgggatgctgaaggattcaggcttgggatgccccaccgccaactatcgcgtgaatatcggcaactcatacgtcatattggatatggcatatccggactgccgcgtcgcgttcgaatatcagggagcctatcacgccgatccggcacaaatgcgaatcgacgcggcaaagcgaaacgcattgcaactgctcggctggatcgtcattctcgtcactgcggatgacctgagaacagccgacacgcggcatcgttttatcgagatggcccatgtcgtggtgtcccggcaacgcaatctcgccgattggaaccgctcatgggccattacctcttagcatcgcaccgacaatgcgctatgccgttatttactgcgaggcacccgccagatatcgggctcaacgtagatctcccattcataccaaggcagcgcggcacggcgtcctcgtccatgtgaatggcctgcaggttaatgagcctatccacgccggcagtgcgctccattgcctcgaccaccaggtcgcaggtgctgtggtcaagcgattcgcccaccagcagcgaaccggacttaaacgccagcgccgcctacaaaagtgtgaggctgcgcaggctcacactgccaacagccgttcagccaaccctcggaaggtctggccaatgccatccgtacgcaaagcgccgtcggcgtccagcaccgccggccggccggcctcgccggtctcgcgcacttcgggttccagcggcagctgggccatcagcggcacgtcatagcccagcgcctgagtgagctgttcagacacgcgctgaccgccgccggcaccgaaaatctccagcttctcgcccttgtgctcgtagtagctcatgttctccaccacgccacgcaccttcatcggcacctgcagggccacgagtccggagcgcacggcgatgtcagaggcggagggctgcggggtggtgaccaccacaagttcggcgttgggcagcgcctgggccacggaaatcgccatgtcgccggtgccgggagacaagtcgagcaagaggacgtccggctcgccccaccatacgtcagacaggaactgttccaaggagcgctgcagtcgcggcccacgccacagaatcgcccggtcagcaccggcgaacatgccgatggagatcagtttcacgccccacgcggtgaccggcatgagcatgccattcagattggtgggctgtgtatgcacgccgaacaggcgcggcagtgagaagccataaatgtccgcgtcgatggcggccgtgtcgaagccgagggccgcaaacgtggcggccaggttcgcggtaaccgaggacttgccgacgccgcccttaccggaggcgatggcgaagatgcgggtcttgacacccggtttgctgaaggggttctgcttgcgttcggccttgaggtcggcgaccagatcggccagcttgtcacggctcatcgaaccgacttcgatatgaggcagcagctgtgctcccggataggagctgacctcgccattgatctggctggtgatggtctcgctcagtgggcatccgggaaccgtcagctcaacgtgcacggtgacgtcgtaagtgccggcgtccgacgatgcgggcgcggcttcgatggcggcaatcatgccgaggtcggtgaccgaacgaccgagctcggggtcgatgaccttgctcaggcgttcgtagatgtcggcttcgatctgacgtgcgtcgctcataaatccgtatcctcctttagggcctgttctaccctagcgtgtgatgcggcggcatgccagagggagtggagtaagtcacactggggcgggattcgctttttctctcccccagtcagcctaaaggctgacagcccccctcatcagagggggttaatgaagcgtctgagggggctattttagatggtgccggtggctaggagctgggcgaattgggtttcgctcagcatggggatgccgagttcctcggccttggcggccttggagccggcgtttgcgccaatcaccacgtaatcggtcttcttgctcaccgaaccggccgccttgccgccgcgctcgataatcgcctctttggcggaatcacgcgaatagccctccaatgaaccggtgaccaccacggttttgccggccagcgtctgcggcaacgaactggtctcggcctcgtcgacgcccacgccggcggcctgccaagcacgcaaagtcgcgccgcgccagtcaccgggttcgcgggtggcggcgaaccagttcaccaccgattcggcgatttccgggcccaccccgtcgatggccgtcagatcttcaatcgtggcgttttcgatggctgccagcgagcccatcgccgaggcaatcaggcgtgcggtaggcggaccgagccggcgaatcgacaacgcgaccagcacacgccacaggtcggcgtgacgggccttgtccatttcgtcgaacatcttgcgcgtgttttcgccgggccgaatgatcaccggtacatccgtgacgccagtgcgcgtggtcttgtgatccacgcgcacgataaccgcgtcggccggcacgtcatactcaggataggaggctgcggcaaagcccggcatagtaccaagtggcgcctcagccccggtaggtgcgccggtcgtctcgctggcggtacctccctgtgtttcggcagattcgattgcggtctccccttgcgcgcgttcggccagctgcttggccgtgagctttttggccggcgtgggcgcggtccagaaagcaggcacctgatgccacaggccagagccgccgacacgcttacgcacctttttcttcttaccgttcgcaccgaccgtctcatgcacctcgacgattgcggcctcacgccacacgcgcacgtcgcgcagatcggcggcggtcaggttgaacaacccggattcgttagacaacaccggcttctgcgcggccggcaattccagcccttccaccggctcgtacgggtcaggctcttcgccgggggcgaccagaacctcggtgatgttcggcgcgtaggtcgccaccgaatcaggccggttctcctccgggttggtcagagcgatggccgattgttcgcccaagtgctcgatgtcgaacgccttgcgtgaggccagcgaaatcacgcgctcggtcaactgggccgggcagctctccacattcgggcagcgaatgtccttgtcaccctccttggcgggtgacagtttcgcgccgcatgaagggcagaactcgggcatgacgaattcgcgcagctggtcctcacgccctttgcgccgttcaagcaccgggccgaccagttcgggaatcacatcgccggccttgcgcaccaccacggtgtcgccgatcagaatgcccttgcgtttgacttcaaatccattgtgcagcgtggtacgagccacggtggagccggccacgtagacaggtttgagcacggcgaccggcgtcacacggccggtacgccccacctgcacggtgatgttgagcagttcggtgttgacctcttcgggcgggtatttgtaggcgatggcccagcgcggcgcgcgcgaagtggcgccgagggtacgctgcaggcccaggtcatcgaccttgacgacgatgccgtcaagtgcatgctcgatgtcgccacgatgctcgccgtagtactcgatcatgtccaggatctcctggaatgaggtcaccgcacgattgtgcggggagaccggcacgccccacttggtgtatagatcgtaggcctgcgactggtcggcgaccacgtcatgggtgccgcgcggatggtccggcccccaagtgagctgccccagaccatgcgcatagaagctcaggcgacgggtggcggtgatgcgagggtctttttgacgcagcgagccggcagccgcgttgcgtgggttggcgaagggcgctcgtccggcgtcctcctgctcgttgttcagggtgtggaaatcatcccaacgcatgaacacttcgcctcggatttccacgaagtccggaacgtcttccttggggccgccgaggtttgcgggaatggagccgatggttcgcacattcagggtgatgtcttcgccggtaacgccatcgccgcgcgtcaggccctgttcaagcacgccgttgcgatagatgaggttcagggcgaggccgtcgattttgacctcgcagctcatgggcaggggcttggattcgggccaatcgaggtcgcgaatcaccgagtcgtaccaatccttgagttcttcgatggagaagacgtcgtcaaggctcatcatgcggctggggtggcgcacggaggcgaagtcgttggagaaggaaccgccgacgcgatgggtgggcgactgcggattgtccagtgaggggaacgccgcttcgagtcgttcgaggcaacgcatgcgcgcatcgtaagcggcgtcggagctgacgggtgagtcgtcgatgtagtaggcgatctgatcggattccacccatgcggccacgcgagcccacaggcgggcggcggcctcagcggtcatcgtgttcacgtcgaaacggtcgaggcgtatcgcgtcgtcgtcagtgggctgcagtgcggctatccattgttcggagccaggggcaaaacgtgcaataccggtatcaggccggacctcggccacatccccatcgtcgaaatcccatgccagttgttcgttcgtgctcatggttgtctatcctagcgggctcggctcccctcggccggctataccgtcaactcccctcaggcggctacgcggatagcgagcgcaggaactgggcttggatgatgtcgatgttatcgccttcgccgtcattcatgcgggccacagccaccgagagcgtgcgggccggcacgaacatgccctcatccacgcacacgcgagcggcgtcacgcacgatgtcagccacttcgatatgcggccagaccggcagatcatgcgtggcaagcacatgggcggcggcctccaccgattcaggcaccggtatgcactgcgagtccgcacgggaaaccagttcctgcagttcgctttccagcgaaccaatggccccgggagcgatgtgatcgctcataatgtaggctgcggcggctgtgtcgaaccggtcgagcatccattcggcgtacgcgaaccggtagtaggcgaacgcggcatcgtcgcggtccaaggccacgcgcagagcattcaggcaggcggcgcgtgccgaatcccaatcctcattgcgggccagttgaatggcgagcttcagatgtgagagcgggtaggcgggcgcgtacgccaccatacggttgagatgcgggatcgccgcctcggcacccttgatctgactcaacacgtcagccagctccatgtgcgcgtagaacagattgtccgggataagcaccgtacgctcgtccaatgtggcgaacagccggttgtagaccacgcgctcggcataggaattgaagtatcgaggtacgccatggcctgccgcatacacctggtccaaatgggccacggccgcttcggccgcttcgatggcctgatcggcttggcccgagaacagcatgtctcgggcgcgcagacgctccttgtcaagatcgtcggcaagcgtgaacgtgaagtccggcgtgtccttgccatcgatcaacgcactggtgacctgagaggccaaatcggtcagttcgggatcgcatatcgattcgatgacctgcatggctcgctgggccttttccacggagccgagcgacgtgttcctggcgatatcgtggaattcgttgacgccatgctgcagcaggtccactcgctggatagccagtccggcactattctgtgcgcccagcacgtgagcggtcgccgggctgaattgacggtcggccagttcgggctcctcctgggatccggtgggagagaaccggctgtccgccaagtcgaagtcggcgctgatgggtttcagaccaccttcgccgtccacgtccatcacggcaccgaacatgcggtaggtttcctcgggattgtcaagcccagcggtgtccagtcgcttgaggaaggcatcacgggtgaaggtgacggtgaccatattgcgcacggtgggattgcggcgcagcacgctcatcggatcatcgtccatgccggcggccccatcagcaccgtcagtgccgacgccctcgccgccgataccgcccaggtcgtcgcctgcgccggtatcgtccggcatgccgaacgccatttcgtcgatatcgatgcccttcatcaggtcttcgaactgcgaatcgatggacgcagcgccatcggcgtcagcgtattcggccgcggcctgatccgtagcatccgcagacggtccggtaccgttgcctgctcccccggccgtgccgcgttcgtcaccggacgccgtctgcccgaacgtctcctcatgggtgatggggcgggtcgggtcgccatggaaatcaccatctttggggtcggctttggaacccacacgccccaaatcgccactgcgtagatgttcgaaggcgcttagggcctcgctcatcatcgcctcgatggcggaatcctgttcggcaatcgcctcttcaagaccaatggaatcgatgtgcaacgacacctggcgcacggattcgctggtgccgaaacttagcgcggccatcatcaggccgacacgcaggttgtaggcggcgctcattgacgcgcgttcgacgctactcagcgcacgccacgtacgtcgagtggtgtcataccggctatcgggcatcatcgaggtgccggcggtggtgaagccaatggccacttcacccgaatccaagcgcgaccggaactccacgtcaaaccgatacggcaaccgtaaccggcgcaacagtgaagagagggtctgacgatacacccattcgtcgctcctcgccggcgaatacgaaggacgagcggcttgagtgttggtgtcgctcttatcggtccgttctacagcgccctcagcactctcagtactttcagcgcccgcagcattcgtcacacccgaatccggcacgttctgctgggtcagcacatctcgaggatcggggaattcactgcgaatctgtccagccgtgcgtgcggcgatatcgaccaggctcagcacggcccgacgctcctgctcgccatcatacgggtcaagcgccataatcgcagggttttcgatgagtttcatgtcgatttgcgcggcctcggcacgggtcaccgtatcttccgtagggttgcgtcccaaggaagcgttgcgctccaaccaagcgctcaccgcagcgaatcggttgaggttgccttcgatcttcaaggatttcagcgcctgcccgaatgccaaggacttatcccacgtaaagaaatagccgctcgaatacgtcgaggtgtacaggtgcaatggttcggcgccatgcaccgcttccagtcccggcgtggtgtcgagagcgccggcttcgcgcatcagatcggcgaaatgatcctccagaccggaggcccgcatgccgtgggcacgtgccgccaaagtgtcacgcaccgaacggcgaatcgcaccgattggcgcctcacggttgagacggcggaagatattgccggaaccgaatccgatgagcagaccattgatctgcggcaacatatacgtggcgaagaacgcgatggtaatggcatcgcggtattccaaatcatgacgcatcgcaggcggcagattggcacgcatctgctcaagcgtgtaccggttgccggccttgagccatgaggcgagccacgtcatgcgtccggtgtcgtcacgccccaccacgccaccggtaatggccttcacaccgtcagcaccatgaccaaggccacgccccaaaccacgcccatgatgcagcgcacttcccaggccacggtctgtacgggagaaaccggaacgtgaacgaggctcgtcgctttcgcccagccgctcaccgtccggcaatgtcacttctttttccttgccgaacataaatcgcgcctgcatatcctgcacgtccatgtcggggtcggtgcccacgaatacgcggccatgcgtatcggcgaacgccacctgcgcaaaatgatcgcggtcggggaaaatgccaagcgagaagccgcggcctctggtggagggcagctgcgcccatccaagcaccagcccttccggcacgttctccaattcggggaaggtgcgtcgcttgattacaggactcagcgccactgcatggcgagtcagttcgtcgataatgccgcctttacgctcactggtctcctgcaaggcatcgccgaacggattcgtatcgtgcttcttcggcttggacagtcccagatcggccgcgagcgcgttcatcgaatccttcagcccgcccagcagtggcgtgcggttgtgcttcccatggtccgatgtacgttttggcatgattcacattgtctcttgtttgcccgacatcaagcccgaataaagcctatagaataaatgcgtgcattccatagaccacactcgcgcagaccgtccgatgccgtcgaatcatgaacggcacctgcccagccgcccggatacccggcaccggctgcgtttggtgcgcctgctgatcgccttgctggccgccgtcgccgccatcgccgccatggagtgcatcgtgttcaacctgccgttctggcgtacgctcggagcgagcacggatacgaacgccgtgcataacacgctgggttcgggtctcacgcgccggaatgatggcatgttgaccgtcaccgatccgaccaaggcctatcttgaactgaccgcggacggcacgtcggattacctacgcatcgataccgagagcagcaaggtcatcgataaggcccgcgagcaggccgaggccgaatccaaagcgaacgacgataaggaagtcttcaaaccgctggcgaccattcatgtgcgcgcggatgtcgatggcatcaccggcaaggcccagtcgatgaatcccgacgctattcgcagccattatgtcaaggcgccgggtgccggcatcgtgcgtatttggattcaggaagagcgcggcgcgatcgtaccggtcaccgacgcccgcgccaacgtgcgcgtaccgttcgtcatcaattggatgcgcgtgctcgccatggccttggtgttgctgatgattgccgtctggaggccgggatcgcgcctgtggcgtatcacgcttgacccgtccagcactcggcaacgacttgctttcgtggggcttctggcgattcctaccctgcttatcggcgtatccatcatccacgaactgtggtacacgtcttcgctcgtcttccacgtttccggcgattacacctatgatttcgaccagtatgggcatgtggccgatgcgctggtcgccggccggccctggctcgacttgccggttcccgaacagctggccgccaccgagcacccctatgacgtagccacacgtgcccagctactcgccaatggagccagtccgctctactgggattacgcgtattatgacggtcactggtattcctattttggcgtgttgcccgcagtgctgctgttcgtcccctatcgtctgctggccggtcataatctgccgacatccgccgccgagtatattctcgtgctgctgttcatcatcttcttctccttgctggtgctgcgcgtcatccatcgtgtgatgccgaagacttcggtggcggccgcgtcgttagtagtggtctcatcgttggtgagcgcgcaaatggggtatttgctgtatcgcacgaacttctatcagataccgttcgccgcatcgctgacgttgacgtcgctgggactatggctatggctcggcgcggacacgtcccgccgtccgctgagaccatcggaccgatggcaggcgggcgatgccaagcctctctccctgccacgactggccttgggcgccttgtgcattgcggcgaatttcggatgccgaccgacgttcaccttggccgcattgcttgcgttccccctgttctggccgcagattcgcgcgctgggcaccggtctgcgcacacgccgcatcaagccgttgcaggcgttgcgcgcgccgctggcggtaatcattcccgccattctcgtcgtgacgcctctgatggcgtggaacatggttcggttcgattccccgttcaatttcggcaatgcgtatcagttctccatatccgatatgacccggtataccaccccgtccgcggatatgcccgccaacatctggtattacctgttcctgccgctgcgcttcatggatcgtttcccgtggctggcgggctctcccgccccgatgccgcaatggggttattacgaggtgatggtcggcgcgattttcacggccacgccactgaccttgatggctttggcgctgcccctgctgcgcagattggaaacacacggcatgcggccatggctgatgtcttgcttggccgtggcggcggtgctggtcgtattcgacagccgcgtcggcggtttgggatggcggtattccgccgatttcggctggctgatctcgctggcgtccataccggggctactgtggctggtcaatgggcgcgaaccgagccgctcattggcgggggccaacgacgccgcttcaggcgatggcatcgcccgcgtcactccgtggcgttggctgatgcgctgggtcgtgatgctggccgtattgtgggcgctgggcatagccatactaagttgcttcgtgcagtcgcgcagcgattcgatgatcgccaacaatccgacgctctggcatcaggttcagtcttggttcaccctgctataggaccggaccgctcggcgacccgccaagcttcagtattctcccagcattccggccggtgttttccaagacctgcggcataatgtatgtgacgtaattcactaatcgtttacccatactgtcgtgagggtttccccgtgtccactgccgtccgtagtcgcgtcttcaaaatatccgcagcagccgtcaccgcagccatcgccattggtctgtgcctgttctcacaggacgacgtcagcgcctccatcaaggaacgccgcgtggagcggctcaacgcccagatcgagaacgtctataccgacgaataccagcagatgatggacaccgagatcgccgacgagcgcgacgccaaagaacgcacagtcgacagcatctacaccaaggtgaacccgtacggcaccaacaccacgtccatgtacgtgtacttcaccaccgatcaggcctccaccgtcagctacaccgtttccgctgaggggtacccggattacacggccaacgccatcaccagcgatgaggcggccgccgcataccgtgaggccgccgccggcgacgccgacggttccggcaatgtcggcggtaccagcacggcgagtcagacgaccacggtatcgagcaatgacatcgcctccaccgagcacgagtttctggtgttgggactgatccccaaggtcaagaacaccattaccctgaccatcaccgacaccgacggcaacgccaccacgcgcaccatcgagcagaccggcccgaaactgctcggcgaggaggaagtacggctcgaacaggccgtcgcccccgacgaatccacggtcaccacgctcggcaatggcctgtatgcgattctcggcaatgattccaacgagcaggatttcatgtactactatgacgcgaacggtgtgattcgcggcgaaatcccggtgctctactaccgctcgcaccgtctgctgttcgacaatgacggcatcatgtggttctccgcctccaccaagcatttcgtcggcatgagccgcctaggcaagctggtcaagatcatcaatctgggcgaccagtacatcctgcaccatgattacgcgctggattccgacggcaatatcgtctctctggccaccgatctgaaacattcggaccatgccgtgcaggatcaggtcatcaaggtggacaccgactccggcgaggtgagcctgctggtggatttcggcgacctgttccccgattacaagcaatccaccgatcattccggcatcgacgaatccgatccgaccgccacgaaccgttgggactggatccacttcaacaccatccagctcatggatgatggctccgcgttgctgtccgcacgtgagacctccacgatgatcaagatcaatgacatcgaaggcacgccgtcgctcgactacatgatcggcgagccgagcgtatggaatggcatggatgcgcagccctccttcctgaccaaggtgggcgattccggcgacaccggcggccagcactcaatcactgtgcagtacgattcctcgctggaggacggccagtactacatctacatgttcgataacgacttcggttatgccatgacccgtcctgatttcgattggaccatgatcgatggcatttcgaccgcgcagagctccaaggatgagaactcgaactcccagttccgcaagtacctggtcgacgagaacgccggaacctacaccgaagtgcaggacttcgatgtgccgtattcgccgtatgtctcctccgcacaggaactgtccgatgacctgaacctggtggacatcggcatgcagggcctgttcggcgtctacgatgacgacggcaacctcaaggcacagtacaagatggtgctcagttcgggatacatctaccgcgtctaccagtacggcttccgcggcttctacttcgcgtgaggattggcatcgacctcacggccgatgccaatcctccaacggccgattcctatctgctaccgcttcgcagcctcatacttgcggcgaatcagatcctcataaaacgccacagcctcagccggcgctccgtcaaacgcgaccgcgtgctcgtccagcaccagtacgcggtcgatggcgtattcgggccggcggatcatatccgtgtcatgcgtggcgaaaatcacctgcttgttgtagctgaacaacgccttggccacatgcgcggcgccaatctcatccaatcccttgctcggctcatccgccacaatcgcactcggctcaaagctcagcgcggccgcaatagccagcaggtgccgtttctcggagtccagttcgctggccttggccttggagacctgcgccaaatcaaaatgcgcgaacagattgccgatgcgcgcatgacgttctgactcgggcaccttgtgctttttcagcgcttcggaaacagcctcggaaatattcgccgcttggtaaaagctgttcggaatctcctcgcggcgaactttgccgaccagattatcgatgcgcttcgcgtccttcttcacagccgggtcaagacgttcctcaccgcccgcaatggtcaccgtgccggcgttggccttcaacgaaccgtccagcagacccagcaatgtggatttgcctgcgccgttcagtccgatcacagccacccgcagctcgctgatggtgatgtccgtgggagcaagtcccacgtgcccatcatcatacgtatgcccggcctgatccaaagtgaacgtcagcgacgccgggcgtggcagttctttcggtctaaacaagaatcccatgccgctattgtacgtggagtacaggcgtggtgccggcaaacaccggcctatcgcagcaaagcggcgacggtattgagcacggcgcggatgccacgctcgaattcgtccggttcgggtagcagggaaacggccaggtatccattggaagtcatgtcgaagaagtagccgggctgtccggtcagtttgtgctcgtcaatcaaccgcagcaccagctcgttctcatcgatgactgaaggcactcgtagcagcacgttccagccgccttcggcccgtagcacgctgaccagcccgttgggatcggcgtcaagcaactcgtgcaacttggccaggttattgcgcacgcgctcccccacccgtctggtctgtgcgggcgcggcgttcaataatgcgggaatccgttcggcgatgatgtcactcatcggcagataatcatcggcgataacgtccagtcgacgctgtgcctcggcaacgtcctcggcaggtccggacacctgaatccacccgactttggcgtgcggcgcggccagcattttggagaatccgtctagggcgaaggtgagcacgccgcgctcccccgcgagccgtgcgttgccggggaaaggttcgagagagtaatcgaagaacacttcatcggcgataagggcgatgccatgctcacggcacaatgtcacgatacgtgcacgctcggttggttttacgtacgaaccggtcggattgttcgggttgatgagcaccaatgctctgatgcgttcgccaccgggctcgctgagcagccgctcgagttcggcgatgtcgatgaaccaggagccgtcgaattgcaactggtattcgaccgtgtcaacgcattcaagccgtgcaatcgactcaatcagcggatagccgggtttgggtgccagcaccgcgtcgccggcatcgcaaagtaacttaatcagccacgaatacgcctcggacgtggagctcagcaagtacagggcgtccgggtcaacgccctcgatggcggtattcgcattgttgaaagcggcatggcgctcgttcccgccctcgctggcggcgggcgaagtcgactgagggctgcttgcgtctaccgcctttgccgtattgaggaatgcggccaatgcttctcgcgccgcacgcggtccacgcgggtcggccgtatacacgctcggcaccaattcaggtgccagcccgtggcgggtcggattggaatcgttgagtttgctgagtgcgatgccgtttgccttggctgccgcctcggccgccgcaatgggattcggcgcagaaatatccacacgagaagagaaatgcacgctcataccctcccacgatagagcgtggtgccccctgccccgctctcaaacgcgcaacattcccggaaatgcgtcgctctggacccgaatcacaccctcaaacgcgacacattcccgggaacgcgtcgccacagacctccatacacacgcccactttgcgcaacattcccgggaacgcgtcgcatacctttcctatgcaatgcaaaaggccgcccgactagtcggacggcctgaagcatattcgcgggtcagcgctgcacacccacgctcactggctcactgctgcttggtgctggcatagtaggcggcaccgacgatgccggcctggttacgcagcttggcgggcacgatcggggtcttgatatccacgtacggcaggaacttttcgctctgacggctcacgccgccgccgacggtgaacaggtccgggttgaagtacttctccataaggccgtagtacttggtcagacgcttggcccacttcttgtagcccagttcctcattctcgcgaatcgcggaggaggcatacttctcggcgtccagatgcttggcgctcaggatgatgtgtccgagttcggtgttcgggatgagcacgccgttgtaaatcaaggcggtgccgatgccggtgcccagtgtggtggcgatgaccagaccatcctggcccttggcggcaccgaactggacttcggccaggccggcggcgtcggcgtcgtttaccacgacgaccgggcggccgcaggcttcggagaacacttcagtaacgtccacgccaatccaagactggtcaaggttggccatgaagtcgagcttctggccgggcttgatcggcgcggggaaagcgatgccaacgggtgcggattcaggcacttcgaagtggtcgagctgctgcttgacgattttggccacggcctgaggagtggagacctcgggagtgagaatcttcaatcgtggctcggcgaaatcgcccttggtcagatcgacaggtgcggccttgatgccggaaccgccaatgtcaacaccgaaagcctgtgcagtttcaatcatcgttgaccttcctttccatacgttttcatcagttcgtaaggttgcgcccagtttaacgcgaattacgctcaacacgaaaccattacacaccaattgtgcaaacgtgtgcatcgtcgccggtcactacgtaccctattcgtatcgtttttcaagcctgacaatgggcaatgcatgcgatttcgcatactaggaaaaatcggcgtctatggtggcctgactctgtgtcgcgcgcgataatgggaggtatggcagaacatacccaacttattgatgcaattaacatccgcaccgccgtacgcgcctacgatgatgagccgatcgacgacgatacggcccgccagctcgagatggcgcttcagccgatcaacttactcggcgatctcaacattcagctggtgcgcgaccagcccaaggtgttcgccgaagccaatgcttcaggtcatctgaccaatgcggcgaattatctggccatcgtcggccccgcgaacgatgaggaagccaaagagcgtgccggcttctatgccgaacgcatggtgctcacggccacgttgcgcggcctcggcaccttatgggtcgccggctcatgggacaaggcggaggcggccaagcattgccgcgtcacctctggccaggagctgtatctcggtgtggtgatcgggcatccgaagaatcatctggattatcaggcgaaatcctatgaggagctatgcgaagcgcaacgcacgcaccgcgccaccaagacctatgagcagttcaccgccacaatgagcgatgaggggcgcgaggccgctccggattggttcaagtccggcgtcgaggctgcgatgaaggcgccgagcgcgatgaaccgtcagccaatcaccttctcgtataatccggccgacgataccgccgccgcgcatatcgatcagagtgcggaagatgagcatcacgcgttcaatgacatgggcatcgccaagctgcacttccagatcggtgccggccaaggccagtgggcttggggcgacggtggcctgttcatccataagtaacctgtagtgacccccctcatagaggggagccactactacggctacttcagcgacggcatgagcttccaggtggggtcgtgcatcagcttgcgcgagtcccaccagcccttggcaatctgtaccaaaccggtcttgaggtgctcgcgatccaccatcaccaggcgaatgacttccttggccgcggtgagcacggtacccagtccaaacaccagcggacggaagtcaccataggtcatgaagtaccgggccatgtatccgcggttgcgcatgatgtgataccggttcatgtcggatgtggagttgagctggcgcacgccggcgatatcccaattgccgatttcgcgcgtacggcgcaggatcacgtcgggcaccacaatcgggttggtgaccttgctggcgcggtagccatacatcgtgtcatcccagtagatgaagaagcgcgggtccggcagaccgatttccgtaaccacacggcggttgaacaggccgccttcgaagcacagcgtgtccatcactcggtatccggccgggccgaatgcggcgggcgcaatcgggttcgggatgcccagcggcacaatgaagtcgtactgccagtagaacgggccgccatcgtagtcgaatcgggagccctgaatcacctcgtgcttgtcggtccacttggacagcttggcaatggcgtccggcagcacggccacatcgtcatccatcacccagaaccatgcggcacccagctcgtaggctttggccacgccggcggagaaaccgcccgcaccacccaggttctcggtctgcggcgcatagaccacacgttcttcgttaccggactggtcggccacggtggtgccccattggccggtcaccttgccggcaaacgcagcgaccatgtccgccgtctgatcggactgctcattgtccacgatgacaatgcgccacggtgcctgttcaagcgccagaatcgaatcgaacagtgtctcaagcaactgctgacgtttgtaggtggtgacgatcagggcaagcttgtcgatggtgttgttgggtttcttcacttcagccatggctcccattgttgcacttgaccggcacaagacgaatttctgcacagtgaaacgcgggttgcatacgtccggcgcatggcgtatgaataagcctgtcagtttcagggaaggtgcaattccttactggcggtaacctgcaccccgggtttcataacggggatggcaggaagcccgcgacccgcgcaagcggctgatccggtgagattccggagccaacggtatagtccggatggaagaaacgagggctcattatgagtgtatcttcgcgtattcgcatgcaagttgttcgttctgtggcacccgaggccgagggttcggccagcacgtccaccgccagcaccagcgccaaacttggctcacacaccactggtgtggccgattctggccgctggtccacgcgccgtatcgccatgtatgcactgttcgtggcgctggcgatggtcaccagcttcattgaattcccgattacgccggtcacttggctgaagtacgacccgtccggcatcgtctgcctgattgccggctttgcgtatggcccggccgccgccgcaatcgtgtctgtgctcggctttgtgccgcacatgttcgccaatccgtggggttcgctgatggctgtgctggtggcgctgttcctgtctgtgccggccgcgttcatctaccgtaagatccgtacgcgcaagggtgccgccatcggcattctggtgggtgcggtgctggccatcgtggtggcgctggtgagcaacctgattgtcacgccgatttacgcgcacatgacctaccaagctgtggccgcgatgattctgccgattctgctgccgttcaacgtggctaagatggcgattcacgccgtgatcaccttcctgatctacaagccgatctccaacctgctgtccaagcagcagtgactggcctgagacgggccgatgcccgccacgactaacgaccactcaaagaccactcaaagaaccagaacgcagaatcccggcacgggccgggattctgcgttttcgcctatcagttacggattgctgtttcatgaccgttgcaccccattccttcgacgccgacgagttccacgattctgccgaacctcacgcttccgccgagcctgcctcccccgccgccgtgctcaaggacattcgtttcagctatgaccgcggcacctcatgggctttggatggcgtttcactcacggtccatgccggcgagcgcctatgcttggtcggtccgaacgggtcgggcaaatccacgttagcccgtctgattgcgggattgaccgcgccggacggtggtgaagtgacgttactggggcaacgcgtgtacgcagccggcccgaatgccgatgcctatcgtgctgcccgccacggcatcggtatggtgttccagaatcccgaggatcagctggtcaccaccgtgttggaggatgacgtggcctttggcccggagaatctcgggctggagcgcgagctcatcggcgagcgtatcgttgattcattgcaggccgtggggttggcgaacttacgccagtccgacccgacccgtatgagcggcgggcagcagcaacgcgcctccatcgccggcatgctggccatgaacccggcaatgctggtattggatgagccgaccgccatgctggacgaatccgcacgcgccgaagttatgcgcattttggatgatttgcaggcgcgcggcaccactattgtgcatgtcacgcatcatccagatgaaaccgttcatgccgatcgcatcgtgcacatggaggccgggcgaatcattggtatcactgcagccgtcgataatcgatccccgctagcggaggctgtctcgcaaagcgagactgagggtagtatcggcacagaagccgcccccagtcgccctacgaacgacagcccccgccagcgggagcgcgaagacggctccgaactgccgctgctctccgatggcatcggtgatatgacgaaccccattattcgcgtctcgcatctgacctatcgctatccttcggccaaacgggcggttatcgatgacctgtcgttcaccatcgcgcgcggtgaaaccgtggcactgatgggcgtgaatggttcgggcaagtcgacgctggtgcgcatgttgtgtgcactgactgcgccgaccgccggcagcatcgaagtggccggtgttccggtggcctcgaccggcaagcgcggtcgcaacgtgcgcccgaagtcggcgaatcgcaagcaattagcgcaattgcgccggcatgtgggttacgtgatgcagcatccagagcatcagctgttcgctgacacggtagccgaggacgtggcgtacggcccacgcaaccaagggcttggcgagaccgaggtagccgaccgcgtgcgcgaatcactggaactgctgcatatcgggcatcttgccgaccgctcccccttcgacctgtccggcgggcaacaacgattggcagccattgccggcgtgctggcttgcaatcctgacgtgctcatcatggacgagccgaccgcgagtctggacgcccaagccaagaagcgtatccatgagctgttgcgcacgctcaaatcgcgtggcgtgaccgtgctcatcatcacccatgaccgggaggaggccgagcaaatcgccgaccgcgtggtccgtatgccgattgccgcccccgcatccggcggccccgtcacggccaccgtcaccgagccggccgtatcctccaacggccctgcgcactcagtgatacaccgacttgacccgcgcgtgaagatggtgggcttcctggccgccatgttcacgatgttcgcggtgaacacgccaacccagctcgcgctgggcatcgccatcaccctggccgttatcgcggcggcacgcctgaacccgttacgggtgcttgaatccattcatccgattctgatcctgctggtgctgatgggcgtggtcaatctgtttgtggtacgcaccggcacgccggtggtggcgcttggcccgctaagcatcaccgatcagggcgtgaccatagccgtgctgtacgcctgccgtttcgcattggtaatcattctgggcgcggtgttcctcactaccaccacgcctaccgccatgaccgacgccttcgccaccttgatcagtccgctcaaccggctcggtatccatgcccaagaaatcgcgctggtcatgagtctggcattgcgattcattccaacgctgaccgacgaaacccgcgccatcgtcgacgcccaatccgcgcgtggcggttccatcgaaaccggttcactggcccagcgcatcaaggcgatgagcgcgattatcgtgccgattttcgccggcacgttgcgtcacgcggacaacctgagcctcgcacttgacgcccgctgctacgaggagggcatccgccgcacccactggcgtgccctgaccatcgccgcgcgagatctcatattcgccgctgccgtcatcatctacatcgcggccatcatcgcgctgtagggcggcaaacagcgcagacagcaccggttgctatgctggtgtggttatacgaaagatgtaaggaaattcccatggcattgaccaagaagcaaatcaagcagctgcgcgcgatggcgaactcgctgaagcccctgttctatgtgggcaagaacgatttgaccgagtcggccgtcaatcaggccgatgagaccattgagaagcacgagctcatcaagtgcgccgtgcaggacggttctggcctgaccgccaaggaagccgccgccgagcttgccgagcagctgaacgccgaagtggtgcagtccatcggcaatcgtttcgtgctgttccgtcgctcccggcgcgacgatgtggagcatatccgcttggtgcgcgagtaatgttcgccccgctcgatcccgtagcttgatatgagtaatggcggttgggatcagtcccattccaaccccccttactcatattttccccccgagaaccgccaccgctacaaaaaggacacgaccaatcccccaaccaaaggcaggaccaaagacaccccacaccaccaccacaaaccacgaaagaaaacaccccccccccaaatatacaggcggcggcaccgatgcctatcacatcaccgggaaacgatgacgacaccggggaaaaccatcagcccacactacggaaaaacactgccgaacctgtcgaacaaacattgaagcaaaacatgcaggcgccggaacaggccatcgcgtgggcgcgcgcccacggcgggacggaggggtgcgtgcaccattccggccacggctcgcagtatataagcctggtgtattccacgcgcgtggaggaatacgggatgctgccgtcgaccggcacggtcggcgactcctacgacaacgcgctggccgaacgcacgaacaacacgtacaagcgcgagctgatttggatcaacaggccgtaccggacggtcggcgagctggaatacgcgaccatgaggttcgtctcgtggtacaactcgaaacgactgcacgcctccctgggctacaggacaccggaacaggccgagaacgagtattatcagaaacaggcggcacaaaccgtctcacaatagaggcggaacaaaaatcaggccacttcagccgccccgctttgttatactgagcaccatccacaacacaaataaaggaaacagacttgactctgcaggctacgcctcttgtatcgattatcataccggtctataacgccgaaaaatatctccgatactgtgttgattccattcttcagcagtcatacaccaatcttgaagttattcttgtggacgatggagctaaagattcatccccatccatttgtgacgactatgcacaatccgattccagagtaacagtaattcaccaacccaatgggggcatcgcgaaagcgcaaaacaccgggctcgacgcagctcacggtgattacatcgcgttcgccgacaacgacgatatcctcgacagccgtaacatcgagctactgttgcacgcattgaaatcaacagacgctgacatgagtaaaggacgctggcgtcaattcggcgtctcgcaattaccgaccatctgtaatgaagccgctcagggcgctgacgaaccacaccacattaacgtatttcgtaacccgctacgggcttatcaatccatattctgcaaaagtctgagaattatcggagaacgtttcggtcgtcatactgaggcgcggtatttcaacgaagcaaactggtgcaggctctacaaacgcgagctgtgggacggactgcgattccccgtcggtcattatgcacaagacatccgcatggctggccccttatactctcgtatgtataaagtcgccgatgttgatgcgactttgtactactggcttcaggaacccgactcagtcacgcactcaaaacgcaccccgacattttggcacgataatgtactttccgcagcggagaacttccagttcacccttaatcagggaatagtgccataccgcaattacttcggattgactgcgagtgtccgtgatgaaggacgcgggctgcatcatgcgaacagcagcacaggctctgctcaggcccagttcactatctcagccgaagatataaagaactaccaggacgacgttcaaaacatgaaatctcttattcgacggctggccccgtcacaaaggttcctctgcaagatactgtacttcatccgatcaggagaaaatcttatttacaaccgtcgaatccattccatgaaatgacccaaacgcgcgctcactctggttatggatacacctcttttgtgaagaaaaacatgctggtattcgcaaaatgtcatacttacatgccccgctggtacactctgtaggtatggttgaaagaatactggtcactggagccggcggttatatcggtaggcatgtcgtcaaggcgctgcttgatgatggacaagacgtcatcgcctcggatctccgcttgaacgatgttgatgatcgtgcggaacacatagagaccaatctgtttgaatctggtagcgatatctattccaagcttggaaagccggatgtctgcctgcatatggcttggcgcgacggcttcaagcacaactccgacaatcacatgggtgatttatccgcccattatcgattcatcaagaacatgttggacggaggtctgcctcaaatcgcggttatgggaactatgcacgaagtcggatactgggagggtgccattgatgagcacaccccttgtcatccggcttccatgtacggcatcgcaaaaaatgccctacgtgaggccacgcttatgctcgcacaagaacacaatgcagccgtgcaatggctccgcgcatattacatcgtcggagacgatctacgcggtagttccatcttttccaaactgctgcaagccgcacatgatggcaagccgtccttccccttcacgacgggtaaaaataagtacgactttatcaatgtcgacgaacttgcacggcaaataagcgcagcggtttcccaacgagaggtgaccggtatcatcaactgttgcactggaaagcctatatccttggctgagcgcgttgagcaatacatcaaagacaatgatctcaacatcacactggattatggggcgttccccgatcgtccctatgattcccccggcgtatggggtgacgcgaccaagattcacgagattctagcgacacgatagatcaacaaaacatatgggttggggcggattccatcgcgatggaatccgccccaacccatatctgctattagcagcaactcattgagtactacttctcaaccttttggaacatccgcgatacatacgccactactgcatccgtcacgcgcaaaagtatccaagacaagaccgcaataatcaacatatccgccacgaatagtaggtaggcattggatacgccgaggctgtcgggattgacaatggtgtacacctgcatgatgacttgatgatggactaagaaaatcgcataggaatatttcgatagtgaacctatagccactcgaacgggttgacggtcgaaccactgcgagatccacactaggaacaggaagaaggccacacccaccagtgtgaccgccacgtcgcctttcaggatatcggtagactgctgtactgcgagaagcactaccgcagctgcacccaccacatggggcacttttttgataaagcggacaaaatacatcccgaaggcaagttccggcaaccgggtggtcagtaacaaatcagatggcataccttgcgagtccggatacaacacaatcgtcagcacatacaatatcgcgatgataacgccggtaatccaaggatgacgcttcaccccataccgcagcaaagggaatatgatatagaacagcagaataaatcccaggaaccattcgccaagtgtatagaacgtcggtattccggcattagccagataaccatccattccaatcacggagagcagcacactatatttcggtgcctgtgccgcgacgataccgccctggcgtaagaacaggtacacatttgccgcaatgaaagcaatccagaacatggggaagattgatttgcatcgcttccaatagaacctctttagatccagcttctccgcatcctcatgcgaatacatcaatgcagcgccggaaataatgaggaactgagagacaccaagcgaaccgatgtaaataccgaacggagaattcgcaaaaattgggtgttccactaaatatggattattgaaatgcgtgataacaatcaatatcgcagacagtccacgtacccaatctaggtagaatagtctcggcttacgcttcgtgacattaccagtcatgttactcatcctcgtttatgcccaattgcttacgatgcaacttcaccaacgccggtcccagcaccggaacatgtttagtgacgttcttcatcactcgcagtaatgtgttacggaatcgctttccttcagcgatggcaatgcaagtttgctgcaagtcctcacgaatccatggcacagtgatgccctttaccacttctcgcaactcatatgagagattcgtaatctcgatacgtgcataacgatccgagaaaatatacgctgggtaatatccattggcctgtggcacatatccataggcccgctcaatgaagtgtaataacgtaccatctaccttattgggctccggcggaaagtccgtgtattcccatccatggtccagtaagccacgaaatgcttccggacggaaccagaacatagtgcccatcggtgccaccggttctttgtcggcattcaacggaacgtgcatattcagtgtctgttccaagaagtccttggtaccggggaaattcggtccccatgggaacgtgtaccccgggaaatagctggcatggttcggaggagtcggcatagcgatgccgaggcgcggattcctctcgaacaagtcgataacgttggaaacatactccttgctggcaagaatgttctcaaagcacttatacgcgaacccatcaccgatactctgaggagacagctgcgtaaccttcttgtcgtgggcaaaacaaacgtaatcgtactggaacaggtcttccccgcaaccaaccagcagggcactgacatcacgtcctctgttctcaatcaccctgacatcgaagttatatgggaactgcttgcagtattcacgcacagtttccgcgttggcttcggagccaaccgtaatgatgatgtcacagccttcgggcatcgactggatgtagtggaatgtggactccagcaaatccatgtaataaacatgaattgcaagtgctattttcttgccttccggcagaggaacgctcagcgattgcggcaatacataatcaagatgcaggttcttcatcaaatcagcgacgttcatcgtgcgaagcgcgttctgccagatcaagtccacgtcatagtcggtgtggtcccgcaaatattcatataagtccagagcagcgttgcctacggtctgggtcatcacatcacgatacccgtggaagaacgagcgacgtttgaaaatcgggcaacgcttttctgcgaccagtcgtttcgccgcataggtaatggggccgtacgtgaacccttccaagtcggacgtatcgacatatacatcccacttgaaacccttatcggcaaaacgcttggtaaacagggattcatgcaggcccacagaatcgtaatagtcattgatgggaggaatgttatcccagtaatccctgaacgcctggctcgtgtgcaaacttttgcgatatgcatggaaatgcgactgaatgtgttccggaaggtaggggtatgggctacggccaaacggatcatgctcgacacgatggaatttggtgatgccccagaaatccaaatcccgcttgttcattgcttcgaacatttcagagaacggatacaccggtcccatgatggtggcgttgaataatacaatctcatcgaattgttccagcttttgccagccgtaactgtccaaagcggttttgtatgcccatacatcaaaacccttgttctctcgcacaatcagcttactggtgtaccgcagcagtttctcgcgcccggcatcattcaactttccattgcatacaatggtcagggcagagaagtgcggcatgaaaccgtcaagcagcttcagcacatagtcgtccacaaccccctgagcgtcgtaaaagaagaaaattcccagacgattgataggcgtatcagacgtaagaatcatggattgctctattcctcttccaaatgaagtaaacagacacgaggatatcatatgggcccgttatcattactggcatccgtccctcagccagtatgatgaatactgattagctgtaccgtatctggatactggaggaatgatgggtagaatagcgctatgcggggtcttcgatattcccaactacggggaccatctcttccccctagtattgcgcgaagagctctcgcgccgaggatacgccggtaacgtggtgttgttctcaccgttccaagctgaggaaagcttcgtggagaactctaacgtccactcgcttgacgatctcgaacgtatgcatatggaagaaccattttccgcaatcgttgtgggcggaggggagattatccactggcatcgctttgggcaaaaacgcaccttcaacagtaccgattttgaggcttatcctatggataaggtctggctcgtcccttgcttcatgaagatgaagtataatgttccactactgtggaatgcgcccggcattccttttgacttcgatgcggacaaggccctcgcccactacctgttcagtaatatagactatctgagcgtccgcaatgatttctccaagcaggtgctgattgactgcggtataccggatgcagccattcaacgcgtgccggatactggtttctctttgaagaatgtcgccaccgaccaagaactccacgatgcgcgcaaccacgtgttccccggattagcgcattatgcggtgttccactgcaaccgctttatcccggaatccgaaatcaacaatgtcgtggccacgctcaaggaattgcatgacgatggacatgaaatcgtgctgctgccgctggcctatacccatggcgatgaggatatcctccacaccatccacgatgcctgcccattcccctgcctcataccccaacacccgctctctttactggagatcatcggcatcctgtcagattgcgaaatctatgtgggtacaagcctgcatggatccgtaactgcgtccgtattcggccgtaagacggtgagcttcgattaccagcagactaagaagacacgagacctgtaccaccaacttggacgtgacgctttctatgtcactgatggcaatcagcttgcagaaaccgtatcggatgctctgcaaacgcaacaaccggttgatttcttcgatacccaacaacaactcaatcagcatttcgacaaactattcgcactgattacacaggggaacatcgtcactcctaatccttcctcgcaggccacacaattctcggacctggtgcagaaatgctttgatgcagaatatcgatccatcggattgtcacaacgaatcgacgaactggacacggcattggagaaaaacgaaggattcgtgaattacttcaaaccgcgagccgagtatttcgagagcgagttgaacaaacagctgaatcgagtacacgaacttgaggagctccaacagcacccggtgaaaataatattgcagaacatcaagcataagtgaggaacgccaagtgacagcatcaatcaacatggatacaactacaacgactcagagtatcagccaaaatgataatttctcattgactagttactcattacaaggatttttgcaatttcttatgcataattctaagcaaataattatctccatgttgttccttctgcttgcatttggacagaagctttttagcaacactttttccattgatacacagggcatcatccaaaacaatgatgcactctataaatcatggtttgaacttgaacgtttcggcctagtgctgtttaaaaagctgaccggcacctatctctataacaatgcgttagcttcattcaccatggtggtgttctttggcatttccgctatggtatgggcatatctcctatgctcagcttctcatgccacaaagctgcaaccggcatttttcatgattccttatgtcgcttcgcctattttcgccgagatgttgggatttttgctactcggtccggaaatttccatcgctgccacactaactgcgatatctctcatgatgtgggccaatgcagcagccagcaacagtgcaaaacggcgtattttgctagtcatagtctccgttgtgtgcgccacaatcgcgttcacgatgtatcttgccatggtcacgatttttattaccggcactgccatgctctatatattgcagtttggcaatcgtgctcagtgggatgaacggaaaaagtcctcttggatttttttggtgggaagcatactcatcttcggcgcatcgtaccttgcatacaagatactcaatgaaatcgcaatgcatcttgctggcgtgacgaccagcgcctacatatccgatcaatctcgctggggaaaagattcgttcggcacgataatccgcaacatcggtcaccatgcacaagagttgtattccggctccggcatcttttatagtgcactgttttccattgccgcaatagtctttgcagttgtggcagtcgcatgctccattcgcaagcgtatttcggttctcgcagttttggtttctatactgctgcttctcgctccgatgattatgtctgtggtactgggtaccgccccatcagtacgcacagaaatgacctatcctctggcgtttgccttcatgctcatgatgttactctccagattatcgcgcaacacagttcaacaagcaatagcgtggatcctcatcactattgttggatggaaccaagccctcattaccagcagaattttctacaccgaaaatatcgtattcaatcaagatgtgctcaccgtgcaagccattaagaacgacatcgataagctgggactgggcgaatcccccaagcaaccggttgtctttatcggcaatcacacggcaaaatgcaatgatgattgtttcacgccagaacaactaggaaccgctctgacgggccgttccatgttggaaatcggattttccactgagcacggtactggcgtgaagcaacaattcataattgatgtactcggggtccactataacggtgcaacgccccagcaaatgaaacaaagcgaaacattggctgaatcaatgcctcactggcccgatccaggaagcgtggcagaaaaagacggcatcattatcgtcaatttctgatcaaccctgaatttcagattttggtttatcgacgcactcaccgcgttcaccgtgctcatcatcgtctgacggcctcgatgcacgcagctccttaatcacgtaaacggtgaatattacggataagaccacatctaggaacgatagtgtcttgaatagcgtattgaaccaaaactgagaaacttcagatatgagtccggcatggtatgccatcacctcattgaggaaggtcaatgcggtgaacgcgagaagatagagcctatccggcaatttattgccgacacaaacggcgataagcagaaacgcgataacaggaatctgatagcgctcatgctgctgagtcgagatgatgaatactgtgttataaaataggcaaaccaataacgtcagaatccgaacgtccagacaacctactgttctcttaatgtaggcaatcagaatggcagtgataagggcacagataagaataatggcaatgttgattttcccggcatcgaggccaaacgggaaatcaacctcttgaagattgacaccaaagcgaacgaagattccccaagtattaaaggcactgagattcaggaaagggtacttccccgatcctccgaggtaaatgcgcagaggaaggctaggaccgcttacaaccataaaaggcaaccatcctaaaagcccgattgccagtccttcaagcgttgcgatcacaatcttccgtaatgggtagaacagtatcacgattgccgcaaagggaaatatgaaataacagaattgaagtttcgtcagacaaccgattgcatagaaggcagaagcccaatagatacgtttcgtcgataccgaataaaagcagaggaaaagcagcagtacgagcaatccgtcgaattggccccaaatggctgcattaaatagcagtgtaggactaaaggtggcgacaacgacagccaaggctttatccatatcggacagtggctgtttcttatcgacaattacatagaccgcaatccccagtatcagattgaatgcaatggggaaaagtttcataaggagaaatgtggaagcgcttgccgagaaatattggagcaccggagtaatcagtctaaaaagtaccggaaccagtggagggtaatccaaggaagggattgaatataaatggaatatattgtcgatcggtgtggttgcccatacatagttgaatgtcattacatcggcaacaccctgatttgagaatgccaacacgacttggaacagccctgaaaagaccaaggaaaaaatcagaatcatgagcagtccgtctactggctgtcttttctttgaaatatgtttcatgcgcttccccttaacggtatctcaatcacagtaatgatttagaagttgactatgacgacgccatctttttccgcaacacttcctggatcaggccagtgaggcattacggaagcatcttgttcgctctgacgtatttgtttattggttggctggttataatgcacgcccagcaccgcaatcatgaactgtttcttgactcctgtgccatgcttagtggaaaaacccacttcgagcagagaacgacctgtgagaccgagttgatcagccggataacaatccggattgcccttggcaacgtgattcccgacgaaaacaactggctctttaggtcgctctccaagacccaattcatctatacgggactttattgcttgtacggtaagcacatcttggttgaagacaacattttctgtgtagaagattctgctcgttatcaatgcctgattccatccaatagcgataatcagaatccaagcaacaattgtgacggcttcgacacgtatggactgcacgtttcttcgtatattgaaaacgataccggagaataaaaccattgtgatgaacgagaaggccagcggatatgtcatttccgtacgaactgagggaatccctcccagtacgaatgacatgatcgtgggagacagcacaatgaggagtactacgaggcaggagaagagcgatattttcttagttatgacatgatatatcgccgtgacaaacacacatagtgcgcaaatggagaatataacgctatagaagataccttctcctgagtataacgccagcacatgcgagcctatgttatgcaatataacgctggacgaatccttaccccaacgcgattggtcgctgatgtatgcattggtcgtcactcctttgaccttcatcgccaaagcgttgagcagcttatacaatgcatatgaaataacgaagataatcacactaccaataagaaatacacgggattcgttcttgtcgtgattctgatatttgctgtcactgtatctcaggacatagagtatggccgttccggtgatgaaaaacgtgaccatagctagatacatggtaaatgaaagcgtggcacatacgattgaggttacaatcaacaacgctgatagttttttgggtctatttgcgttactccacaacattaaggacaacgcaactaagaaactcgccacagatatttcagggccgagcaacagaaaaccgagcatttccgcaaaaataggagaagccacataaggtatcataaagaatgccggttgaagctttgccttggtggtggatccacaaagcaaatacgaccatattaccgctgagatcccaaagaagaccaccatggtgaatgatgccagtgcattattgaactggtaggttccactcagtttcttgaaaactactagcccaaatcgttccagctcgaaccacgatttatacagcgaatcttcattttggatgattccctgtgtatcaatcgagaaggtattgctaaaaagtttttgtccgaatgcgagtaacaagaatagcacggaaacgatgagctgccctgcatagtgcttactgaattgcaacaatccgcacacggaatatacagtcttttcctctgcggtagaggtctctgttgccagtgacatcaacggtctcctcccggtatcttgaagtacctccttagctcaagtatcgtcaaacgctaagaccggcacttgcaattcgattgttcgcagttttggaaacaacggcacgaaattcatccaggcacggaaaagcctcgtcattccccgtaatatcggcaatgccacttacagcattgtttcaatgtgataccttgggcaatgcttggactccagatagattttacctacacattcgccaacaatgcccaatgaaatcataatgaagccaccgataagccatatcgaacacatcagtgacccccatccggccatcgcatgccccaccgttaatgacaccatgacatagacgaatatgacgattccgaccaagaccgataatgccccccacaccagtcacgaaacttaacggctttgtcgagaacgaggtgatgccctgaatggcaaaggaaatcatttttttcgacgcaacaaggagatcaaacttatgatgaagaacttcggctgtatggcgcaatccttcggcctcgttgtaacaaggcaacacgaaatacacaataggctcgtcacggttttcctcatgtatcgccaattgctcagcatattcagtagacaacgccatatcgctccagactcctagccaaccatactctcacggcgactttgtaatacaataaccttcactgacctactactatcagttatctattgccgtaaactgtattgcacggtcactcagcacaccctgttcgccattccggtcatttctgatggcaaagtaatagctattgtcatcattcgtgaacgccaggaactcgggcttttcggcatcctcatcggtctgtgcacgcaacgtagcgaaaattcgatattcaccattgttgaacatatccagtggaatcgaatatttcactgtatggtggccgggtacgattggcatgcccttgcactccgtttgcgtgtcgacgtcataaacttgtccgcttctacgggaatcctgcagaacaattcccaaataagcagggatatcctcgttaaactcatactcaatagagaattcaagaggcgtcttgccatccacaacctttggcccatcactggtcacgttgagaatcggcacccgagaattcaacccgttaggatgaacgtatttcttttctcccttggtcttgaagaaatcattgttctgagcattttccaagctgtactggtctgccacattacgaggttcaccagaacaaacgatctccccatcgcttatcagtatagctttgttgcaatacttcttcatcgaatccatgctgtgtgtgaccaggatgaccgttttcgttggatcttccttcacactcttgaagaaagcatcgcacttcttctgaaatgcagcatcaccgaccgctaacacctcatcaagcaccagtatgtctccttgagccttaatggcgaccgagaatgcgagtcttacctgcataccactggaatagttcttcagcttctggtccataaactcgccaagctcggcaaactcaacgatatcgtcgtacatcgcatcgatttccgaacggctgaagcctagcaacgcaccgttcagatacacattctcacgaccggtcagctcaggattgaacccaacaccaagttcgatgaatggtaccagcttgccacgaacatccacggttccctgctcgggcacataaatctgggagataatcttcaataaagtagatttaccggagccatttcggccaacaatgccgaaaaaatcacctcgtcggacatcgaacgtaatgtctcgcaacacatgctgctcggtgtaccctttgattcccttcgtccagttcaggaatgccatcttcaaaccacttgcttgctcggtcggcaaccggaatgacttggctacatgcttgacgctaagaacaactgggctctgacgctccagactcacttcataatcacttttcattgcttacagcacctccgcaaacttggcattgtgcttgcggaatacatgcacacccaccatcaggattaccaaggtcaacacatacggtacgaatggtagccacctgctgttgatatatgtccacactgtcggcacatattccggtgacagcaaattatgacgaatgtccataatgacctgggtactaggattcaacatcaggaacttagaagcccacgcaaaatctggtgcccgctgggcaatcatgctaatcggatagataattggcgtggcatagaacatagcttgcatcagcacttcccaaatgtgggccacatcgcggaagtagacatacaacgtgctcagaatcagagatatccctaatgccaacaaatacaactgcaatatgttaaatggcaccaacagaatacgccacgtataatgcgcgtgggcaaagaaaccaaagcatatgaccaccaccatgttaatgccaagggaaatcatggaccccatggtgttggatgctacgataatgtagttcgggaaatgcaccttacgcaataagtctccgcgatcaacgatgccgcgcataccaacggtggtggcctccgtgaagaaagaccacaagcaagtaccacacagcagggaaatcggaaacgttggggtgccatcagagaatttcaggaaccggacgaacaccacatacattacggcaaatagcatgagcggtttcaataccgaccacgccatgcccaaaaacgagccctggtaccgaagctggaaatcagttttcaccagctcctgaaataccactaatgaatagcggtacttgttcctcacccactgcacaagtttcttcataaacatccaattctagcaagaggcgtatcggcaccagccttggctagcgcaacacccagcttacgctcgtgttccagttttaatagctgctctagaaatctgaagctatgccacctgttccgtgcaatatgtccatccttgtgaagaactcattcttattaaggcatcagaatgctaacatagtactcactgacggctaccatatacactatgactcaagaagtgtttaccccgaaaaacatcattgtgaccggtggctgtggcttcatcggctctaattttgtccactatgtatataacaaccatccggatgtgcacatcacggtgttggacgcactgacatacgccggcaaccttgacaacatcaagtcattgctcggcgaccgcgttgattttgtgcatggcaacatttgcgacgccgagctactggacaagctggtacccggacacgatgcgatcgtgcattacgccgccgagtcgcataacgacaactcaatcgccaacccggagccgttcctgaaaaccaatgtggagggcacgttccgcctgctggaagcggcgcgtaaatacgatgtgcgttatcaccacgtcagcaccgatgaggtctatggtgaccttgcccttgacgaccctcataaattcaccgaggaaacgccctaccacccttctagcccctattcctccacgaaggccagttcggatttgctggtccgtgcatggcaccgcacctttggtgtgcgcatgaccatctccaactgctccaacaactatggtccatatcaacacgtggaaaagttcattccgcgacaaatcaccaatattctggaaggtatacgtcccaagctgtatggtgacggactgaacgtccgtgactggattcacaccgatgatcactcatccgccgtgtggaccatcctcaccaagggtgttttgggagagacctaccttatcggtgccaacggtgagcggaacaatatcaccgtgctgaaggacattcttgaagtcatgggcaaatcccccgatgatttcgatcacgtcaaggatcgtccgggacatgatcgccgttatgcaatcgactctaccaagctccagactgaactcggctggaagccatgtcacaccaatttccaaagcggtctagaacacaccatcaagtggtacaccgacaatcgtgattggtgggagcccgtcaaagctgcaacggaagcaaagtacaagcagcaggggcagtgagcttgttaccgcttgggaaaacgtattggaatcgataagaaagacggaataaatgtcattggaattcgaaaaggaactcaaggtcaccaagaccaatattcctggcctgctggtatttgacttaccggttcacggagataaccgtggatggttcaaggaaaattggcagcgcgcaaagatgacagctctgggacttcctgacttcggtcctgtgcagaacaacattagtttcaatgccaaaaaaggtgtaacgcgcggtatccatgctgagccgtgggacaaatacatctctatcgcaaccggtgagattttcggcgcttgggtagatctgcgccccggcgacagcttcggccaggtcttcaccacccgtctagaccccagcaaggcaatatatgtgccgcgtggagtcggcaatagcttccaggcgttgcaggatggcaccgcttacacctatctggttaacgcccattggagcctcgaacagaagaagacctacacgttcgtcaatctcgctgatccggagctcaacattcagtggcctattccactggtagattccgagcgctcggaggctgacctgcatcatccaatgctgaaagatgccaagcctatggcgcctaagcgcaccatggtattcggcagtaacggcaaactgggccgcgctatccgccgctatgcggaaagccatggcctacacggatttgaatatcacgacaccgatacgttcgatatcgccgatgctaaagcctacgccgccattaactgggacttgtatggcaccatcatcaatgctgcggcattcaccgccgtcgatgaagcggaaacgccgggaggtcgcaaaaatgcatggagaaccaacgttcagggtgtcaagaatctcgcccgcatcgctactgagcatcgcatcacgctagtgcatatctccagtgattacgtattcgatggtaccaaggagctacacaccgaggatgaggaatttgctccgctcggcgtatacggacagaccaaggccgcaggtgacgctctcgtagagaatgtaccccaacactatctgcttcgttccagctgggtgattggagagggacgcaacttcgtgacccgtatgctgggactggctcagaaccacgcccatgccgaggcaccttccgatcagtttggacgcctgacctttactgatgacatggctaacgctatcttccatctgctcgatggcggtgcctcgtatggcacatataacatgaccggttccggacgcatcgcaagctggtatgacattgcacgactcgtcttccaaactgctggagtcgatcccgataccatcaccgctaactccgtagctgagtatgcccgtgaacaccatgctgccatgcgtccgcagaattgctcgctggatctcagcaaactggaagctaccggatatcaccctcaggattgggagcaatctctcacgacttatttggcaaaggagcttgagcagcgatgaaaggcattattctggccgggggatccggcacacgcctatacccccttaccacggttacttccaagcagttattgccggtgtatgacaagccgatgatttattatccgcttagcgtactgatgatggcaggtattcgtgatatcctcatcatttccacgcccaaggatttgcctaactttgagcgtctcctgggagacggttcgcagtatggcgtgaatttcagctacaaggtccagccttccccagacggactcgcccaagccttcattatcggcgaagagttcattgcgggcgaaccatgcgctcttgtgctgggagataatatcttctacggcaatggtttgggaaagacgttgcgtcgagcggcatccgtgaagcatggcgcaacggtattcggctactatgtggacgatccggaacgctatggcgtagtggaattcgataaaaaccacaaagcgatttccattgtcgaaaagcctgagcatccagccagcaattacgcggtaacgggactctacttctacgacgagcgcgttaccgaattcgccaaacgagttcgtccttccacccgaggcgaattggagatcaccgatcttaaccagatgtacttggacgatgattcattgacagtgcagacgttgggtcgcggttacgcctggctggataccggaactatggatagcctgtatgaggctggggagtttgtgcgcactgtgcaacgtgcacaaggccttcccatcgccgtagccgaggaaattgcctatgaaaatggctggattactcgggaccagttgcttgaggccgctgaaaagtatggcaaatctccgtatggccagcatctgaagagtgtggcggaaaaccggattatcagtcaaccatctgacgatccacagcaagcctgattgcactctttacagtagttggattctcagataaggcccgacgcagtaatgcgccgggccttatctgaggcttctgctgttttcgtgggttaggttcttggttgtggtaggcgtatgtcgggtccgccgcagcggagcatgatcagggcgatgaggttggtgacgtggtggaagccgtgggccatgcggatggtggccttgatcctgttgtcggacgcctcgagcctggcgttggagtatcccagctggatcgtgcgcaggatgtcgggccggcgccgccggatctttttggcgagttcgacgatctcgggtatgcgcgagtgggacgcccggaacacccagtggttcagttcgccgcgggcctgttcgaccggatgcttgagcagggtcctcaatagttccttgaactgccaggcgcggtagatctggcccttggggtccgtgttcctgatgccgtcgagcgtcgcgaactgccggtccgtcaggtcgccggggttcttcagcacggcgtgtttggcgccgcgcatgcgcttcgtggcattctcgtccccgtcgcgcctcgcctggttccacagacgtttcctgaccttgtccaaggcgccggtcatccaggagacgatgtggaagccgtccaatacgcgttcggcgttcgggcaccaccggccgacgcacgagtcaatccagcgggccccgtcgccggcgacgaccttgatggaggcgcgctgttcgggcgtcaacgccttgaagaacaggtcgaacacgtccccgccgaccccgtcgtgcgcccagatcacccgatgccgctcgtggtcgacgaccacggtcagatacgcgtggcccttcctgtagccggtcccgtccacgccgaccgcggtgagtccgtcgaacggcgaggacatcgacgccttgacacgttccgcgacccgacgggcgacggcgccggcggtcctccacgacacatgaaggaaaccgctgaccgtcttccggttcgcgaccgtcatcagccacgcgcgctccacctcaaaattgctccagcgcctgcagcggcagctcccggaactcctccgtataacgcacacccttagccatgatcccatcatctcctatcaaacgaggggaaaagacggaacaaaaaccaggtcacatcaaaaccaggccacttcatctttagacaccgaacgcataagtcttagtgtccgcgagtctcccatcagaggtatatacctcataatgagtccaatatataccctttttgggcttccaaatcgcccacggtcccttgaaaccttgcacccatttgctgcgtttaacatcatagattttaatctcataatgggcagccgcattatttgaactttcccccagcaacacatgattgttctgccatcccgcatatgttgccgccacacgcgttgtacctggtgcatacctgaaagcgattgtctgcgatccgataatcttgcgagtccgagagtcacgtgcttccacgtgtagccaatagtctcctaactggtccgcccaacccgcccaattggcacctgtccaatcggtgatggttttccaacgtttgctggataaattatacgattgccatttgtaatcaatatccgatgaagggtaatcaaccgatgctccgacagcaatatcttcagagcgataaacccaagttatctgaaccgcgggagtgaattgatagttgccgaacgcattcatatccacgcgaccggaaatgccgttgatggagccgccgctcgtgtactgccagccgcggtcgttcgtggggaacgcggtgtactgcatggtggagccatactgggcgacccaacgggtcttgccgtggatgttggagctgttgagcgcgctgttcaggtagctcgtgtacgagtagacgctcagattgttgtaaccggccgcctgcagtttgccgtaccaggagttcaccataccgtcgtacacgctcggactcgttgggctcttgtgccccgtgtacgtccagttctccagatcgtagaacaccgggtaactcaggtcgcccggattcacgcctgcctggcgcagcaggttcaccacgtccgcaccctcggatgcgccgtcggccgcactttccgcatacgagaagacgtacacgccgaacgggatgccgagacgcttgcattcgctgatgttgcgcttcgcctgcacgtcgaagccactgccccagccgtagctcagacggatgatcgcgccctcgacgcccgcgttcttcaccgcctgccagtcaatcgtgttctgccacgcggacacgtcgatcacgcccttcgcctgctgggcgaacaggttgttgcgcgcgtcgaagaacgcctgcgtgccgttgtacgtgccccagtgcgcaccgtactcgttgttctgcaacgcggcgagcttcaccgacgcgttgtcggcacgcgtcttcgaggagaccgcgttcacgtcaccgccgttcgcagcgaccttctctttcacatccgcggcgctcaccggaatgaacgactcgccatccgtcttcgccaacggatctggctgcttgctctccgtgcccacgatcttcggatcggtgaccgtctcgcccgtctcgatgtccttcaactcgccttccggcgtagccgcatattgctcggacaccaccgtcgcgtcatcggagatctcggcggacaccttgtccggcagctcggcatccggattgtccggcatcgcgtcggcagccgtctcatcggcgaccgtcacaccgttcgcgaccggacgcgtcgcggaagtcgcagaccgcgcctgcgagcgcgcgtcggatgaggttccgtccgaggcggtcgcggaggccgcggaccggacgccggacgcgtccgcgtcggcgttcacatccgcgagcgcgctggccggagtgacgcacaccgcgcccaacatcgccaccgccgcgacggacgtcaccgccgcgatcacgccgcgccccgcaccggacgccgccgcacgcgcacgcaacgcacgcagcatgcccgtcgcacgcgccgcacccgttgcgcccgtcgcgcccgtcgcatccgagccgtcgaaccgcttcttttccaccatgcgtaactccttgacgcacccatcccgcgcacccgcacaccgccacgcgttccgatggtcgaccggactctcacacgcgggaacaggcaggcgggaataggcgtaatcccaacgttttcaaccgcgtctcagtctaatgtgcgcggcggataaggcgggcggagcgaagcggacaaaatcagcggaactccaccgcacattccggcgacggcatcatcctatcttttgagaagatacttcctgtttctgctgcgcggcggcgcagtggcgagaacgactccacgctcaacgagccggctcaacgccttacgcgtcgtaggaaggcctctccccgagcgacggccgatttcgtggacatcaagtggcgtatccgccgacaatacggacagtatcgcggattccgatgccgtaagccccttacggcccccattcggctccccaccatcgaccttctccgctagtgcgtaccgatcagggccgatttcatcggccagccccgcttggaccaatctatacaaaatcaccctgatgtcgtcggaatccagatacagcgcgacatgcaactgcggaaccgtcatatcgccatgcctcttcaacaagagcaacgccatacgttcatgacgagtcaaggggacgcccacatgatcaagccagtcacggttctcctgctgctccacgccgtagcgtccaagaacgaccgtgaaccgatcgggagtcgcgcggaacacaggttcccccagtgcgtgggatttcatctcgcgaatcaccagagggatgccggagccaccgccttccacggtcacatcattcgcatcgtcatacggtatctgatgaagcagctgcatcaacgtcgcattgcggcagcatgacacgccgctgccgatcgtggccagcgtaaccccaccccataatccgccaggattcgacacctccacccgatcggggtagatgtccacggtcacggattctccgaggaattgcgcatcatattccctgtgaaccacggcattggcgacgacctcgcgcagcacctcctttggaatctcgctatcggtacgggctccgacccccacgacgaacgtgggagcccgcaggtttttggcgatggcctccaccgcctgttcgattgcctccggcatattgccgtcgcattgcacacgatccacgaaacgcggaccctcaaccgccgatttctcgacacccggatgtgcgacgacgtcaatgatcagcttgggatagtactgctgcgggtactgtccggcggccaacagtcccgcaagacgcacctctccaaccttgttcaccatattcaatctggtcatgcgctcaagacgagtatcagtcccgcgcaacgccttggaattacgatgctcggcaagcaccctgtccaccgcctcggcattcagatcggagacgtcggcttcagggacaaccatacgatccgcggaactgggcgtcagggcatgggtcatttcgaacacttcggttggcgacaatctcaaatccttgtcgtccatacggcggtacccaccggtttgcggccctctcgccgtaagatagcagggtttgtgctgaatgccgttttcatggatgtcgatgaccaggaacgacaagccgttctgctcgcatcgggaaacgtcatactccggaggattcgtcaaccgtgctccttgcggattgccatctcccataccatccatgaactgcgatgcaatatggttggcgtcgaatcccggaacaggcgagaaatccccgtcctcgctgattcccaacaacagcacgccgcccttggtgttggcgaacgcgctcacactctcccacacgctggtgccgatggtccgcgcacaggatttcgcctcgaaacgggcgtcatcgttgccttggacacgtagatgttccagcacctcggcgatatcgtcattcgtccacatcatcatcccccttgatcagcttatttgtcttacttgttgcgaccacatggatccaagcagtcgcctccaatcgaccccaaacccacgtctgaaatctcatgataacgtgaagataaatactctgtcatgagcttatcatgattgcatcatgataagctcatgacatcaagaaccggtttatgacaagcgacacgaatacgcatgccgaacagcaacaggaacctgaacgcaagcatcaacatgtaaataccgaaattgaccgaaccaagaaaatcacgggaaatcacgcacgacattacgcgggtaaactatctatagcacatgagtatgggccgggaccgtgatgagacggcttcgaactgagtatgaggatgggaagatgatcttcgagacaaacacgcagaaatcggacatcacgagcgccggtggcgatggttccggcgagcgcgccgaccgccgcgaccagccggtcgtgtatttcgtgcttccctgctacaacgaggcggaagggctcgtgcacacggccgacgtgctggccgccaaagtcgcacatcttaccgaaaccggacggatcagcaaacaaagccgcatcctgttcgtcgatgacggttccaaagacggcacctggagcatcatccgcaatctgcacgaacgcgacgcacacttgttcggcggcgtaaagctctcccacaaccgcggccatcagaacgcgctcctcgccgggctcatgaccgcgcgcgcctacggctgcgacgccgccatctccatggacgccgacctgcaggacgatgtgaacgcggtcgacgggttcatcgacggattctgcaacggcgacgaggttgtctacggagtgcgttccgcacgcaagaaggacacatggttcaagcgcaccaccgccgaagccttctacaaggtgttcgagtggatgggtgccgagacggtacccgaccacgccgattaccgtctcatgagccgcgagacgctcgacgcgctcagcgaataccacgaagtcaacctgttcctgcgtggcatcgtgcccacactcggctaccagaccagcaaagtctactacgagcgcggcgaacgcgaagcgggcgaatccaaatacccgttgaagaagatgatcgccttcgcgattcagggcatcacctcgttctccacgaaaccgctgagcttcgtcaccggtgccggactgctgtctatcctggtagcgattggcatgttcgtgtacgtgctcgtctcgctcgggttcggccacgccatcgccggctgggggtccatgatgatctccatctggctcatcggcggactcatcatgctctccctcggcatcgtcggcgaatacgtcggcaaaatttatatggaatccaaacatcgcccccgttaccgcatcgaaaccacactgtaggaggggccggcggccagcggacggcccctcctacagtgcttggattgtatctattttgtcctcatcatacgagtcaacgcgtatagcaatgccccctgcttgaggcgaaaatgagaccgtcgccgttctcctgccttgttataacgaagaggtgaccatcggcaaggtggtgcgcctgcgcagtggccaccggcatcatcctgctcacgtatctggccttgtggctgcaatatacgcccgccgacgcgactggcgtggatggcatgcagttccgctacttcctgccattaagcggcatcttcacactctgcgcttgcgaatgcgttgccgggttgcggcggcgcgcgagtcacgcaagtcgtgcaagccacacaacgccgcgctcctcacgcgccgcatccgaatctacagccgcaccttccgcagcagacactgcacgggcttaagcaccacggtatcggcaatcaccgcaaatagcagcgccgcgagcagcgtggctgcgaacatcagcacgctgatgcccgcgtacgaccatccgtccgtgggcgcgggaatccgcgggccgatcagcaccttggacagcggcgaatgcaccagatagatcgtgtaggagtaccccgccagccagataatcgccttgcgcacccgcgccgacgtgatgtgcacgtcgtaccggaagaacaggaacaccgcggccaccaccatcgcgaacgcaaccgtgaccgtgcggccgacctgcatctgctggccggcgaacagatatggcgtggcgacggtccaggtcagggcgaacggcgccaacgcatacaagccgcgccgcgcccgcgtggacggcggatagtattccaacacgaatcccaacagatagtagaccagcagtccccgccaggggaacgactgcaggaacgtcaacgggtatccggcaagattgcagatctgctcggcggcggccacggcggcggccagaccgatcagcagccaggctcccgatcggcctatcgcgcgcatcatcgcggccaggaacggcgtcgccagcacgaaaccggcgagcatgaacacgaaccaatagacggaatcgtcatacccggagaacagatcgaacaacgttccagacacagcgccgccaaccgaacgatgatcgatcaccaggtaggcgacgaaccccatgccgcccgcgtacagcagatacggcacaatcagcgagataaaacgtttgtagtagtagcgcacgtacggcgcgaggctgctgggatcggcttggccggcaccgccgcctgtccgggcatcagagccagagcccggcagacggcccgctgagtgggtgctcaccggccggtcggcatcgaatgtcaggttgaaccggcccgacaccatgatgaacagcggattgcagaccatgaacaacgcgaacagcacggatcgcaccgtttccgcgccgccggcgagggtcatcttgacgggcatgtagttgttgatcacgtggacgccgatgaccaggcacatcgccaccacgcgcagcagatcgtagttcacgtcgcgcggcctgccggcgacgccggaaacggtggcgtcggaaacggcgacgccggaaacggaatcgggcatggtcatcacatggatcccgtcagggacttcagatcgaccgggcagctgatctggctcttcagcttgtccaaggtgtccaggccggccgagggatcggaggacgcgcccttatgcgcgtcgttcttgccgccgttcgcaccatcggcgccgttcgtatcggccgggcactcatccgtcaccttaccgttggagcccgtctcgacgccatccgcattcaccaccggcgtggttaccacgttcagtggatgtgtggcatcgctgctgacccgaacggtataggcaatcgtcaattcttttccgggctcgatccactgctggttgaacataatgtactgacggtcatacaggctcgcggtgttggtaccccatgaatctatatcagcctgcacagcggtgatttcgccaccgtacggggcggtaagcaccacgcggtacagcatgccaccgagcactggattctccgagccgccattaacgaaatcgggcaacgattcggccttagccttagtcagcgtgttcttcatggtgaaggtgaccgtgtattcgtcaccgagctgatcttccgtaaactgacccagctgcgtgttacgcacggctgtcgtgatgcgcttatccagcacgccagaatacagggcgttctggctggccgaggcgtcgccgcaggtttttgtgaccgtggtggaggtcttcagataccaatcctgcttgccttgctgcagctccgaaagatagatgccggtttcaggcacctgactgtcagcagacagctcaccactggccttatcgtcgataagtccggtggcaatcagcgcctcctgctcatccggatcagccatccatagcttgaaatgaccgctagcgctggtatctctgattgccttcaacagcggggatgcggtggaagcattcgcgttaccaagcacgtggttcataattgcttgagccgcttcggaaacgaagttgttctgctgctcgaagtccgggtaatccgtgtacaggtctgaagcgaagaacggcaccgtggtggtgccatccagcactcggccgtccgaaagcttgaccttgcctgtggctcccagcaatgcctggaggaatacgggatcgaatgacaatacacccgctacgttctcgtcttcgttgcctttctgatacagccacatgtatttgttcatctgtgccacacgctggaattcggggtcgatggtcgtggtggccgggtactggtcaaaagtgtcgccaaatacctggcgctccttcagcaccgtagcatccattggcttctcaggaatgtcccaaccagaagtggtggcgaaatcaccgatggtaatcgtgcccttatctgccgtgattgcggcgatggtgcccaccatgccgcccgccgaacgcagctcggccgggttctgcaccatcaccaaatacgtgcgcttgccgtcctcgccaagcagttgcggtagcaagttaatgaggccatcgtattcgctgagcatcgaatccacggtcttgagcgcagccttttcggattcgagcacggtggccaccttggcgacgctcggagtcggcaccttgttgagcttggtgagctgctgcgagatatccttatgcgcctgcttgacgatatccggcatatccatcagggcgctgacgtccaccgagccattcttcagggagaagccctgcaatcgtttggacaggttcagcagatcagtgaacggaccgttgaccaacgtatccacggaagccagcatttcgcgggcagcggtgatgtcgctgccaaatcgcgaatggtcgcggaagaagtcccactgcgggccgttcagctcctcgttgagatcactggtggcattgaccaactcttgggagatgtccgacagactcttatcgctgccgcagccaagtgccgaattggccagactttcggcggatgtcagcacacgctgcgcatccgtggccattctcgagacggatgccgcgtagagcgtgcccacacaggtgacgctggccagcaacgtcagcagcagtacaaccaccactcgcgcccatatcggcgtacggctgatcagcgaacggccgtcgccacccacgtgctggggagtcttcaggtttacgggacccgtctgctgatttgcagcgctattcgtagatgcggagcgattggatttcccgttaccggcatggcggcttctcctacgccccacagccttatggctcgaatgccctgaagtgaatcgcatacttatcctacccgaaaatctgctcagctcatactcttatccaacggcgcaaggccacgcttccggatgccggactccgggcgaatccggaatcgcagacatgccggaacacacgtgacgccacgcatatctcatgccagtgtaccgatgccaccgaaatagaccgagggtttatcccataccgggtgcaaatcccctcatgaccaccacatcgctgtcagaatgttctcagacttcattgaggggtataacagtattgcgcaagaaaacggtcactaaacgtaacaatagttaaagccgtattgatctgttcggcttaggagaacgggagaggtaattacatgttcgtcctcagcaacgcctggcgggccctgacacgttctaaaggacgtacggccctgaccgcattcatcaccttggcggtcaccttcggcacagtcgccggactggccatcattcaagaagataccaacgcacacaccaccgcgtacgatcagcagaaggccacgttggccattcgcccgactgcggctacgtggaagaaggtctccgctacggactcggcttccaccaagcattacatgacgtggacctcatataccgaatacgccacgctcgtccggtcggccaccaactcgttgaacttcacggttaccgaaaccgtgccggcccgcgtgagcggtgatttgaaggccctggacggcggatcgctgggctcggcctccgatgatgagaccggcggccagctcatttggcgagccttctggaccgaggatgccgccaaggccagcgacctcggtaccttcgaaatcgtggacggcaaggacctgagctacgacaacaagtcctccaacccgaacaccaccggcgcactggtctctgaagcgtttgcctccgccaacaacctgaaggtgggcgatacgctcaaggtggcggccgcctcggacgcccagaccacggccgagctcaaggtgcgcggcatctacaagtacacatccgaatccgccgtcgccaatccggtgacggccgcccgcaaccgcgagaacgcgatcttcaccaactatcagaccttcgccaaggccggactcgacccacagtccaacgacaagaccgcctccggctgggcggtgccggatctggacgtggtgttcgacaccggtgatcccgctacatacaagtccttggtatccaccctcaagaagtccaagctgcccgccaagggttacgagttctcttccccttcgctggaatcctacaacgcttctctggagccgctggatacgctatcctcgcgcgcgaagaccggcaccattgcgttggttgccgtgggcggcgtgctgttgctcatcctcgtgctgtcaggcgtgtgggcgcccaagcgtgacgacgagatcggcatggcactggtgtccggcgtcactcgcgggcgtttgggatggcagttcatgctggaagtgttcatcgtcaccctgcccttctacgtgattggtctggtcggaggcgcgttcgccgccaatccgatcggatctgccctggcatccggccatgccaccccggtgacatcgggcctgatttggaccatggtctggtatggactgggttcaatcctgatcctggcgattcttgccgccctgcgccttgcgttcttcagcgcgaacaagctgtttgccgccgatggcgactggggcaccgtgagcgagaccaacaagacgaccaccacaaccgacgatgcggaggcacaggcatgagcgacaggaacaacgatcaggaactcgagaagaccactgacgcaacggctgacgaagcgacttctgagactgagacgaacgacgccattgaatccgttccagctgactccatgcagttcagcgtgaccttcgatgacgttgatgacgaaggcactgttgacgatggtatttacagcgcactggcatctgccgaaaccggagaaaccgacgagaccagcgaggccgaagcagacgccatcgcttcggccaacgcatccgccgaagtgaccgagcgcaatgccgcccgcgtcaacgaaacactccgactggccaaaaccgatcacaaagacgcattggccgagcatgcggagcctcagggcaaagcgtccgaacccaccatgacgctggcctcacgtatcgatcgcgtgttggtgggcggcggttccgacgacattctgctcaagacctacccgaccttcgccctgaacaaggtgacggtcgccggacccaagggcaaggtcaacatcctcgatggcgcgaatttcttctgctattccggacacgcatacgcgctgctgatcagcgacgaccccgattcgggcatcaccgccgacgccaaacgtcgcgcgctgatgggcgtgatgagcggtttgaccacgccggcgtctggcacggtgatgaacaagagcgccaacattgttgagctcgagcccgtggaactgcgcggccaccgtctgggcatcgtaccgcagctgcacgccgtgcagccgaagatcgacgccgaacaaaacgtgctgtacgccatgaatgcgtccaaccgcaacttcctgaagcccaagccggtaatcgcccgcgaactgctggccaaggtcggcttctctgaggccaccagcggcgtggctgtcggcacattgcctttggtgcagcagcgtttggtggccatcgcccgtgcaatcagcaccgaggccgaggtgctgatcctcgacgagccgacacgagggctgaacgcggatgacgaggtgaccgtgttcgccgcgctggccaagctggcgcacaccggtgacccgaagcactgcgttatcgtgctcactgcgtcgcgcgagatcgccgaagcagccgacacactcttcgaaatctgatgttcagaccatagagccccctgtgattcgtattgccgaatcgcaggggtttttcaatgctgcggctcattgccgcgctaatctgaggataaatctgaccgtacgaggcgaaacctgataatcatgaccggatatattcccacactggagcagatcgacgagttgcaccgcaaaatcgcgccgtccaaggcggcgtacgagctggtgcatacgcattgcgtgattgtagcgaccatcggctgccagatcgtgcgccggcagaacgcgctgttcacgcgccgctgcacattaccgaaggacgcggaggtaccgcccaccgcaggcgtcaccggcggccatgtgccgccgcgtctgctcgacgagcatttggtactcatcggcggactgctgcatgacatcggcacctaccgcgtgttcaagcatgacggctctgacgacgaaccgctcaaattcagcaagaaacgctacattctgcacggtcttaagggctacgagtatctgctcgacgagggcgtggacgagtccatcgcccagttctgccgcaaccataccggcgtgggacttacgcgcgaggatgtggtgcgccaggagctgccattgccaccagccgactatgtgccgatgaatctcgagcaggaagtggtgatgtacgccgacaagttccatagcaagtcagtgccgccgaagttcctgcaggtcgaggcgtatacggcccgagccgagcgatttggcggagagaacaaacaacgatggctggatctggtggccaagtatggcgtgccggatattccggcgttggcggagaagtatgggatgcggatgatttgaggctcaaggcccctcgtcagagacggcttatgaagctatttcagatggaacggagacggtaggtgccgttgcggttggaggcgatgatcatctggtcgttctccagcacgttccagccttcctgctcatagccggaagaggagaccaccacaccggcggagtcgccgttgtcgtcgcgcagctcacggtagcgcatcacacggtagtcggcggcctgcgcgccacggccatactcgtcgtagatttccacgatgcgcgggctggtcttctcacgaccggcggcgcacagggcgatgagctggtcctcggactgaatcatgcagttgtagctggacttcgggtaggcttggcgcagttcgcgcacggcctgggccacggcctcgtcgagcgggaagccgaaaccgatgtattccagaatcaccgcgaagaagatagcggagtcggaacggccgccggtggagaggagcacgctgtggttcaccgggtatgagcggttggtgacgatgttgcggccattggcgtccgagatatcgccgttgtggatgaagctcaggccgttcgcatagaacgggtgctggttctccatgatgagcggcagattggagcttgccaagcgcaggtgccagatggcaccgcgagacggttcgtcggccagcgtctcaaacgtgctgtcatgacgggccgcgatggtcgacttgtagattcgggtgccggtttccggggtgggtgcgccgccgtcgcgcacgtgcggcgcttcggcgggatcggaaagctgggctacaccccagccatcattgtggatttcagacagttcacggaaatcctcgacattgtcttgccccaacacggcgttgagactcaggttgaaacctgccgtcgcgtatcccagtaatctgcacatggtatttcaacttaccgaaaccgtgcggcgacgtgcggcgaccgttataggcattctttatagagcgcatcagcgccgctgcaaactggtatgttatcgcttctgtttggcggagcgctgaggcttggcggcgggtttgccgttcttggccttgcccttatcgcctttatcgccctgctcagtggcggcagcggtctcagcgatcttccgctcctcggccgatacggcggcatcgagctcccgtaccaatcgcccaagcccggacgtggtgtccatcgggtcggggacggcggccgggtcggccactgcacgagtcggcgtgggcgtcgtgatggtcttggccgtatcggtgcgcttcagacgcggtgggcggcgggtggagacgaacagcggctgcacctcgaccagcgggttgtaaggtgccagaccgaaccacttaaccggcgagccggccatgcggcggattgcgtacttggcttgcaacgacagggcaccgcgtgcggaaaccttggattccggcatcagggccttgtgaatcagcacgtaacggatggtgccgatgtccggatcggcgtcgaccttggggtaaatcgacttctgcttaggcagttcgccggttttggacaggtcgtgcatgatctggtggatgtacgccgggatggactgcgaaaccttgaagcccaaacggaagcgcacgcggtagatgtagttcgtgccgaagtcctccaccgagtattcacgggtgaacggctcatcggtggtttccacgctgactgcccaccaagcacgggcacgcttggggtggtcggcgaagatggagaagaagatgtccgtgtcgagtcgcttggtttccgagtcggaggtcaggtacacgatgttgtccgcaaaatacgggatgcggaaatcactgtgcagcttgtcgagcgcgggtaggaagtcgttgggccgcatgtgacggcgttgcgcacgttcgagcttggtgccctcattccacgtgtacatgacgaacagaatcgcggcggtcagcagcatggtgaaccaaccaccatgcaggaatttggccatagacgcgatgaagaacatggcctgaatcgccaagaacagcacggtgaacacgatggcaccgacccgcttgccggaatgccataggtagacgccgagcaacacggtggtggtgatcatcgtaatggtcaacgccagtccatatgcggcagagatgtgttccgaatccttgaagatggcgagtacggccagtgtggagacgcacagcacgccgttgaccaccggaatgtacagctggccacgcgtgcgggccgggtaccgcacctgcagatgaggcatccaattgaggcgggtggcttcggagaccatggtgaacgcgccggtaatcagggcctgggaagcgatcacgccggccgaaacagacagaatcacggccagataacgtacgttcggagacatcatctggaagaacgggttgagtgactccatcgcagtgtattgcgggttatcgctattggccagcatccacgcaccttggccgaagtagttgagcaccagcgcaaccttgatgaatggccaagtgaagtagatgttgccgcgccccacgtggcccatgtcggagtacagcgcctcggcaccggtggtcgagaggaacacggtgcccataagggcgatgccggcagcattgttcgggctgaacaggaatttgatgccgtacaccgggttcagggcctcgaacacagaccagtcgttagagagattcgtgacgcccacgatggcgaggaagccgaaccagaccagcaccatcgagccgaatactttgccgatgctttcggtgccacgcgactgcacggagaagagaatcacgatgatcacgacggtgatcatcagggtcaggcttgggttttcgtcgaacaacccttccaatggcggcagggtctgcaagccttcgactgcggaactgatggaaaccgccggggtaagtaccgaatccgcgaggaatgccgcgccgccgagcatggcgggaatcgcgagccatgcgccgtacttgcgaatcaacgagtacagtgcgaagatgccgccttcgccattgttgtcgatgcgcatggcgatgagcacatatttgacggtagtgatcagcgtaatcgaccagaagaccagcgacagcatgccgagcacggcctctcggtctacgctgccaagccctccctgaccggcaaggaaggtctgcgcggtgtacaagggcgaggtgccgatgtcgccgtacaccacgccgagcgccacgattgccatgccccaggtgaccttgtctgggctggattgcaggcgggcccaccatcgaccgaggccgcctttcgaccatgcgctggcgattttctcggcttctttggtttcagcttccctctgcttggcgagtgcctcgcgctcctccttggtgagagtgcggcgggacaccttgggagcgttggtaaaggtgtcggccctcagcagtgcttcttcttcctgtcgggccttggctttggcggcaccagactgggctttctgggcctttgaggctttttgggcacgtgcggtcctttggttcgactcagccatacgttcagtcctccattgaggtggagatcatccccctcgcttatgtcaaacacatcatgatagacctcgttcacaattctgacaaattttacaagtcaacacatcgtctctacacgcgccgcgacggccgcacacccggccctcacagtccgtatacggcgcgggcggtatcgcgggtgccgcgcgccacatccgcgatgggcaagtcgagcgtatcggccatggcccgcaaggtgtagggaatcatgtacggcgcgttggtgcggccacgatacggcatgggcgtcagatacggcgcgtcggtttcgaccatcgcatggtccagccccacaatccgtagcgattcgcggataccgtcattgcctttgtagctcacggtgccggagaagctcagataccagccatgttcgcgcgcgatctcggccatctcacggtcgccggaatacgagtggaatacggtgcgttcgggcgcgccgtcggccagcagggtttcgatgacctcgcgatgggagtcgcggtcgtgaatctgcatgggcaggcccagttccttggccagggcaatatgcgcgcggaaagcctcgcgctgcagttccttggcaccttcgccggtgcggaagaggtccatgccggtctcgccgatagccaccacttgctcggggtatgtggtggcgaggcgatgtacttcggcgagcgcgtcctcgaaagacgtgtcatggtaaggcttgtatttgaggggcagaccatccggccccggcacaccgcgatgcccgtggagcacggactcattggggtgtattgcgagcgccgcgtgcacattacccggatgatcgagggccatctggacggcggtcatcaggtgcggcagctcgcaaccgcagtcgataatacccccaatgccgacagattgcgcctgcgccagcaattggtcgacgtcgtacaccgggacttcgggctgtcccttctcctgcgcctcatggctcatagcgcgcgcgaaagggattacggaggccacgtgagtgtggttgtcgatggtctgggcatcgtccggcaatgcttcaggtgccggggcccagctacggtcgcgatggtggtgcttgctcatggtttctcagtgtaggctgtttctcagtgtaggctaccgccagcaacgctcgtaaggcagtccggtaagacgttcgactacacgacgggtatcgtcggtcacgcccgcctgaacttgccgtttcttgccacgagcgcaacattcccgggagagtagcgcaaccggcaagcgagacggtcgccatcctgccgcctttttctgcatcatcagcccattttctgcctcattttgataaaatatgatgcagaaaagttcgtatgatgcagaaaatgaggcagtatgagatcatttgactacatcgaatcaggtaagacgttgctcaccccgcacaccacgagtttgcttgccgctattcacgaggcaaaagggcgtcaaagcatacagacaacgatcagaccggatatattggggacgctggttgccgtcgcgcgcatccaaagcacagatgcctcaaaccgcatcgaaggtatttctaccagcgatagcaggctcaacgatctcgtctcggagaaagtcacaccgcgcaatcgcaatgaagaagaaattgccggttaccgtgacgcgctatcggttattcacgaaagccacgactatattccgattaccccgaacgtcattcttcaactgcactgcgacctcttccgacacacaccactgacctttgcggggcatttcaaggacagtgacaacgtcatcatcgaacgagatgcacacgggaccagcaccgtgcgattcgccccaccgtccgcacttgtcacaccggaactaatcgaacgcgcgtgttccgcctacacgcaagcaatccgagatggacataccgatccattgcttgccatcgccatgttcattctcgatttcacctgcatacatccgttcaatgacggcaatggccgtatgagtcggctactcacgctcctgatgctgtgccgcaatggctatatggtcggcaaatacatcagtatcgaacaccttatcgagcaaagtaaaagcacttattatgaggcgctggccgcaagcacccaaggctgggacgacaacgccaatgattatgcgccattcacgaactacctgcttggcatcatactgtccgcgtgcaaggaattcgacgaacgcatcaatctcacggcaggcggcagagcgcagggagcaccgcgagtagccaccaagggaacgcggattgaagcactgcttgatcaatccctagttccactctccaaggccgatattctcgctcgcatgcccgataccagcaccaccaccattgagcgcacgctgaaatcactgttggactccggtacgatcatcaaaatcggtgctggccgcagcacccgctacgtgaaacgccgctaaacgcatccttgtgcgcaacatctcgtcactcttccggcgccccgctggccacgcgaatcatcgcgtactgcgactcgtagaggcggtagtacgcgcccttggcggcgagcagctgcgcgtgcgagccgtgctcgacgatctggccgtgatcgatgtagaagatctcatccgcgttctcgatcgtcgacaggcggtgcgcgatgatgaagctcgtgcgccccttgagcagatgctgcaggccggcctgcagcgcctcctcggtgcgcgtgtcgatgttgctcgtcgcctcgtccaggatcaggatacgcgggtcggcgagcagcacgcgcgcgaaggcgatgagctggcgctggccggccgacagagtcgatccgcgctcctccaccaccgtgtcgtacccgtcgggcagttccatgatgaactcgtgcgcgtgcacggccttcgccgccgcctcgatttcctcgtcggtggcgtcgagcttgccgtagcggatgttctcgcgcacgttgccggagaagatgaaggtgtcctgtagcatcacgcccatctgccggcgcagcgatgcgagcgtcacgtcacgcacgtcgtagccgtcgatcgtcaccgagccctcggacacgtcgtagaagcgcgacagcaggttgatgatcgtcgtcttgccggcgcccgtcgggccgaccagcgcgatcgtgcgccccggttcgacgtggaagtccacgaggttgaggatgttacggccgtccttctcgtagcggaacaccacgtcgttgaagtcgacgcgcccgcggatctgcggcaggtccgccgcgtcgggcttgttgcggatctccggcgtgacgtcgagcgtctcgaagatgcgctcgaggtacgccgagcaggtgatgagctggttgtagaagttgccgatgttgatcaccggattccagaagttgttcgcgtagccgacgaacgcgatgagcacgccggtggtcacgttcacgcccccgaagcccatcacgccgacgaagtagatgaacgagatggtcatcacggagatggtctgcacgcccggccacatgaggaactggatgtgcacggcgtgcatccacgcggaacgcacctcgccctgctgttcctggaaggtcctgaactgggcctgctcctgtgcgaaggtctgcgtggtcttcacgccggcgatcgactcgtggatgtaggcgttcaggttgctctgcttgttggagagcttctggaaggcgcgccgctggaagatctgcagcacgcgcacccagatgatgagcaccgggaacaggatcaggctccacagggccagctgccagtcgatcacgaacatcacgatcagcgtgatcacgaaggtgaacacgtcggagatcacgttgatcagaccggagctcagcgtgtccgaaagcgtgttcacatagttgaccacgcggatcaggatcttgccgtgcgggcgcgaatcgaagtagctgaagggcagcgtctggatatgcgtgaagatatcgcggcgcatgtccttgagcatgagctggccgacgcgcgtgatcgccaccgtgcggtagcgcagcccgaactcgtacagcacgatcagcgcggcgaggatcacggcgaggatgccgagcttgccgaggtccttgttcgggatcgcctcgtcgatcatgatcttggtcaggtacggcacggcgacgacgatgcagctcatcgagatgacgacgacgagaatgcgcgccacctgtgccatatacggtttgagatatttgccgacgcgcaggatgtcccggaagttgatctgctcctcgagttcctcatcctcgcggtatgtattgcgttgtgccataagtcctcttctaaaaaccttgtgcgacgccggactggagtccgagctgcttgtggtagatgtcccagtagcggccgtgtgcggccacgagttcggcgtgggtgccgcgttcgacgatacgtccgtgctcgagcaccagaatcaggtcggaatccttgaccgacgagatgcggtgggcgatggcgacgatggtcttgccgccgtccatctccttgaggtgcttctggatctccgcctcggtctccatatcgacggccgaggtcgtatcgtccataatcaggatcgacggattgtccgcgagcgcgcgggccagcgacaggcgctgcttctgcccgccggacaggcccacgccgcgttcgcccacgacggtgtcataaccctgtggcatcgacctgatgaaattgtccgcgccggcgatctgggccattttctggatatatcggtcgtcgctatcaccgctggcaccaaaaccgatgttgccgccgatggtgtcggagaacaggaaggtatcctgcgccacgatgcatacctgcgagcgcaaggtggccagcggccagtcgcgtgcgtcgatgccgtcgatgagcacatggccaacggtcgggtcgtagaagcgggagatgaggctgacgagcgtggacttgcccgcgccggtttcgccgaggatgccgagcttggagccggcgggcacggtgaagtcgaggtccttgaggatcggggtctccgggtcgtccgggaaggcgaagctgacgtggtcgaagcggatgtcgcccttgatgtgcagcgggcaggacttgcgttcggtggactgctgggcaccggatgttccggaagccacgggcgctccggtagccccggtagcctcatcatcgtgcttgacttgctcgacgatcgtgaccgcctgcttgacggcttcgaccgcgtcgggcttctccacgatgcgcggctgttcggtgagcagcttgcggattttgatgcagctggcgttgaatcgctgccagtcgttgatcagccagccggactggcgcaccgggccgtcgatcatccacaggaaggagttgaaactcaccagattgccgagggtcatgtagcccttgatgaccagaaagccgccgaggccgagggtgatgagctgcagcgagaagccgaggccgtccagccacggcatgtacttgcgcgagttgtaggccaaggccatgttgcactgcatgtaatcgtcgttgtgctcgtcgaacttttcggtctcgtacggttcgcgcacgaatgccttgaccacacggttgccctcgatgttctcttcgaccatggagttgagggaggccagcgagttgcggatggcgaagaacagcgggtgggcgtgcgtggacaggccgcgcgtgagcacaaaaatgaacggcgtgacgcaggccaggacgagcgcgagtcgccaatcgatggcgaacatcacgcacagggcgcccacgaacatgaccacgcagtcggcaatctgatagctcacccaactcaggcagtggcggatcgcgtcggtgtcggaggtcaggcggctcatgatgtcgccggtgcgtgtgtggttgaaatacgtgaagtcgagctcgtgcagcttctcgtattcgtcggagacgaggcggtagaccgagttctggccgaaacgctccatccacatctggtagccgtatcgcgcgcccacgcggatgatggtcatgaggatcatcagtccacacaaacgtggcagttcgtcggcatgtccgccgacgatgacgcggtccacgatgataccggacagaatcggaatggtcagggccatcgtgttatttgcgatgaacagtagaagcgcgcctaccacgcggggcaggtctggtttgcagtatggcagcacccatttgagattgcttgcgctggtattgattcccggatcgacgtacatgtgaggagatcaccgtttcttggggattgtttgcttgtggtatggtgcggcatgctcctgcgccgcacgcggcaatcgctgccgccgcgattcacgatcagccgtgcttcgcactgcgcctgtcattggccgcatgaccgaagctctccttcatcggtcgaagcacgttcgactttcgcaaacgcgtactagtctagacagcctgcgtctaatcgcaacggcccgcaactctgcgtgttccccgcattagcaacgatacgcggctctctaagcgcaacattccccggaatgcgtcgctgcacacctccgaacaggtccaattcgcaacgcattcccgggaaagtggcgcatgtcatatcacgctcaaacaacccagcatagtgagtggctcattcacgttttacgtattgtgcgacggaatcggcatctcccgcaacacgtgagatatgcaaaagtgccgcacgctgaattgtgatcagcgtgcggcgctgcgcgaaacgcgtgaaatccgcagaacgcacgaaactcacgaaacagataaaacgtacaaaacgcaagcaaggcgaagacaacgaacagacagagacagacagcctacaggtcagaacgccagcgaacgcacgtaggaaccaacttgcgggcggaacagctaccggggattgttcgtttgcgatgttcgcattcatggcaggtttctccatacgattcgggcggtcggttcaggaggttggttggcggaggcaggttcggtttcagcgtcggtccagggccacccagagcacgccgtgcggcggaatcgtgccggtgatgacgcggtcggcacccacgccttcaagacgcacgtcggcgggctcgcccggcgcgtcggcatacagatcggatagcgtccaatcgtcattacgggcgtcaagccccacaatggattggagctggatgttgcggccgatctcgtatgtgtcgctgccggtccagaacagcgcggcgtaatggccgccgtgatgcgcggaacgtgtgccatcagcccaatcggctgcgtcggcggaccagacgatgaactcgccacggtaggtgctctcatcccaccatttgccaaaaatccgttcgcgcacggtctcgcggttattggtggagccggcaagcacctcacgcaacgcgggattctgcagcagcgcgatggcgtcgctgttgctggtgggcagatcgccgccgaccataagcgggctacgccccatgcaccatagggccagcagtgtcttctgctcgtccagcgtaaggcgggattggcggtcgtcgccgcgttcggcgcgcaggcctatgtgcccgaacggcaccatgtcggcgtcggcccagtggccggtggtctggaacggcgcccagcgggccaggcgggcgaactgctggtagatgtcttcccaacggtcccacagatcgtcggaaatacgccacatttgggcgttctcgcgcaggaagtcgacgtagctcgtcgccacccagccgccgggcgagagagacaggtcaatcgaacggccgtatttggcttcggctttggcgatggcgcgatgataggcggcgatttcgtcggagtggaacggggtctgcatgtcgtcgaccttgaggaagtcgaggccccaggaggcgaacaggtcgagctgcgcgtcataccaggcctgcgcgcccgggtgggattggttcaggccgtagttgtccggattccacttgcacacgtggtcgaggtcggccacgtccttggcggtgtagttggtgccgtatacgggcaggttcttgtccacagcgatacgcgggatgccgcgcatcatgtgcatgccaagcttcaagcccagttcgtggacggcggcggcgagcgggccgaatcccttgccgccggcagcactcgggaaacgcaccgggtcaggcagctgacggccgtattcgtcgagaatcagcggcgcgttgtcgttgtaaccatgtgcgcgggcggtcgggtcgtaccagtcgatgtcgatgaccaacgtatcccagccggcgtttttcaggtgttcagccatgaaccgcgcgttggccagcagctcgtcttcggtgagagtcgtgccgtacgaatcccagctgttccagcccatcggcggacgccatgcctgaggaaggctctgcggaagatccgtcatcgtatcctgctttcgttgatattcgtataagttgccatacggcggtacgccagccgcaaaccaatcggcatcgcgcacgtacggataggtgaagagtgacgccactcccccggagagtcccatcccaacgtacgacgaacttcatggcctcttggcacaccgacgtatgtaccgttacatattcttccaccggaacgatatcaagcaagcgcatgttacgctcggcgcgtcatcgcctaagcgcagcattttcagcgattccggcgcacagccaccatttgccaaaacacgatgttgtgaataccgttacaaccattggaagcattacgggcattgtccaatgcccatcacaggcgaaacatgaggtgacgttatgccgagcggcaaaccaacattgcgcgacgtagcgaaggccgccgggttctcccccatgaccgcctcgaatgcgctgcacggcaagccgggtgttaaggattccactcgcgccaaagtgctggcagtggccgaaaagctcgattaccgcatcaatctgacggccagcatgctgaagtccggccgcagcaacatcatccacatcatcgtcaacgaattcgattcgccgttctactccaaactcgtcgaatcgctcgtcaccgaaaccaccgcgcgcgggctgacgccgttcgtggagcaaacccggtactctccggatgccgccaaacacgcgctggccaacaacccgttctccgggcagttgttcgacggcgagattatccacgcttcgggcctgaatgccggtgtgccgctttccgcgatcaaccacggccgaccgctggttctgattgacgcctgcgaggaaacgcccacgttcgatacagtgaatttcccgaacgaagacggcgcgcgggcggcagtgcagcatctcatcgaatgcggatgccaccgcatcgccattgtcggcgacgggtattcgccacgaaccgaactggcgcacgtggaaagttccagcggtttgcgtctacgcggggccagcggcgcactgcttgacgccgggctgccgtatgacgaatcgacgaacttcattggttacggtagcgacagcggcatcgaagccggtcatgccatcgccgaggcgatgctcgaggctcgtgcgcaatcggctgatgacactgctgagtcccgttccccgggcaccacgcgggcaacgggaagcaccccggccatcgatggcatcttctgcattaacgactatgccgcattcggagtaatccgaggccttgccgactacggcatccgcgtgcccgacgatgtgagagtcatcggcttcgacggcgccacggccggctcgtacaccacaccgacgctgagcaccgtccaagtggatctcgatcagctcgcccaattcgcgcttgatatgatcacccgccgcgtggagcagcgcgaccagggcgacggcaggtccgacgaatccgctggcatgccggccacgcgcgccaccattggatacacactggttccgcgcgagtccactgtcggttcggcaaacaggtaacgctgaaacgccgaaatagggcggcgattcccgactgccgcgcccactgcccaagtgccgtgcagcgtgacgtgcgaggtttcggcatgcgtcaaaccgttcccagcgctcccacgtggtagtggcgcccatgcgcacttttcctagggttaggaccatgaccttccctaatcacacggtgttgtagaggcgggcggggaaagcgtcgcggtattggccgggggtcaggccagtgcggcgcttgaagacgcgcatgaagtacttgggatcggcgtagcccacttctcgcgcaatatccgccacgctggaagcggtagaactcagcagttcgcgcgcacggtcgatgcgatattcgatgatctgctcggccacacccacgccgaacacgcgccggtacatcgcggtcagatagctgggtgaatagtggaagcgcgcggccactttggccacggtgatgtcgtcgaaggcattggccataatccacgagcggatggccagcatcggcgccaggccggacgaatcgccagcggcaccggccgaatcgacatgcatggcccattcctgttgctgccggacgcggtcggcactggtgatgggcttgccgtcgccccggtagccggcaagcgtacgatgggcggcaaagtccgccttcagccgctcctgcgcgctgacctccagcagcaggccggtggcgaagtaatcgcagtaagcgttggaatacgggccgaatcgcgcatagatgtcgatgagctgcccacacatcaccgccagccggtcggggtcgggcagggtgcgttcatcgggcagcaacaggcaatggtcgtcctgcggcagacccgcgtcatcggggagcatgcgcgcatccggcaatttgaaatgcatccagtagaagtccacgtcagacgtgatgatgtcggcgcccgcatgctccacattcggcggcaagagtgcgatttggccggcctcgatatgcagggtctgctcccccacccgcatcggcaggacgccccgacgcacgaacatcagctcgaaggtgtcgatggtgcgccgcagatggcgccagcccggtccggacacaaactgcccgaccgagtaaaagtccaccggcccttcgagccgacatgtcgtgatgcccatggctaccagagtagccgagagcaaatatcagccgcgcagccagacggtcatttcgttttcgccgcggttggcccaggcgaagtacgggatgagcgtggcggtggcgggctcgcgcttgaccggcgcgtacacggcgtagagcggcgcgaacgccggaacctcggccgcgccctcacccgcggcggccacagcagccggcaacggctcgcgccaagccggcacctcaagcttcaccatgcggcgggtcacgtcttccacctcgccctggcccttgtcgtcgatgcccttggcgccggcgtggaagtcgaactcctcgaccttggccgcgctcgggtcggccagcagtgcctccacatccgcgtgcagcaggtgcaggttggcgccgttgtctttttcctcggcgcagaaggtgatcgggccgcgcacgaacgccaccttgccggcgtcctcgcgcaccagcgggttggcggccagcatacgcaccggcatcgggaagtcgaacgtcacggtgtcgccgtcgcgccactcaccggtcagatacaggtagccgtcgcgaatttcgcgggtcacgcgggaactatcggccccagactcagactcgcccgtggccgtaatcgcggcggcagcagcggactcatcgcccacccaaccgggcagacggaaggccagcgtaaagcgagcaggagcctgagccgaggtgccagcagcatcaccgcccaagcgcacgaccgccttgccatcgccttgccacggcaggttcgccgtaacatccagctccacagccgtaccattcaactcagctttggccacgccgcccatatacaagtgcgtgaacagcgtaccgccatcctcggcaaccgtgtaggcatattcctgcaccgactcaacgatgcgggcgatgttcggcgggcagcatgcgcagccgaaccacttctgacgcaccggcttgacgtggcgcaggcggctgtctttatggcaggcatacggattgacttccagcgggttcacgtagaagaagctcttgccgtccagcgccatgccggccagcgtggtgttgtacagcgccgactccataacgtccgcgtactcggcctttggcgcgagctcgagcatgcgacgggcgaagaacgccagcgaaatcgcggcgcaggtctcggagtaggcggagtcgttgggcaggtcgtagttgtaggagaatgcctcgccgtccaccgtgccgccgatgccgccggtaacgtacagtttcttatcgacgatattgcgccagagccgctcggccgcatcggcgaggtcctggtcgtcggccagtcgggccacgtccgccagaccggagtagaagtagccggcgcgtacggcatggcctacggcttcgtcttgttcggtgaccggcttgttcgcctggtgataggcgtaccggttggggtccgtgttgggtttgtagttggcgtcggcgtcgcgctttgcgttctcgtctgcctgaatatcgaagatgtacggctgccggcctcgctcggtcacgaaatattcggccagatcaaggtaccgctgttcgccggtgacctcgtacagcctcaccaaagccatctcggcaatctcgtgaccggggtaaccacgcagctggcccggcttgcgaccgaagcgctcgtctacgtaatcggcgaaacggcaggcggccttgagcaacttgtctttgccggtgccctggtagtaggccaccgcaccttcaacgaggtggccgaggcagtacagttcgtgatggtcacgcagattggtgaacgcgcgatccatgccgttcaggatgtagtaggcgtccagatagccgttgtcgagctgggcggcacacacgacgtcgatggcttggtcggcggtctgttccagtgcggggtccgggtaatgggcgagggaatagccgactgcctccacccacttggagaagtcggtgtcttggaacacgaagccgtagaacttgtctgggtcgggattggccgggtcttcggggagcgcctcaaatccgcggaacgtgtacttcggcggcacgaacgccttgccctgggtatccttacgcttgttttgcgcggcagcggccttgaagttgtgcatgcagtagctgggggccgcgccggggacgttatcgttcagggcgttccactgatagggaatcacagccgtgcgcacgagttcctgctcggtgcgccagaatgaatcggtgacggtgacgtttttcagggccagcggcttgctatgcagcgaagtcatgacgtactcctttggactatgcgacattcgtcaacaatatgtatcggtacatatgatacgtgcgcccgcgcgagcagcaaggtggacaaatcgttggcggggtggaatcgccggcgcatatccgcccgtacgatttcgcccggtgaatcgtccgacgaatacacggcgacttatactaccgacggaccacaaacgtcgcctacatgaatggaagatcaatcatcatgacagcaaacgccagcgcacgggccatcaaacccgaacttctgcgtacgtacaccgaagacttcaacaaggaccgcgccaacctgatcgcggcggacgcggcggtttcggccggcgtgctcaaggcggccaccgactatcgcggcgtgcgtgcgctgccacgcgacttctccatcgaactcaagcagggttcgatcaccaatcaggagcgttccggccgttgctggatgttcgcctccctgaacacgctgcgttacgaactcatgcatcgctggaatcttgaggatttcgagttctccgagacctacctgttcttctgggacgcgatggagaagtcgaacacttatctggagaacgtgctgcgcacgctcgacgaggcgaccgattcgcgtctgttcgaggccatcaatgagtcgcctgcagacgatggtggctggtggcagatgttcgctgcactggtgaacaagtacggcctagtgcccaagagcgcctacccggagtctgagaactcccgcaattccgacgatttcaagcagtacctcaactccaagctgcgcgagttcgcggccgagctgcgccgccgttcggctgccggggcgtctgaggacgagctgcgtgcgttgaaggacgagtacatgggcaccgtgtaccgcatctgcgccgtggcgctcggcgaaccgccggagaagttcgacttcttcgcgcgcaccaaggatgatgatgaggataagaagggcgaagcttgcaagtgcaaggccgaggccgacgcagacggcaaggccgaatcctgcaagtgcggcgaatcctgcaagtgcgagggcaaatccgacgccaaggcctgcaagtgcgataaggacaagtccgacaagccgaaaaccggcaaggacgagcgcccgcagattcgcgagatcggcatcaccccgcttgagttctacaagaagtacgtgccggtggacgtcaacgatttcgtgacgctggccaacgccccgctcaagaaccgcccgttcaaccagcgctaccgcatccgcttcagcgcgaacgtggccgaggctggcgatatggaattcgtcaacgtgccgctggacgtgttcaagaaggccgcgcttgaccagctcaccgccggccacccgatctggttcgcctgcgactgcacgcagttcgccctgcgcaaggacggtttcttcgaccagtccgtggtgcgcgtcgaccagctgttcggcaccgaattcaccggcgacaaggcccacggcctcgaatacggcgacagcccgagcaaccacgctatgaccttcaccggcgtgaacctcgacgaggacggcaagccgaaccgctggaaggtggagaacagctggggcaaggacgccggcaaggacggctactacgtcatgtccgacgcctggttcgaccgctacgtcaccgagctcatcatccgcaaggaatacctcgacgacgccacccgcgccctgctcaccaccgaaccagtcgagctcgatccctggcagcctctcacccgccgctgccgctgatatattccgtctattggccgcggctgaagtgctcctatgttttgccgactcctcacagagtgagcaaaacataggagcactttagttatccacagagttatccacatcctcagcaagctagaaccacataccccgtttttcatggcgaacacgcgaccgctacgctacggtggcgttatgaacagcggatttcccaccccgccacccggcgtattcgacgatgaaccacccggctggaccaacaatgccgcggcaccgagtgctgcgtccacgcacgccgtcaagcccgagccatactcaccaccgcgtatggcaacccccactgcgcccgctatgagcgaaaccctcacccaacgtaagcgggaaatgcttaaacgatgcacggacgccgcgcaacagctcggaaagccggtgctcttcggcatgaccacatcgctgatactgcaatccgtgccgcttcccaaggattgcgatctcaatgccaccgagctccataccgtctccgactcgcatagcacccggatacgcgccgtcgttccgccaacaacaccgcacatctggaaaccgctaagcgccgcgcacaatgcacgtatcaacaagcatgtgcacgcgctgaatctggtacatacttgggcgcagctcgccgctcacatgtcattggaatcattggtcatacttggcgacgcaacccttacggcaatagcgcgcaagccgagcctatcgggcggccgcaccgccgacgaaatttatcaggactttgtgcggcaggtcagcgaacttccgaaattcaacgcgaaagccacatgcatgatcgcacttgaatttattgcaccgcgcgtggattctccgatggaatcagagacccgtatcacaaccacgcaatacgggcttccacgagccgtgacaaattacacagtgcccggcgcgacgttcagcaatggtgagccgataacactcgatctcgcttggcccgaattccgcgtcgccatcgaatatgacggcgatcatcatcgcacagacaaggcccagtggcggcgagacaacgacaagcgcgaactgttacggcatcatcattggatcgtcctcatcgccaccgccgcgaatatggctgatgaaccgtctcaagccgaactcgcctaccgagccgggcgacagctggcgttgcgaggcgccatattcgatttcaccttgacagcgacgccgctcaatgaacttgcccggcggaaacgacggaaatccaccggggcgcactgagctgacatcgatacgattgcgcgcgcttgctgcaacgcatatgccattcatcgcaccccatttggtcgcgtggccccgaccgcatggcactgttgtgtgtcacacgccatgttacgtccggcgaatccgcacatcatctgcgttgcgtactgccatattatgcggttcgcgatatacgtcacggtgtccgatgtcctggtaacgacgtcaatcgatttatgtgtgtaccgggccagattttgttgtcccggttctccatttcgcctctttttgagcaaccgggacagaaacaccctcgaaaaatcgccaattcggccctaccgcacaatatccgccatcacacatcggcggaattccgggcttctggatttgcatacattgagcgctcacgggatggtctgtcccggttcccaaaaagaggccaaaatcacgaaccgggacaacgaaatctggcccggttcgcacgtcaatcggttgccgtcaccaccgggacaccgactgcgcatagataagatgcttcaatgcttaacaggcatgcgaccataccgcgatagcaacgtttcgctggaagtagaggaatcaagcagcaccccaaaccggaagtatggggggactcctgcaatgctccgacagcatcgtaacttgcgttgcatgatgcggaccaaaacgaagaaacccggcggagggggccgccgggtgagagagaagagagaagaagggttcagttatggggttcggaagaacctcgccaccggtatgaacttcattccgttgacatcttctatataaccgtctctttcttggggattcgatgtgcttgtctgagaaaagtcttggcaaactgtgacgggtttgtaacgccgcccgacaaccggcctcgcattgtcggggctaggccgcacatacggcaacgggccaccccgcaacacttcatgtgcgaggtggcccgtcagctacgagctagcaatgccgaatcactcggcggcgagcttggccttctcggcggccagacgttcggcttcggcggcacggcgagcagccaacgcttcatcgaagcgagccagctcctcttccacggcctcggtcggaatcttggcgaagatcggtgcgggcttaggcaccatggcgccgacctcgattgcctcgctcttccacgggtgcacgttcacaccgagctcgtaatcgccggtgatgatcgggtacgtgaagccgggcttgtcgagatcctcgacttccttgagctcaggcagcggcgagaaggtgccggtgccgccgagcgcctcccacaccttctgtgcggagtgcggcaggaacggcgcgagcaggtggttcgcgtcagacacggcctgagcggccacgtgcagcacggtgccgagacgagcctggtcgtccttaatcttccacggttcggtggcggaaatgtacttgttgatgtcgccgaccacacgcatcgcctcggacagggcgtgcttctggtggtgggtttcgatggaggagccgaccacgtcgaacgcggcggaagcctcttccagaaggccacggtcttcgttggtcatcgaatcctcgtccagcggcggaatctcgccgaagttcttgttgatgaggttggccacgcggttcaccaggttgccccacgaggaggcgagctcctcgttgttgtggcgcacgaactcggcccacgtgaagtcggaatccgaggattcggggccggccacggaaatgtagtagcgcacggcgtccacggggtagcgggcgaggatgtccttgacgtagatcacgatgccgcgggaggagctgaacttcttgccttccatggtcatgaactcgctggccaccacctgctcaggcaggttgagcggacccatcgggccggtttcgccgcccttggagcccttgccgttgtacgccagcatttcggacggccagatctgggagtggaaggtgatgttgtcctttcccatgaagtagtaggccgggcagctcgggtcgttccaccattcgcgccacttctccgggtcgccctggcgtcgggcccattcgatggaggccgacaggtagccgatcacggcgtcgaaccacacgtacagcttcttgttcgggttgtcaatccagcccttcaccggcaccgggataccccagtcgatgtcacgggtgatggcgcgcggcttgacttccttgaacaggccgagcgagaagttgatgacgttggtacgccagcccttgcgggtctccagccatgccttgttggcttcggcgagcgccggcaggtcgaggaagtagtgctcggtctgctcgaagcgcggggtttcgccgttaatcttggagacggggttgatgagctcgtccgggtcgagctcgttgccgcaggcgtcgcactggtcgccacgcgcaccttcggcgtggcaaatcgggcactcgccctcgatgtagcggtcgggcagagtgcggccggtggacgggctaatcgccacctgctgggtgcccttgtagatgtagccgttctccaagcactgcttgaacatctcctgcaccacgtgctcgtggttaccggtggtggtgcgggtgaacaggtcgtagctcaggccgaggtcgcacagatccttggcgatcacgcggttgtaacggttggccagttcctgggcagtgagaccttccttctccgcctcgacgagaatcggggtgccgtgctcgtcggtgccggacaccatgagcacatcattgcccttcatgcgctcgtagcgcgcgtagacgtcggagggcacaccaaatcccgcgacgtggccgatatgacgggggccgtttgcatacggccaagcaacattcaccaaaacatgactcataaggcttgattatccggcgcggcggggacacgcccggatagctgccgcgccgccatcctcatcccactcacctatccacccgcaacttccccacatacttatccgtacacctcttgcgcgcttatccacatacgcattcgcacacgtatccgcgcacccatccgtacgcacgcccacgcacatccgcacacacttccgcctgccaatatccaccgagttatccacatcatttgcacacctagtaaagttatgcacttatccaccgttttcgcctatccggtggcgcgcaagccgcatttctgcatattgttcggtcatggatatcacagcaggtccgatgacggacatcacaacagccgcctcgccggcaaccgcgcagcccgcggtgccgccgatactgtttaccaaggatctgccgggaccgctcagccttaaccgtctggccgccttcggcacgttacgtaagctcgacgattccgccggctactggatcgagcattcgggcacactgtatggtcgcgcgaaaatcgtcgcggaggtcgccccgtttggcactgtggtgtgttcgatgaccgccgcttgggtatggctgggaggccccgactttccgagtaccatagacgtgatttccacatcgcacttccgctcggcatccgtcagccgccgtatccgcgtattcaaaagattgacgttgccggagcaaatcatcaagctcggcgggctgcctgtcaccacgccagcccgtacggcttgcgacctggtgatgagtcctgaagacatccccgatccttccaccgtcaacgcactggtgtgtcagctgatgtccgcgtaccagtttcggccaaacgactgtctgcaaatcgtcaaggaacatcggcatcacaagtatgccggacgcgcacgcatgttttttgaatcggtgcagcaggagatggacgaaccggctttggagcaatgcgcatgacgagggggttcattgtcagaggccatcgcagaggccgccatgccgctcaccgtttacggcatttgcggcaggcgcaacggttgcctcgccacgcggcggcggcacactcatccgaatccgcatcgcgcgcaatctcggatatgaccgcgccgcctgaaccgcccatcagacttacgcccgcggtggcatgttcgcccgatacggatgttgccgtgctctggcacatcgcatatcacgtgcccgaactgcgtaaatggctggttgccaatcccaaagccgacgcgcctttgctggaattggtctcgcagcgtggtgggcccggggtccggcaggcgttggaaatattgttcgagtcgatggaagcgtaacggggagataatcgccggctgctgcgctatcccttgattttcagcacagccgcatacacctgcttgcgattggccaacgatccgtcagccagtggatgctcctgcaccacttgcgcgatggcgtccttgatacgcaggccgtcctccaaagcacggtcgatggagagcacggccatgtcatccacgctcaacgtgctgggcgcggccgcttcggcctcctcgttggacgcgccgccgatgaccagcaccatctcgccacggggcggatcatcaatcacactttggcgaatctcgtcaatcgggccgcgacgaatctgctcataatccttggtgagttcgcggcacagggccatcgggcgattcgggccgaacgcgtccagcagatcgtccatcgaatcggcaatgcgatgaggcgtctcgtagaacacgatggtgcggcgttcgggcaacagcgtgcgcagatactgcacgcgctcggaatgctttcgcggtaggaagccttcgtagcagaagcggtcggtgggcaggccggagagggcgagcgcgtcgagcacagcggaggggccgggcgcgcaggtgacgggcagaccgcgttcaatggcacggcgcacgatggccaagccggggtcgttgatggtgggcatgccggcgtcggatacgacgagcacggtggcgccggtttcgacctggtcgagcaggccgtcggccttgtcgcgctcgttgtggtcgtgataggcgatgacgcgaccgttcacatagacgccgaggcgacgggcgagatcgtagaggcggcgcgtgtcttcggcggccacgatatcggcccgttccaagagggccaccagacgggctgaagcgtcgccgacattgccgatcggggtggcggcgagcaccacggtgccggcggggatggtcacggccgattcgcgggattgggcgacggcggattcgccggcatgaacttcatcattgcgttcaggcacttgcgtcacgctaccgtcagcgtcatactgctcattcaactcatctgcgcttgtcatactcccagtattgcccatgccacagagcaatccacgacaatccatggcgaaatcgaggcattctccctttgcaggggctgatttcacatgttccggaggtctacttccgtttcaaggggctcctcatccggtgaagcaccgatacaaacggctttgacgcaacgctattccgccattttggcggcgtatctacttgaccatcagcccctcgaaacgcaagtagacctccggcaaaccccaaatcagccccttgaaacgcgagatggcagaatttcaacgaaaacaaatgaaaagaccctctgcggtggaatgaatgcagagggtctcgtggagctgacggtagtcgaaaccgcgacctcttcgatgcgaacgaagcgctctaccaactgagctacagccccttggatgttactttgctccgcaaagcaactcgcaacaatatagtacggagtacggtcaaacgcaatttgacgccgaagtgtcgcacgcgtgtcgacacggtaacgtttcggtgtcgcagacggggcaagtcacccacaccgctccgcatggataccgcggcggcacccggcaacgtcatcacgtctccagcacgcccagcaccttcttttcgttgtagaacgcgaacacgatgccgcccagaccgcacagcacggccgcgcacacggcggcgatgcggtagcccgcgccggacgccatgccgatggtggagacgccggtgaacagcagcatggccacggactggcccatcttcatcgcaaaggtgcgggccgcgtagaacatgccctgacggtcctggccggtggtcttggaactggcgtcggcgatattcgccacgatggcctgcggcaggatgccgaacgcggccatcggaatcgcgccgaccaccgagagcaccaaaccctgggccatcgccggaatgaagccgagcacggccgaaccaagggcgccggcaaatgcgaacgcacaggtgaagatcacgaaggcaaccagcagcagcctcttcttgccgaccttattggccagaatattgaccggcagatagaacagcacagagacgccggtcatgagcacgaagtagatggtcgtggtggtttccggcagcttgagcaggctggtcacgaagaacggcagaccggtctggaaggtggtgatggccacccagtagaccacgtcggagcatacgaacttgcggaattcgccgtcgccgaacgtctgcttcagggattcgatggtcgattcggaggtgggatgggagttgacgtagtccttctcgcggatggccagcggcggcaccagcatgcacacgaacgccacggcggccatgatggtgaaggtcacgcggatggcggtgatgcggcccatcatcggcacgaacgcgccccaaatcaccggcgccacgtacgcgatggccgtgccggccacccaagtgaaggagatggcggtggagatggtgagttgctgcttggagtcgtggccgagttcggcgatgagcgcgttgtacggcgtgcagtagaacgtgagggcgatgtagtagccgatcacggtgacgaacaggaacgccgcgttcacccagctggtgccgttgatcgggctccagaacacgagcacggtgaccaccgcgagcggcagggcggcgaatttcaggaacggcatacggcggccggatttggcgtcgcaacggtcggagagagacgccacggccgggtccacgaacgcgtcgaagaatcgggcgaaggcggtgatgccgcccaccacggtcacgatgccgagaacgaccaggccctgcggcacgaatacggtctgaccttgggagatggtctcctggtcaggttggtagaaatacacgagccagttggagatgatgccggaaagcagcgcccacccgaactggccgaccgcaaacgcccacactttggcgatggggagatctctgatggctgacttcgccggtgcaacttgcacacccgttacacttgctgtagtcgcattgcccattctcacaacctccgaatcaacattgacacagtgtcaaaatccagtatacaccggcacaccatgcgctctacgatagtgggcatgacaagtctgaccgagcaactgccatacgtatacgcttttcctgatgcgttggggaccggattactggtgcacaccgagagcgtattggacgatgagatacgcgatcgtattggctcgttcatccatgaatatgaggttgtattatctcgattccgcgatgattccatcgtcggccggatgcgcacggccgcacatggcggcacgttcgattttcccgactgggcatcgggtctgtttggcctgtacgaccgcctgtttgcggcaaccgatggggcgaccgacccgtgcgtgggcgaggatttgattcggcttggctatgacgagtcgtattcgtttacgcctgcgccagatgccgctgaacatgcaggcgcgatccacggacgagccatttggtcagccgacgttgagcggcatggcacaacactggtgacgcgcggaccggtcgcgctcgatttcggcgcgtgcggtaaggggtatttggtggatttgcttgcggggatgttgggtgatggcgcgggtcaccctcaacccattcaatacgtcatcgacgccgggggtgatttgctagtgcacacggacgaaccaatcaccatcgcccttgaagatcctgccgatccggccaacgccgtaggtgcggtcgaaatcagccaaggtgcattctgcgcgagctcccccagccgccgccactggtctgacgccgcaggtcaccaacttcaccatctgctcaacgccatcgacggactaccggttgacgatgtagccgccacatgggtggccgtcacgccgccatcgagcgccataaccacgaagacatcgacgcatggcagcaatgcctcgacaacggcaaaccgcgataccgacgattcgtcgaacaccgttgcggcacacgtccctgtcacactggccgacggactcgccacagccctgttcaccacctcggccgcccagctgcgcgctcacttccccttcgaatgcgccatcctcaacgccaatcgcaccgccgcacaatcccccaattttccgggcggttttttcacacactaatgtacgaaatcatcagtatcacatccagtggagcattccctcgggtggaccgatgggttgctcccctcagtcagctacgctgacagctcccctcggagaggggagccgagtatagctaatccgctaatccgctaacgcaggaaacaatccgtcagtcagcgagtgcgaactggctgttgtacaggtcggcgtaaaaaccgcccgccgccagcagctcgtcgtgcgtgccgcgctcgatcacgtcgccgtggttcatgacgagaatcatgtcggcgtcgcgaatcgtggagaggcggtgcgcgatcacaaagctcgtacgccccacggtcagcgcgtccatggccttctggatcagctcttcggtgcgggtatcgaccgaggaggtggcctcgtcgagaatcagaatcggcgcgtcctgcaccatcgcacgggcgatggtgagcagctgcttctggccctgggagagcgacgacttgtcgtcgagcacggtgtcatagccgtccggcagcgagcggatgaagtggtcgaggcccacggccttgcacgcatcctcgatctgcttgtcggtcacgccgggcttggagtaggcgatgttctcgcgcacagtgccgcggaacacccacgtatcctgcagcaccatggagaactggtcgtgcacgttccagcgcggcacggacttggtgtccacgccgtcaatcgcgatcgagccgccggaaatctcatagaagcgcatgagcaggttgaccatggtggtcttgccggcaccggtcgggccgacgatggcgaccttctgcccggccttgacggaggcggagaagtcgtggatgatcggcttgcccggctcgtagccgaactgcacgtggctgaattccacgtcgcccttcacttcgtggccgttggtcccaagcaaagcggacttgtcggattcgtcctccatctccggctcctcaaggaagccgaacacgcgttcggcggccgccgcgcaacgctgcaggttctggaaggcctgggcgaactgcgccaacggctgggtgaacaggcggacatacatcatgaacgccacgatcacgccgaactcgatctgcccgtcgagcgcgagcgccgcgcccaccacgcacaccaccacgtagccgaagttgcccacgaaattcatgagcggcatcatcaggccggagaggaactgcgacttccagccggactcgtagaggtccgagttgtacttctcgaagcgacgaatcgaatcggcctcgccgttgtatgccttgacgatgaggtgaccggcgtacatctcctccacgtggccgttgacgtcacccagcgccatctgctgccgggcgaagtacttctgggaggacttcatgatggccatcatgatgatcaggccgatgaggctggcaccgatggcgcacagggtcatgatcacgttgttgtagaacatcatcaccagcgcgcccacgaacagcgtcaccgaggtaatcagcgagccgagcgactggcccagcgtctggccgatggcgtccacatcgttggttatgcgcgacagcacgtcgccgtagctgaccttgtcgaagtatttgagcggcagtttgttgattttgaccgagatggactcgcgcagtcgctgggcggtgcgctgggtgacgttggccatcatccagctttgcacgtagccgagcacggcgtagcccacgtacagggccaccaaagtccaggcgatgtggcccaccgtgccgaaatcgaccgagttcatcaccggtctgccgttaacgatggcgggcagacctttgacgatctcgttggtcatgtccttgagcttgtccgggccgacgatctggcagacggtgccggccgcgcccaggatgagcgcgatgatgatgacgggaagatagttgcggcagtagttcacgagtttgcccatgactttgccgaaatcatggggctcttcgacggcacgcctgccgcccattggtcctcttggcatttgttttactccttaaaagtccgtattgacctccctctgatgaaggaggtggcgcgaagcgccggagggagagaagccgtacgcgactacccctcagtcagctgtgctgttttattcgctcgcttatcagctcgtcttcgcctgggaacagcccactgggctgttccctttacggctcagcccctgacatggggagctaccgctgccgcccccccctacgccgtaagctccgactggctgagctgggattcggcgatctggcggtatacgtcgcagttgtcgagcagttccttgtgcgtgccctgacccacgaccttgccgtcgtcgagcacgacgatgcggtcggcgttcatgatggtgccgatgcgctgggccacgatgagcttggtggaatccttggcctcgcgggcgagcgcgtcgcgcacttcgcggtcggtcttgaagtcgagcgcggagaacgagtcgtcgaaaatcaggatttccgggtgacggtacaccgcgcgcgcaatcgacaggcgctgcttctggccgccggacacgttcgatccgccttgggcgatcgcggcggaatacccgccgtccatgcgcgccacgaactcgctggcctgcgccacgtcggcggcggccctgacgcgattcagctgctcggccggtatatcggcaccttccgcggcctcgccagcggcgatcaacgcggcctcgcgcttgcgcccggccggggtggaggtatcggccatctcgacctccgccgggtcgcccggctgatcgccgtagctcacgttggaggccacggtgcccttgaacagcacggactgctgcggcacgtagccgatcttgtcgcgcagggccttcaggtcgtagtcgcgcacgtccacgccgtcgaccaacacctggccttggctggtgtcatagaagcgcggcacgagattgataagagacgacttgccggagccggtggagccgatgaacgccaccgtctggccctgctcggcggtgaagttgatgccttccagcatcgcctcgcgcgaatccgggtaggtgaagctgacgttgcggaattccacggtgcccctctggccggttttggccacgtcggcggcggttttggtgccgttctcgacgatcggctcagtgtcgagtacctccatgatgcgctgcgcggacacgtcggcgcgcggccagagcacgaacaccatgctcatgagcaggaagctcatgatgacctgcacggagtagttggagaacacgaccatgttggagaacacggtgagcttgtccttgagcccggcggcatcgatcaggtaggtaccgatccagtagacggcgagcatcagaccgttcatgatggtgttcatcaacggcatcatgaacgccatgacgcggttggtgaacagctgggtgtcggtgaggtccttgttggccttggtgaatttggcttcctggtagtcctcggcattgtaggcgcgcaccacacgcaggccggtgaggttctcgcgggccacgaggttgatgttgtcggtcagggcctgcatggccttgaatttcggcatgaccatggccatcatgatgacgatggccgccagcagaatcactacggcgattccggtggcgagcgtccattcgaagccttcgccggcgatcttgcacacggcccatacggccatgatcggcgatttgacgatgagctgcagacccatggtgatgaacatctgcacctgcgtgacgtcgttggtggagcgggtgatgaggctggcggtggagaacttgctcatttcggccgggccgaaggactcgaccttgcggaattcgagcgagcgcagacgctgggtgaacgaggccgccacgcgcgcagcgatgtagccggtgatgatggcacacgccgcggatccgagcgagatgagcagcatcttgccgccggcaatccagatgtccttcatgtggctgcccggcgtttcgaccagcgtggtgatgtctgacatatagtcgggcagtttcaggtcgaagtagacctgcccgacgatggtcaccagggcgatgagcatctgaccgatctccgctttggagaggtatttcatgatgcgaagcattggtttccccttgtgttggttgggttggttattggttattgacgattggttcttaagttggctgggttatcggcgattatcggttcacgatgtcttaatagtttctattgtttgattacttacactgtgagatattacgcgcacttctgcatgttcgctgtgagcgtcctcaattagccttgccgattagttctccgcgcgcttagctgccatgtgttcagccacgcgcttgccccgctccacgaatgcctcacgcacctgttcagcagtcggccgaggctgtcccggatggcaaatcgacatatatgtggtgaactcagacaccaggtcaacgaattcgcgcgtgcgccgctcccccatttgcgagaaaatccagcaaatcgcggaacgcatttcctctatcatccgatgagactgctcgcgcccggaatcagtgagattcacgcgaataatgcgccgatccttggaatcaatgtcacgcgtgacccagccttttttctccagagacgacagcacagtggagatgcggccggaactggcctgcagcgccgatgccaattgcgatggcgtttgcgtccccttcatggacagctcccggagcacgaactgctcaccatgggctccacgagtgaattccctctgcattgtcgaacgatcgccccacacgctggcatacagttcactaactgcttcctgctcaaatcccataagagcaccatccatttccattcgccacacggcagagcgccgcaaacatcccaagaatatctcacaccgtaaacaattcgctactagaaactatttttggaacgcataatgcacacactccacgctctttgatattctgaaagccgcatagatattcacttcggggcgtcgtctaagaatatttgctgggccaacggtagcgacgttggcattgtgctccatgaggtatctggtcgaaaaggcggacgaagacaggccagttgggcggagcgcgcccatacctcaaaaccattgcaattattcgctttgaccattttcgtggagtcacgaaaatggtcatgaaaaacataaggacacacccatgaaccgcgacgaaatcacacgcaaaaccagcgaactcagcactatcgcacacaccaccgaggactccaaagttgagtattggtatgcacgcgagctaatgacctatatggggtacgacagatgggaaaacttcagcaaagctattacacgagccaagcaagcttgcgacaattccggcgtatccgttgaatcccatttccgtgacactacgcgagacgtgactctcggcagcggtgccaccagctccatcgcggacgtcaagctcacccgatacgcctgctatctcattgctcaaaacggtgatccaaagaaagaagaagtggcacttctccagagctattttgccgttcagactcgcaaaacggaaatcattgagcaacgcatgggagaaatcagccggctcgccggccgagaggcccttgccactgcagagaagaaactctatccgtatacccaaatcacacacaacaaaaccgcacaagtgcacatgtacacgcccaaccacgccgcagaacgccggcaaggatgtgatacaggccacagaaagcgttgtaccgcctaggcaatgcaacaattgtccgctatgctctgaaggcagatggcggcacggatgccatcccaaagagggggtatgaccatgattcggggtatgaacctatgcagcatcgccggctgcacgcacgaagcagaagaagcgggcatgtgcaacatgcatttcacatcggcgctggttcacggagcgctgcactacactgcgggcggacgtccgtcgcactgctgagcgcaacaacaaagcaaaacaaccagtaacgctcaacggcttccacatgttcatgctctaattgcatgtacttgcagacacaatggccggtctgagccagctgccctcgcatggagcagctggctcagaccggccattattgttgctttgtactgtttgcactgtattgcgcctgcattgcgcaagctcgggcgcactcgggtgcactcgctgagtggcgtgaatcgcagattgctcaatagcaacgcaatccacgctactcagcagttgccatggttatgcgcggcgtttgcggatgacgagcaaggcaccagccgcagctgccagcaccacaaccacgaccgcaatggcagccacggcagcacccgtattcgaaaggggcgcagcgccattagcagccggcttattcgtggcagtgctaccgggcttagcagtgttgccaggattgttggtatcgccgggcttctgctctccagggccgggagtgacctccgtggccgtgaccgtgacttcgaacgtcgcgttcacgccacgataagagacggtgatggtcttcgtgcctgcggtggcagaatcaaagccagtgaacttcagatcaccatcagttggatcaatcagcttgcgcagcgtttcggtatcgccgactttgtaaatggcggataccttcacatcggcagcgttgaacttatcgcctacctgataggaatccttggtcacttccacagcaagctcagccaactgaggcagttcgccgaatgtcactgtgtaggttttcgccgtgccatcctcagcagttacagtcaccgtggccacgccgttgttctcggccgaagcctgctccacttgcaccgtagcctttgcgtcagcagcagtcgcctccaccgtcgggtaagaagcagcgtctccggccagcgcaccggcatattcggtgatatccgcggagaatccgtcaaccgtcttgccatccacagtcagatcagcaagattggcgttactagacggctgcggctttggcgttgcttcaccttcggcgatgcgtacttcagcgatcttggcatagtcattgccatcggcgtaggtgaagttgaggcgaatgcccttggtggcgggcagagcgctcacatcggcttccgtcacggctccagcagcaccattcacagtgactgccggcagcgtggcatcagtccacgtggcgctgtcttcagctaggtacgatacagtgaagctcttcggagcggcctcgcccttggccttatccaccgcaacgctgagcttgcccagctgatatgccttatcgaaggtgtagctgagccacggcgaggtgtcgccggtgccccagttcgaccagttggtgctcaggttgttgtcgcaagtcaggtcggccgtagaagcggaggcccagctactggccggctcatacttcgaggctgcggcggacgagcagaacaaccgggcaaggttgctttccacagtcacggtgaacgtggcggttactgaagaatcagtgacaaggcgtaccgtcacggtttgctcgcccaatttggtggtgtcgaagccttccaacgtgtattcatctggctccagtacacgcgtcttgccattggtgagcgtagcggtaaccgtcacgtccttatgcgcgagcgtctgcctcttggcgatagtggcttcagggcccttggccgcgatggactccacagcagcagtctgcgaaccgaacgcagtgccgttgaaggccacggtgaatgcgccggcattgctgttcgacgtggcgaagacaccggcatcgagcccggttgcgtccgcaccggtcagcgttaccgtagcgacatcctgccattcatcgttcgcggaagcacgccagtagcctttcagggtatcggttgcggcgcgctccagcttgagttgcacttggtcgccgaagccggcaccaacatgcgatgtttccttatcgatgtagccatcggcattggaatcgtactgcatgtaaatgccgcttgggctggcaagtaacgtggcatatcccttgccgccgttagcgtcagcaagaccgttacgaaccaccaggccggcacgcggatcgccattaccgcccaagtcgagcggcttgaccgtggtttccaacgtttcgttcacgtccagagcatcaggctggtacaccgcgctgccctcgttgcgatccgtccagacaccacgattggcgttgtccgtaacggtgaagtcataggtaccgccggatgcggcgacctggcacgcgctgccgcccttccaatgggcttccttccaacttccggaaatcgggttggagcaggaaacgtcgatggttctgcggaatgtgcggcccgggttgaagttgctgctctcggcaagagtgcctgtaatggtgtaggttcccggcacattgaatgcgtaggtgctgccggcagccttggtcgacttgctgactgccgtaccgccttccacattccatgtcaccttggtagcaatggtatcgtcgccttccttgacgttgacggtgtccggcagagtaacggttccgcccgtgttcacggtcttcgggagatcatcgccggtttccacagtccagttgaccagcttgcccttggcgctaccatggttgtcccaatagttcagatcccagccgtcgggctcgccttcttgagcaggattatgcatttcgatggtgccgttctcaccgatggtcagcggcagccaaacataggtggaatcggctttaccggaatcccaacggtcaccaaggtagatgaagtgacctttctcctggtctactgcgagcacactagccgactgcgaaccgaatgtggtgccgcgggtatcgcccacagacaacagaccatccgcgccttccggcatgttgttgtaccacgtgttctcgttggcatcgtccttttccacgccacgggtccagcttcccagcatggagtcggcggtgtagtaggtctgcttgttcgggtcccagccggttgcaccagatgcgatgatgttgtaacgcccgtcatattggaatacggcaggagcttccagcgaaccattttgtttgacgatttggaaatcttcgccacgcaccggggcatccgtagtaccgtctgcaagaatgtatgggtactgcccgtcagcagagtactgcttttgtccctcggactggtccacattcgtggtcttgactacattggtgtaatcatcgttaagcttggcgatatacagcgtggcattggcttcggaagaatacagtacataggcactgtcgtccttcggatccacgaacacagtcatatcgcggctgtcaccgttctcaccccagctggggttacctgcggcttctttccaattgttctggttaggcaaacgataggcacccaccatagtgaacgggcccgccggattgtcggaaacagccacgcccgcaagtgcacgtgcatagttggaaccgcccggcgtggtgcttccatcggaatgccaccacagcacgtattgcttgttcttcttgttgtagatgatcttcggacgctcgaaaatgccctgtacggaatcaaccgcgccatcaccatcctgatcggggttggtgttgaggtacgggaagattgcgtcggccttggcagcgtccacactgccgtcggacttggtcaggttgtaggccttgtcgaagtaggcgtaatcggcattgctcttatccgtcaactgagatttgctggtcaccgcacgcagcgccacaccaagatcggtccagttgtatagatctgtcgacatataagcatgaacaccggggctgttgtcgtaaccgttagaacggtcttcgccataccagtagtaggcgtcgccaaccttgaccacttggccaccgtgcgcttggatgtgtgtgccgccattatcattggcgttcttggcataccaatatggctggaagtaatcgctagcgttcttgcccggatcggctgtgggctggaacttggtgtatgtcggcacttggccgatggtaggcaggtaatccacacctgccgcactggcacttgcagcggccagcccgcatgacaatagcgttgccgcggcggtaattgccgcgataagagcgcccttgcccttattgtttatcttcattgatttggttccttgattgatgataacggttttttgaacaaacagttatgtcgctatccgcgaagtcagaaaagggccgacaaatcaatataccgatactgaaaactcagtattcaacctgtcggaccaattatgctcaaagagcggaggaaccggccggcaatagtcaatattgccggcttgttccttcccccattactgtgcgagggtgctatgcacgcttgcgcagcatgaacaatgcacccgcggcagcggccagcagagcgacagcgccagcgatggcggcaacattggaaccggtgttggccaccgtgttcttgttgccgttgccggtggcaccgggcttgttggtgctgccgggcttctgttcttcagggccaggggcgactgcgttggccttgaccgtgacgttgaaggtcgcggtcacaccacggtaggagacggtaatcgccttcttgcctgcggtggtggagtcgaacgagccaatcgcaagctgcgggtcgtcaagagcgaccggcacttccttggtcttgtcgccactctgatagacggcagtaaccttcagaccggcggtatcgagcttgtcgccgatggcgtactcgatcttcgtgggtccggtcaccttgagcgaagccaaagtgaaggctttgaaggtcaccgtgtaggtcttcgtctcagactcgtcggctgaggtcaccgtaatggtggccttgccgccaagcttgccattctcaaccgcgtcgccagtcaccttgacggtggcggcattgtcggcggcgaaggcctgcagcaccgggtttgcctcagcaccgaacggaagatcaactgtgtagtcggtcttatcagcagcgaagcccttgatggtctcgccgtcaagacgcaggtcgcccagcgtggcatcggatgccggctgcggggtaatcaccttgttgtcttgtgcgaacacctgaatttcggccacgttgatgtacaccttggtgtcctgcaacgtgttggtcaggcggatggccttggcctttaccggggtgtcgagcacgaagtcaacggtcggggtgtcggcggcggtgatgccgtcggagccagagccggcatcgccggcctgtgtcttccagccatccttggtaccgacttcatgccattcgccagcctcatcctggtattccagcgtctggctcttcggccaagacgcacgaccatcgtagtagaagaaggtcttcacttcggtgatggtctgagcttcgtcgaaggtgaacgtggcgaccgggtccaccgtcgaggcggtggaagcccaagtggaccaaccctttgacgtagtgtcaccatcgatggccttggaagcggaggcaccctcctggaagttcaccgagaagttcgtgccagaggccgcggcgatgttcttcacgcctccgacaaccggaaccacaaaggcttcgatctcggtagcgttcatgaagtcgccgttctgcgtgttgacgatacgcacctgcgtggccttgagtgaaccatcttcaggagtgaacgtaacagtctgcccggctttgggcttgacctcgctgccgaactgcgtccatgtggtgccatcagtggtgtactcagccttggcggatgccggagccttgtcaccataggtgatggtcaggccggtgacttctcgctcttcgccgaagttcaccgtggcggtcgggctggcagagtaatcattctttgcgttccacgtcacccaagcctcggccgacgtatcgtcatcggtgagcttcttccactggtcgcccttgctgtattccgtctgctggttggtcacagtcaggttggaagcagtgtcggccacattctcaggcgtggcggcggtgacatagatcgtacccttcagcgcaatcgtggtcgtgtcgtccagctggtaggtaccggccacggcaatgttgtcgccagccttggcctcggcgagcttggcatcaagcccatcgaagttccaagtaaccttagccgcatcgccctcgaatgcaggcgatgccttgacgtgcaggtacaccggctcagcctcaagcgcagccttggcgttgcttgcactggtgccggccagcactgtggcggataccggatcggaaacagtgaaggcaccaacgtagaccgtggcggtgacgttgaactcattgccgtatacgtcggcggcagtggcggtggcctcgtaggtgccttccttggccacatcgaccttggaagtatcccaatcggcgaccgttgccttgccttcgccccaggtgtagtagagcgtgacttcggtcggcagtgtagccttggcgttcacggcggtctgcacgttcacggttttctggccggtaggcgttacattgcgcaacgtccaggtctgattggcggatggcgaagtgccgctcggcgattgccacaggccaaccttcgtgccaactgcggtgccagagttatccacatcgaggttcgtcttagtcgcggcattgagcagctggtaggtcgaaccatcggaagtgttgagaatccacttggcagccgggtcggacttagcggcctcaaccgtttcgttggaaagcgcgttcgtgccatccttggacaccagcaccttgccttcggcgttagtaatcacataagccttgagatcagggcgctcggagtcggcgggctgctcgatctgggtaaaggtccaagtctgcttcttggcgttctcggcatcggaagcgacgttggccagggacagcgcggaatcaccagaagtggtatcagccacggccttgccggactgcttaccaacgagctggtaagtgtcgccggtctcgacggcagcatccttagcgtagccggtcacgccagtgagctggatggaggcgatagaacgggcgggcacagtgaccgtagcggtcttggcagccttgtcaatcatcacagagccttcagcttgcttgacgttgctggtcttggcgaagacttccggagtggcggaatcgacacccgcgttcttgtcttcggcagaggtttcggtggtcaggtagagctcaccgtaagcgttgtcggcaatctcgccgtacttcgacaggtcgatgacgaaggtctggtcagaggtgccggagttgcggtggatgacggtctgtgtcttgccatcgtcggaggtggcagtcatgttgttgtcctcatcgttgttggcgatgaccttgtcgcccgcgtggatgaagtgggtgatggccttgacgccgttgtacttggcgtttgcaataaccgtgcacggttcaagtccatcggtggtaccgccgttgttgttcacgcggcgctcggagtagagcttgccgtccatgccagccacggtgcagtcgaagtcgatgagcacggtgccccagttggtgttctcaccggccggattcacattcgagcccatctgcatgttgtagaggtcctcgaccacctgccagaaggtgaagtccttggactgcaggcgggtgacgttggagctgatcttgctcatcatgcccagcgcgttgtcgaaaccgtacgggttgtaggagccagactgccaggagccgtccacctcgctcatcgacagcttcttgccgtctgcctgagcgatatcgcgcgactgcatctggttgctgtcggagtaggcgtgaacgttgtactggccgataaggtccttgatcgcctgcgggtactggttgtacgacttgacgaagtcggcggagttcgtggcatcggtggctgcgatgatggtgtcatcattgtccttgagcgcctcagcgagtgcggtaatcgtctgctgctgctgggcgttgctgacatgcataccctcctgcggcttcttcagcgcgttggagtatggggtgacggacctatctttgtcggagtagtacttatcccagtagttgttaatgagcttggtgttgtcatcactctcatcggtgtacttcgaagccatgtcgcccggagtgccccagtaactggtctcggactcgttgaacggctcgaccgtgtcaacgtttgcgccaaggctttcgaggtgctcgacgttcttggccatgtactgagcgaatttctcagggtttgcaagattattgctaccggagttgcgtccaccagtggcgtaaccgctgttggtcaggaaccacggagcggagttggcgaaggcctctacgtcggtgatgtcagggttatcgccggtggcaccgcgctcaatccaccagtcttgggcggcggacttggagaagtcatactggttgtcgtcagtcgggtcgaatgccgcagccagcttgtctttgtcggcctgcttggtggttacgccattgccatacgtgccggaaccggtggcgtcatctttccacgtgccaggcacggcagcgccttggcgcatgaatgggtagccgtaggcaacatcggaggcattgccgccgcccacgttgtagcgggccatgttcaggtccagtccttcatcaccgaagatggactggtagaactgttcgcgcagctgtttgccgtattccacagccttagccttggaagcgtcatcgccgagattggtggtgatggccgattcctcgccgaggctgccggtggcgttggcgaaccaagccagtgaggtgccccagccatcgaaactgttggcataccacgggttcggggtcacggtaatggcatcgttatcagccgcatacgcagtgccggcaaccgcaaacgcccctcctcccactagtgttgccgccgcaaccattgcagcaagcgatttgctcagtaccttcattggtctccttagtgttcctgctgtccgccttataccggaaaaatcggcctttgcttcactgagccggcctctttgcctgatacatgacctacgtcgactccttctttcggcgcagccaaaatgtttacgcaaacattttgatatgagcgattttatcacaaaaccgtcacccagcaaacaacttcagagaccacaaacgacgcacaaagtcatgagccattcgaattgcgctggcccaatcgctacgaatcatatttgccgtagcccttaagtgaatcccactgcatcgagatatcgcgcccgctatcccttccgataacgccgaccacgcgtgttgccttcagcaatcagctttccttgcgcaactaaaccgtttaggaatttgcggactgttctgttatcgagctctgttatcttggcgagttcaggtacagtcacatagtcaacctctgtcaagcgtcgattcatcgccgacagcatcgctgcccgcgaatcaatttcacccgatgcggttgcatctgctttcttaccatccacacgttccccgccaatgagcctcgcaccctcttcggcatctttctcaactacagatctcacgctagcaaaaccagaaccatccacggtcttcagcgcaggaacaataggaatcgtcgcctcgaatatgtcaccatcgcggaactcaggctctcgctcagtatattgccgggacgctcttatcagattccgcagtccgctacccagctgctcggctatgccggtctgcacaaacacattagcgataatcggattctttggcattggcgtgaactcgcccagcttcattcgaccttcaaagaatgagcgcgaagcattaaccgtccggatggattcattatcaatggtgacacgcgccaccaccggactggaatactcccgatgcatgaggctgtttgccaccaattcacgggcgatcatcgtacgcgggctcactcgcttatcgccctttaacacaaagcggtcaggcagattccgctcagtaaattcacggagttgctcgtacgaatcgaacaagttggtccgcaccataagtcggtcatcgtatcggtcaatattgtctcgccgaaccacggcatcagtaatatacgctgggcaaaccgaggaaatgacttcatccttgcccaagagcagcactgcagcaagattaaagccctcttcgccggtcgtgtaatcacgatcgtatagcttggcgctgcggaacagttcttcgtcagacatagttccccaagggtgcccagctcgctgagcgaccgccagctgccgcattcgcgcaatcagctcaggacgcaaatcaaacggagtcacgtaacggaaaattcgccgttcggaatagtagttctgcttgcgaatatacatttgactaatctggatatcgctttcgatgtgtgtatccacatcagcaatgcgatcaaacactgcgcccttgaaccgcacaaccgaagaactcggagctacccaaatacgaacaataatccgttcgtcgtactcgatatgttccgtttccaccattggagccggttcgaacatcttacgattagacactacgttgacaacgttgcgctctatctcactaacgcgcttagaatcgacgccgagcacttgaccgtcatcgtcaacgccaagataaatgctgccaccagaacgattggcgaatgagcatacagtctcaaaagtatccgtatgaggcaattcgctgcagcgcttgaactcgaccatagatgattcaccggcctgcagcacttgcataagttcatcctgcgtcatcgcattccgcccttcatagcgataattcatacattaggacatggcacttatcgtattttagcatctaattagtacattaggacattgttttatgtcctaatgtactaattaggcggctaattgtactaataattgcacactgatgtactaatccgatgatcgaatgcactaattgtccgcgcaaatgcactaatcggatgaccgaatgtatcaatgagacctataggcagccgattggctgacgatcagcccagtcattggctatcggccgctagccagtcagccgccaacagccaacagccacccaactaatagccgccagccaatcagcccgtccaatcactccttgtgttccagtgcggcctttaaatcgcggctacggtagcgttcgcgcagcatagagaatccaccgaagcccacaagccacaccaggccggcaatcgcggaattgcgcgtatcgtccgcaaggaacaacgtcaggtagatgaacacgaagaacacgattgccaccgtattgagcaccttccaagcgggcatgacgaacccgtccggaatgaaatcagcggagcgacggtacttgcggtgtgccatcagcgtcaggatgtagatgaacaggaacaccgcggagctggcggacgagaacagcacgaacgctccggacacaccggggatggcgttgacgatcggcgacagcagtatcagcgccgcggacaccaggatggcgcgggccggcaccttgcgatcggacaccttgccgagcttgttcagcatcgggttcggcgacacctcggacagctggtacaggtggcggccagccgagtacagcagcgagttcagcgcggaagatgcggcggtaatcaccacgaagaacaccagcgcagacgcccaattcagcccggcatactggaacaccataatgaacggggatgcgaaggagccgtccttgttcggcttgaacgaggtccacggcacaatgcacatgatggccaccagtgcgcccacatagaagatgagcacgcgcacgataatctcgttgatggccttgggcagcaccttgcgcggattcttggtctcggagacggtgacgcccacgaattcaatcatctcgtaggcgaagaacaccatctggaagctcatgaggaaggccatccaaccgttcggcgcgaacgagaagttggcgaacaggttgtcgaatccggcgtggccggccgggctcacgtggtccacgccgtgaatctgcacggctgggtaatggtagccgatcacgatcatgaccacggcggtggcgatcatcgcgcaaatcagcgtgatcttgatcatcgagaaccagaattccacctcgccgaacaccttgacggcaatcaggttgatggagaccagcgacaccaggaaacacagctcgatcagccatttccaatgggtcaggtcgatgccgaacgtgtcgaagaaggtgatgaagtacgtggagacggccgtgatctcggtcatgcccagcagcacgagcgcggcccaatacgtccagccggcgaaatgcccccacccgttgccaaggtaacgggtgatgaaattgatgaaggtgtgctggctggggtcacggtacatcatttcgccgatggcgcgcatcaggaagaacatgatgacaccgaccagaatgtacacgaagatgatcgaggggccggttagcgagattgacttgcccgagcccaggaacaggccggtgccgatggtgccgccaatggcgatgaactgtacgtggcgattgctcaggccacgctccatctcgttggtctggtccaggctttcgacagacttgagtttgcccgtagcctgctgtgtaccaccattcacattcgtatcggccatactgatttcatttctcttctctgccgcccgattgttacgcaccagacgcgatactcgttcaaaacaagttcaaactgtatcaccgaaatatgtcacgaaaaccgctcagctcaagaatacatgcgatgatactgtaaatattccgccaaaaagttcaattcatcaacaccaaattgaacttctacctctattccacggacttgagcgagctgaccgggtctacgcgatcgagcactgggttggtgaacagctgcaccagcagcgcgaacgccagcgtcgccaccacggcaatcgcatagctgtaccagtgcacttccacttcgaaatacagcgacggcatattcaacgcagcagtcagtaatccgcctatccacctgccaagcggcagaccaaccaccacacccataccggtcaatatcatcatctcgcggttcacgtagttgtgcacctcgcggtcatagaagcccagcaccttcagtgtggccatctcgcggatgcgttcggacacgttcgtattggccaacgtaaacagcaccaccagcgccaggccgccggcgagccccacaatcagcgccaccacggcacccatcaaatcgaacttaaacgtggcggccagatgcgcacagctcacggccttgagcaccgacgattcctcgcccaaccgatccgcatattcggcctgttcggtctcggaacctttcagcttggcgagcatcgcgttccacgtcaaggtcgaggcagtgccatctcccgaagccgaagacgtcacaccgtcggccgcaaacttctggtcgtacagtcgctcactgatgtacacatcagagccgatgaggttgcgcgtcaccgccgcaaccttcaccttggcccgcccgctgccgccattgcccagcgtgacggtgtcgcccgcatgaatatccaacgaattggctgcggacttcgccacaatcacaccactatcgtccagcgctacagtgccgccacccgctttgccgaagatattgggcagctcgaaccacccatcgtcaccggcctcttccagcgtgaccatgtcgttcagtttgttcagcgaattgttgggcaccgtcatcagctgcacggtttcgctttcctgcgccgcattgctcatctcgccactatccacgcgcagattcagcgtttcggtggtttggccatcttgtgccacctgcttgcgcatcgcggcggcgtcatcgtcattggccacgaccatcaagtcatactggtagatctgctcatattgcttgacgccagtcgtgtcgacggtgtcgttaatcgcaaatccgcagataatcagcgctgtgcaaccagccacgccgcccacggtcataatcaaacgcgacttgaatcggaagatattgcgcgcagtgactttgccgaggaagttcagccggctccataccgggcgaatccgctccaacaatatgcgagcgcccgccttcggcgccttcgggcgcatcagcgcggcgggcgtgtgccgtatctcctcgcggcaggcgagcgcggtgaccacgcccacaccgaccacgaacagcacgatgccggccgagccgtacagccagtcgtattcaagtcgcacaccgggcaatatatacagtccctcaatcaccaccatcaggaatgccgggatgccgaggaatccgaccagcagaccgatgccgccgccgaccaagcaggcgagcaacgcgaacagcagataccggctggacacggcgagtccgccatagccgagtccaaggtaggtgccgataagtccgcgatcttcctcgaccatgcgggtcatggtggtcaggctcatgagcacggcgaccagcaggaacacaatcgggaatgcgcggccgatggattcgatggaactgacatctgatttgagcgagctgaatccgtcgatcgaagcgcgcgtctgcacataccaacgtgcgttggccacatcgtcgatgcgccgttgctgcttggcgaattcgctttccgcttcgcttcgcatcgcatcgagtgcagactgcgcatcatccagtttcgccttgccgtccgcgagctgttgttcgccttctttcagctgccgctcgccttcttcaagctgccgcttgccgctggccagttgggcggcctgcgcttcaagttgcgccgactgggtttcgagggttgcggcattcgcttcgagttccgcggatttggtattgagctgtgcctctcctgcagccgcttcctgttccttagcggtcagttgcgcgttctgctggtccaaggtggattgtgcgggggcaatggtttcgtttaatgtgcgctgcaaatcggctttctgctgggccagactgtctcgctgcgtttgcagttccgtttgcttggcggtcagctgttgccgcagatcgctgattgacggcacttcaggcacggtaatgccaaggcgcgcgagcagttgcttgatggcctgccatgtgggtgagttgaggtcgatattcgggtcaagttgcgccagtagattgttggcctgttgaatcatgggcagcatctgatcaatttgcgccatgccttggtcgatttgggtaatgccctgttcgattttcgtgcgattggcggtcagttccgtttgcgccgcatcgagctgtttgcgagccgaggtgagctgcgttttgcctgattcgagctgggtgcgcgcttcggctatctgctggcgaccttgcgcgatctgttgacgggccgttgcaatctgcgcacgtccatcggcgagctgccgttcgccatcggtaatggttgtcctgttgttctccaattcggtacggctatcttgcaatgtcgtttcgttggcttccagctcggcccagttgtcgtcgatctgcttctgggcttcgtccagctgctcgttggcctcgtcttgggcatcgtccagtttgcgctgcgcgctggagacgatctgttgacgacgggctttctggcgtgtggcctgtatctgatgttcgatacggtcggccacggttttgatggcttcatcgtaggcatcggaaaacgtgtcaaaatcggacgcaccagtgacggcaaccgatatcgcagtgtatatattgccggtcacgccgtcgctgggtgcaaagaacgtatagtcctcggatgaggtggaccggaaggaggtcatgcccgaatagccgtctggattgttgaggtcgcgcgggtcgagtacgacgccggtgatggtgagtttcgtggggaactgcggggattgctcggcgtcggcgtccgtattggcgtcggacttcgcatcggatgccgaggcattggcggcgacacctaccgtatcggcattattggaatcgtcagtctccgtggccgctaccgatatgacggatgaagaggtgtcttgtggcgtcacagtaatggtgccgccaatcttgagtccgctatcgttcaggaattgctgcgtaaccgccacttcgccggccttgttcggcagtttgccctgccgtatgtacggctgatcaagcccttcggtaccgatttcctgcatggtcacggttttcttggtgccgtccaccaacgtggtcaccgtctgagaacgttcgggctgcacggtttgcacaccgtcgattcggcgcagtgccgccgcatcatcatcggtcaggccgtatgtggatagcacctgcaggtcatgcagtccctgctgatcgtaaaaacgaccggccgccagaaaagcatcgcggcatccggcgtagatgccggtcagcacggccacgccaagcagcgtgatgacggcgatcgagacgaacctcttccagctgcgcagccagcaacgcaacgtatctttggcaaataccgcagaaacgcccgctcctcgaccgccgctatcgtcgaggttccgccgtttcacagaatgtttcacaggttgtttcacgaatcgcctcgcttgtttcacggggcgtttcacagagtgtcttgcagtgagcatcgccaatcacctaccattcgatatcggcgatgggccgcggcgttgcgttgacctcctcgctggtcaccttgccggagcggaagcgaatcactttgtgagccatcggtgcaagcgcggaattatgcgtgatgatcattacggtcatgccttgtgtttggcaaatatcctgcagcaactgcagcacttccttgccggtctcgtaatcgagcgcaccggtcggctcatcgcacaacaacagcttcggctttttggcaatcgcgcgggcgatggatacacgctgttgttcgccgccggacagttgcgcggggaagttgtccatcctctcccccagtccgactttgcgcagcgtttcctctggatcgaaatggtcagggcagatttgcgaggcgagctccacgttttcgagcgcggtaaggttaggcaccagattgtagaactggaagacgaagccgatatcgttgcgccggtaggtcaccagttcctttttccgcagacccgtaatatcgcgtccgccgaccactacgcggccggttgtggcggtatccatgccgcccagaatgttcaatgccgtggttttgccggcaccggactgccccagaatcacgcttaattcgccttgttcggcggtgaagctggcctcgtcgagcgcgcgaatcacactgctgccagaaggatattccttgaccacatggtcgaattcgatatacgccatcgcacacctccaacgcgctcgtggcagccacctagccccataggccccgccagaacttcctgctatactcaagtaaaacaacactgtgtcggttctgcaaccaacagttggattgtgggttgtcggaatttggggagaaggccatggccaaagaattgacggaaagccgccgcacccgatacacgagacgtgccatgcaggacgcgcttatcgagttgctgcgcgatcagccgctcggctccatcaccgttaaagcgttgtgcgagcgggccgatgtgaatcgttccacgttttacgcgcattatgcgagcatcgaggaactgctgcacgacattgaagacgaaaccatggcctgggtcaccaccgcactcgaacagctactcgcccagccagatcctgccggcatcgagcatgttattgagcgcatctgccagtacattgccgacaatcgcaatcatctccaagtgctgatgagcccgaaagcggatatcggtttccagcagcagctgctgggattgatttacagccagcgcggtgtaggcgaacagttgcaatcttcggcgggttacccagccgaggcgcagatgcgtatgcgattcgccgtgtccggcagcattgggcttttgcaatattggctcgccaccgatctcgcggcctctcccgaatcggtgtcccacaccatcttcaccatgtgtatgcctgccacgcagtgagcacagtgaattcagtgaactcagtgaactcagtgaagcgtgcggtttcataagcatcgctcgctatagcttcgcctgctcaccggccgcgcccacgcccgcgcttgcaatagcgcacaaatagacgattgaccatttctgagacgatacggcggcatagaataacgaacgttgcgcatcacggcaagccccgcgtgcgccaaacccaagaaatgtgagagaagagcacaatgagtactactgatgcgcctaagaagccgcgcgaaaccgacgacgtgccggtgccggccacgctgcgcaagtcattgaaaaaccgccacatccagctgattgcgctgggcggcgccatcggaaccggcctgttctatggttccagtgaatccatcgcgctggccggaccctcgattctgctcgcctacttggttggcggcctcgcgattttcgcgattgtgcgtgcactgtctgaaatgtccgttgaggatccgaaggcgggcgcgttcagctactatgccacccgctactggtccaagcgcgccggctttatttccggctggaactactggttcaactacatcctcgtctcgatggtggagctatcagtggtgggttcgtttgtgaactactggttcccggcgattccgacatgggtgtcggcggccgtgttcttggtgatcatctgcgccgccaacctgctgggcgtctctaaattcggtgagttcgagttctggttcgccatcatcaagattgtggccgtgattgccatgatcgtcggcggcctggccgtcatcatctttgccctgcccaccgcatccggcgtgcgcgcaagcttcgcgaactggttcaccgtgggtaacggcttcttcccgaacggcctgatggggcagaattccgacggttcctggaccggcctgctgatggcactggttgtggtgatgttcagcttcggcggcaccgagctcatcggcatcaccgccggcgaaaccgaggatccgaagaccacgattccgcgcgccaccaatgatattatttggcgaatcctcgtgttctacatcggcgctctgggtgtgatcatggccgtagtgccgtggaacaccatcgatggcaagtccagcccgttcgtgcagatcttcgattccgtgggcattcacgcggctgccggtattttgaacttcgtgtgcctgaccgctgtgatgagcgtctacaactccggcctgtacgccaactcccgcatgttgtactcgctggccaagcagggcaatgcgcccgcttacttgggcaagctcaactcgcgcggcgtgccagtggccggcgtgctgacgtccgccgcgatcaccgccatcgccgtggtcgtggtgttcgtgtggcctgagttcgcgttcaactacctgatgtcgattgccaccattgccggcatcatcaactggacgatgatcatgctcaccgaaatgaagttccgtaaggtggtcgccgcgggcggcgctcccgaggattccgagctggccggtctgagcggccaggaggcactggacgcgattcacttcaaactgccgtttgccaaggtgaccccgtgggtggtgctggcgttcctggcgctggtcgtggtgctgatgtgcttctccaccagctaccgcatcgccgtcatcgccggcgtgatctggctggccatcctcttcgccgcctaccagctcactcaggcgaagaagtaaggctccatttgcgaatagctctcactgatgagcactcagtgagagctattcgcaaatgggatttattcatgaaacagctcatcgatgccgacgagctgaacgtcggattgagacgccgcagcatcgtcgaccagtgattgatcgaaaccgccgagcgaaaacagcaggtatgttcgctggccgataccggttcgcgcagcacggtctcgcagtagattcagcacggaacggtccaccggcgcattgcggaatttgcactcgcccacaatggcagcatcagacgcattgtcaacggccatcacgtctatctcatcctgacgatcccaccaacggccaaccgcacgcgcacggaagggcaaccgtccagcagcactctcacgccacatccattcacggcacagaccctcgaacggtttgccggcaaaatcatgtaataccggcttgatatgacgctcgtatacgccttccacatcgccccgctccaattccgaacgatacggaaagacaaacgaataccagaatcggaagaaattgtcgctcagctgatacagcccacgcgaacctttcgcccgctccttaggcttcgccgtgactgggaactcacgttccacaatccccagttccataagattggcgagatacgacgatactgttgcgtttgccatcatcgtgtgtgtcgcgatctcattcagcgaagttgcgccgagcgcgatcgcccgtatcacgctgttatatttcgcagtttcccgcagttcttcgtgcaacaaaaattcaacctcgctgtatagcggagcaatgcgtctcagaatatgccgcttgacatttgcgtctatggtctcatctgggtcaaattcctctaggtaacgcgggataccgcccagtattgcgtaggccagcgccttatcctcgctactatagttggggaagaattgcgctgcatcccaatatggcatcggcagcatcttcaggatgccggtcgcacgaccatatagcggcgatttttctcccaacagctccttttcgatgaagctcatggcactgccgcaaatcacaatcatcagatttgcatgacgcaacgtgtggtcccaaagattctgtagcactgacggcaatgacggatcagatttgaccagataaggaaactcatcgaatatcacaagcctgcggccgccatcgctcggctctggcagccgggttaactcggttaacgccctttcccaagaaggatattgactcagataatccttgcccggggcacccgcctcgaacacgagacgggagaacgatgccagctgttcatctttagtggcattctgcgccgcgaagaataaggtttccttgtcttttgcgagttgaataagcgtctctgtttttcccacgcgcctgcggccgtagacgaacacaagctgtgccctacgctcagtgaaacattcctgcagttgcttgaggtcatcgtctcgtccgatgaatgccatgctgcccgcctcctttatgccatacgccggcgtatttctatcgcatcacgatttattgtatcacgattagtataatcgtgattatacaagctgtgacgaggtgcgggtacgggccaatttgcaaaaaactctcactgagggggaggtggtgacagctttgaggtcgagcttgccgcaggtcaggtagaccatggtggcgaagtagtccatgtcacggaagccgcgggcccgtctcttcacgttccggacgacactgtcggcaccctcgaggacggcgttggcgtacgggtgctcgaagtacgcgacgacctcggcgaagcggcggcggatcagacgggcgggttccttcacgggttcgagcctcgagtgtatcatccacgagcacaggcggtatagcctgacccatgccccggcgggcggctgtccatgcagatgccctgcaggacctcgcgcatccggcacgcgcgggcggtcttcagccgctgccgcgtgaggccgcgcttggtctccagccgcaggtcggagagggccgcctcgttcccgagccacaggtacttcgtcctcttcaacagcccgttctcccgcccctcggccttcctgaccttgtcgacggcctcgttggcgtgcctggccacgtggaacttgtcgatgatccgcctgacatggggcaggtgctctgtgttttagcaagttggcgtccgctttgtgagcggtgtttttccgcagtgtaggcagcgggttttccgcagggtgtgcggtatcggccgctgcctgtctgcgttgtgttggttatttggtcatgaggatgctccaccacctgggccgtcgtcatcggcgtggtgaaatacaactccaccgcacgctctcgttcctcaagactgaacatacgaaaatccttccgttcggtctccaagaaaacgtccgcagccccatttacctgcattcgacgcaatcaatgcagcagcattacagcagcaagccgattgagcaaaatagcaaaagccgccttgcgcaaccgcaagacggctttgacgacaatggtgaggctgtgctcgcttacttcttggaagcgttcacggcatccacagccttctgcagcgattgagtataagccttgtaccaatcagcctgctcgttgagcttcgcagtagcggacttgaagccggcagtgtcgtcagctacgcagccttcgtataccggcagttccacgctcagttccttgttgagggcgtccagcgtggaggcatcctttacatccttcttggtgagcgcagcagcttcggaagcatcgccattgaccaagttgttgtagtcattagtggcgttgcgcacattttcggaagcggcggcgcaagcggcgactgcattgttgtactgagcatcggagtaggcgcggaagccgaacacaccggccacgacgataatggccacgaccaccacggcgataatggcgacggccgccttagacatgtgcttcttctgagcgccttcattgcttgcattgttggcgttgtttgccggtacagcctgctgcccagcggacatacttcgatctccttcgttctcgtactttcatacacacgtatgcgctcttagcgctcttatgcgcactcatatgcagggaagtcgcttttcaagcggctacttccctgaaaacaaaaaaccctcgcattccgcgagggtcattggctgggatgcctggactcgaaccaagaatggctgaaccagaatcagctgtgttgccaattacaccacatcccaatttggcttggcgtagcaactccaaggagttgttcgtcgtacccccaaccggatttgaaccggtgttggcgccgtgagagggcgtagtcctagaccgctagacgatgggggcatattcagtttttcaaccggctgctcggtgaaccgcgcaacgagtgataaatatacgcaagtattcacccttacgcaacttacggcgtgtcgcgcggaatttcaacgatttcaagtgctacgctgccactactgatgaatttgcatgaactctactgacggattatcagtaagcactactgatgaattaccatctaatgcactgatgaaattgcagatgaggcaatgatctttgccttgcacattcatagccggcaaatcagccttcaagaaccaaatgaggcgcttatgttcccttgcgacagcgagcgcgtcgcgatgcttgtaatgcaatgtcacgtcaaagaccgccgcccggttacctatcaaccgtttcatggacgcatgaaggcgaaaccacctacaaggcacgtttcgtgacctcactgcacaaaccagccatgttcaacctcgtacatattctcactggcatgcggcgcagcggtaagactttccagctgttccagctcatcactgaatacaagaaaaggtgggcatctgcacatgcagacgcccaccttgagtgtccttacagctcagccgagcacggaaggaaccttagctcacaggtgctcgcgcaggcccttcaggcgagcgagggaaaccggcttgccgacgatctccatggactcgaacagcggcgggctcacgcgacgaccagacatggccacacgcaccggaccgaaagcgaggcgcggcttgtagccgccctcctcaaccagagccttgttcagggtctcatgcaggttgtcggtcttccagtcagcctcatccacagcctcgagtgcggcgatggccttgtccagcacctcgccggcagaatccttcagctgcttcttggcgtcgtcagccggctccaagtagccctcggtggagagcagggagccgaccatgccggcaacctcacccagcaggcgcacgcgcggctgaaccagcggagcggcggcggtcagcacctcacgctcacggtcggtcagggcatcccagttgtcggcggaaaccacaccgtcgcggtgcaggtacggcaccgagcggcgcaggaagtcctcgggctcaagcatacggatgtgctcggcgttgatggagatggccttgtcgatgtcgaagcgggccgggttggccttgacgtcgcgcacgtcgaacttctcggtcatctcgtccatggagaacacgtcgcggtccggtgcaatggaccagccgagcagggccaggtagttgagcaggccctcgcggatgaagccattgtcgcggtggttgaacaggttggactctgggtcgcgcttggagagcttcttgttgccctggcccatcacgtacggcatgtggccgaacagcggcatctccttggcgatgccgagttccataaggtaacggtaaagcacgatctggcgcggggtggagctcaggaggtcctcgccgcgcagcacgacgttgacttccatcatcgcgtcgtcgaccgggttggtcagcgtgtacagtgggtcgccgttcgggcgcacgatcacgtagtccggcacggagccggccttgaactcgatggtgccacgaatcagatcgtcaaaggcgatgtcttcatcaggcatcttgatacgtagcgcaggcttgcggccctcggcgcggaaggcggccttctgttcatcggtcaggttgcggtcgtagccatcgtagccgaactcggccggacggccggcggcaaggttgcgctccttgatttcctcaggagtggagaaggactcgtaggcgtagccggcttcgagcagcttggcggcaacatccttgtagatggcggtacgctcggactggcggtacgggccgtgagggccacccacatcgatgccctcgtcccagtcgatacccagccaacgcagggattcgaggatctggttgtagctttcttcggagtcgcgcacggcgtcggtgtcttcgatacggaagatcagcgtgccgccggtggcgcgagcttccgcccagttgaacagggcggtacgaatcatgccgacatgcggggttccggtcggcgacgggcagaagcgaacacgaacgttcttgggcagttcgggtttggtgttttcagcatcagtcataatcccctattgtgccgcgcgcgccggacgcggagagcagcgctcctcgctcttttgcttcgttattgatgtttcgggccaacaccatcccaaaacggccattttccaacgaaatctcttttgcctgccatttgcttttcttttaaaagcaaaatcaaaagaaaagaaaacagcaaacgagaatcagcaggccaggcccacgaacagcagatcccagtcttgagattcgtcttcgtgcgattcgcgctgctcaacggcggcatccgtgtattcgtggttcatggcattccctacatctctgtatgttgctttatgcatagcgccaaaagcttcgtctgctttccagttccgccccgcaactgtgcgcaatattcatgcaacaggttacacaaccgatcgataacgttcaccctcaactgatatcgatttgataaccatcgattctttccagtgcattcaccacaactttggacattatttggcgcaattgttgagttttccactcatgcaatggaagaatatgatgtgacacataggtcttatgaaaggggaatcaatgtctgatcccaacaatgtgcctttgcctcagcagcctgaggccaacggtacgcccacacctaatcccgtaccgcagtatggcgcaccggccccggcgcagccctcacagccggcgcagcccgcttacggacagccggcatacggtcagcctgctccgaccgcgaactcttatggccaggccgtaccaacctacggtcagcccgcgcccgacgccaacacctacggtcaatccgcaccggcgtacggcacaccggcccccgatggcaatccttacggcccggttccgccgtcttacggccaatacgccgcgcccactgccactgtgccgctggataagccttactacggatgctccttccaagaagccttcctgcgcttctggaagaagtacacggtgttcaagggccgcgcgtcccgcagtgaattctggtggtgggtgctggccgctttcggcatcaatatagtgctggacatcctcaacaccgccacagatgaaaagcttggcttcctcgccaccatttggggtctggtgaccctaatccccaccctggcactttccgtccgccgtctgcatgacacgaacaagcctggctggtgggttgccattttctatatcgcgatggttatcggccttatcatcatgattatcggcggtggtgcggcactgtacggcgggttcaggagccttggcagttatgactatggttatggcagcatggccgccggcggtcttggcgcggcggtcattggtgcgttgattacgctggccggctgcgttgtctatatcgtgttcatggctcttcccagcaagccggagggcgcacgttttgacgatggcgcggcggcaacccccatgcctcagggtgcttacggcgcaccatacagcacgcctgtacccccgaatttcgccgctccgaacgcgcctgcacccggcttcaaccagccggccccggcttacggccagccgcccatgccaacccccgactatggccagccggctgcacccgcacctgattacggtcaggtgccggccccgcagtacggccaaccggaggccccggccccacagtacggccaggttccgccgatgcctcaaaacgccggcgccgaatccgcaacaccttctgagcacacggctcccgccggcgacaatgcccagaaaccctggcaaggccagtaaccgatatcggtgaacttccgttgaagaagttccccgcaaccaatgatgaagccctactcaacgcgagtagggcttcatcattctcggcactgtattatcggcactgtattcagccaactaccccaacggcatcacggcaatggactgcgaaagcatatacgattcacccggactaagggcaacgatacggtctcggcacgccgctgcctccacggccacaaagccacgccattcacccgtcttggcatgggcaatggcgttgccgccctgctctccgggattccacaccaccgtctgcggcgagccggtcttgccgatgcgaatcacacgacccagcacatggtcctgcaattccagtgcagcatcggaataatacacacggtccaccggctgatcgccgaacatcaccgatggctgttcttgtagttttggcgggaatccggcttccgtggcatccagatatgttgcaccccgcaaaccgaccagccgcgcgccgagcacatcgccgacatgcagatacgagtgcagcgccgcctcatacgacatcggctcacctcccgtgttggtaacggtcagcgtcatcgtcagcgtatcgctggcacacacctcgtatgcggcacggaaacgcacgttgggttcatcctcgatccatggcacttcgccagtcgtcagtcgttcggaatccagcacataccgcacacgggcaccggtaaacgcctcttcgtccagcgcccactggcgcaatcgtgcgaacccatgaatcggtcgcttcgcagtctgcccgccatgcacaaaccccggcccgaaccaggggaagcacaccggcactcccccgccaaccggctgaccagcttcgaaatgccatgtgcggggcgtccagattacatccggctgccccgccggggcccagcgcagcagatgcgccccgtaatcgctgattaccgcgctaccgccgtcattggtgagcgtgcgcagattgacgccattgcccataagtgtttcttcttccgttgcgtaagcgatgttcttcaccacatagacgatttccttggcacggaggaatcgcgagcaggggtaagagaaccgatcaggcgggctaagctgccttgattctcacaactccacggtttctttgccagggtcatctttaatgtgcgcaaacttggcggccaaggcctccttgttgcgcttttcgtcttcttccttggccttcttcttggcttcgtccgggttccagagcacatcgtcgcggtgcttggtccattcggcaccggccagcggggcaatgtattcggcggtggcggtcagcgtgtccgcgccagcggccttagcgcgcgtatcaatcagctcaagaatctgctgatcggtcaggcatatgcgcggaatcgagcactgctcgcgcagctcgttgacgtacagcagaatcggcagcaccttgaccgcctgagctgcggcgtcgccatcgtgttcgccgtcaccggtcaccacgctcagcagcgcatcgcacacggcgagcgcagtggcaaaacgggtggccacatcagcgggctcgctggacgtagacagacggccctgcgcggcgtcgtcttcaatctgggcttccacggcggcaatcgtctcacggacctgagccgcaacatcggtgtcccaacgaacgtccaacgcttcggcggcgtcaaagatcagctgtacatcgccggattcggagtagtcggccatcgtgtcgtaggcatcgttggcggccagcagcgtatcgacgatgttctgtggacggccgggaatctcatcggcgccttcatagacgaattcggcatcgggcaccgtgacgtcttcaccggtcagcacgcgggcgaatgcgcgcgtgacgcgaacctgcagattctccgcgtacttggcgtcattgtccatctgcatagcttcggtcaacggccacaggctgatcagcgccgagccggcttcggcggcctcagttaccgtcggcaatgccgtgacctgtgcgattgcctcacgattgagttcaatggtcatctatgctcctttgcgtccaccactcgattgtagtgcgtctcttgactcccctcagtcacctacggtgacagctcagcagcaattgtggacgggccacgcccgcgcctcaatagctcgcctatcggctcgtcttcgcctacaaacagtccactggactgtttgcttcgcggctcagcctcagagaggggaaccaatgtcctaacaccagtgtgccgttacttgacgttggccgctgggtcgacatacgtgattgacatcacacggccggtttcgttgtcgtacgtcaccgaggtcacggaggcgagcgccgtgtgccgcaggaacatccagtgctcggggtggccggtctccagataatggcgataactgaaaatcggcgattcgtggctgaccaccacaatctgctcgccggggtgctgggccaccttctcgcgggcgaagtcgtccatacgcgccgcgatgtgctgataggactcgccccagctcggcttgtacaggttggtgacgagcttccagttgccgttcttccacagcgcgccctcgccatggccgatgcgcttgccacggaactcgttgccggcctcaatcacccgttcatcagtagtgagcgtgagcggagcctcgccacgagcctcgcgcacggggttcagcgcatcgagaatcgcgccggcggtctcgcgcgtacggtcgagcggcgaggagtagacggctgcaatcgtattggtttggggattcttggccaagtacgtggcggtggcttgagccatgcgacggccaaggtcggaaagatggaagtcgggcagtcgctcatagagcagatggtcggggttatataccttgccatgccggacgaaatggatggtagtagcgctcatgagtcgcctttctgcttcccgccctgaagggcataagaacgttgtcttaatatccccaatctaccgcgtgtcgcggagtggacacccgtagagtatccatgacgcaaatatgcggatgggggaaaatccgacgcaaactttgcgcgaccatggacaacacatcattcgatgagggcttcgccggcaatgccacaccagcgggggacatccaatcgggagcggaaaggagcgtagtgctgttatgtccaataactcgtccaactcgaactcgggcgccattctggccggcatcaaggaagcaggccacaaagtttttggtgggtatgcggaactactgcgcattccgcataccgcccgttattccatcggctcggtcatcgcctgcatgccattcccgatggtcggcatgaccatcaccatttccgtacagcattattacggcaactattcgctggccggcatgctcaccgccattcaggcgattgcgctggccgtggccacgccgctgctaggcaagctgaccgacaagttcggccagaggcaggtctcgattccgacgattatcgtttggattgtggccgccatcgcgctggtgacggcgattaccaaccgcgcgccggaatgggtgctgtactgtctgacgccgttcctggccgccattccgccgtggggcgcgatgagccgcgcgcgctggaccaagattcttaagggtgaccgggagcgcacgaaccgcgcgctgtcactatgcggcgtgctcgacgaatgcatgtgggtgatcggcaatccgctggcctccacgctggccgtgatctccggtttgctggcgttctcgttcaccggcatgtgcgtggtgatcggtgcgctgatgttcctgaccgagctgaccactgagccaccgtcgcagaccgcgctggcgcgtgccgagggcatctcccgcaaggaataccgtgagcgcgaggccgccaaggctgaggcgctgaaggcggaaaccgccgccgaggagacccgccgccgtcttgagcgtgaaggcgtgaccgatgaggccacgattaacgcagccattaagcaggcggtcgccgatgcgcgttcgggcaagaaggcgtccatttggggtccgggtctgattgcggtgtgcgtcacctggttcggtttgggcgcattccagtcggccacgggcatctcgattattgcgttcgccaccgaagcgaatatgaagcagtacacgggctttgtgtttgcctgcttctccttcagctcgctgatgggcgcattggtgtatggcgcgaagaactggtcgattgccctgtggaagcgcttctacttctgcctggccgtggtgaacatcggcatcagtacgttcctgttcgccaagcatctgtgggtgatcatgatcatctacttgattattggcgtatgccaggccccgacgtggatcaacggcaaccagctcatgttgcatctggtgccgccctctcgcttgaccgagggcatggcgtggatgggtgcgatgaattctatcggctcctccgccggttcggcgattgccggccagttcatcgaccgcatgggctcgcatggcggcttcatggtggtgaccactttggcactggtctcgctggcgattgcgctgattggcttcaagcagatcaagggctccaccgagcagccgaccttgactgaagtgagtgtgtgagacaaaaattaagccccctctgacgagggggcttaatacgtcaaaccgctacttcggccagcctttgggcgtgtgttccagggaccagatgccgagcttgtgggagaagctgttctgccacttggcttcaagctcctcggcattcaatcgattttcagcggacttcagacggttcatcgcattggtgtgcgtatcgtcgagcagccacttgcgaatcaagaagttccagatcattaccacggcagtggccaccagcttgccgatattggtgcgcaacagatattcggcatgctgcgatacataggcatcgtggttcatgccataagtggaaatccagataatcgcgtcattcatgaacagaccgactacagcgcccgccacgaagataaggatctccatccagcgcgccatgtcatcacgatgcttgaatacgaatttcatgctcgccagatagttgaaaatcagcgagatgatgaaagagatggtggcagccagcacgttgtgcatgtggaatatgccaaccaataggttgaggataccccagtcgataacaaaggcgatgacgcccacaatgccgaacttcatcagttgttcaatcagttttctcacaagggtattcaacactattgggctgactgcggaacatatattggctggaaaggccaataatctccccaaattggccttgccccggtccgttctgcaagcagcttcctacatccgcatgccatgttcaacagcaaccgctgaggctagactggaagcgaaccgaatcaaggaggaattatgcccgttattcacactcatgtgtccgtgcccaccacccctgagcagcgcgaggcgttgaaggctgcctatggcaaggcgattaccgccgtgccgggcaagtccgagggctggctaatgtgcccgttcgaggacaatatgccgatttacttcggtggtagcgatgaccagcccgccgcctatgtggaagtcaacgtgttcggccgctctgtgccgggctctgcttgggaaaagctgaccgagagcattatggccgcgctgaactccacgctcggcattcccgaggaccgcacctacatccgttacaccgccaccaccgactggggctggaatggtggcaacttctagttgccaccattcccctcgcagcatagctgctcgcatcgcctacggaaagcccggtgggctttccgtttaacggctcagggtagcaacttctagtttgcgtatgctggctcccctcagtcagcttcgctgacagctcccctcaaagagggaagctcagatgtagaaagcccgccggtggcgggctttctacgtttcaaggggctgatttccaacattcagaagctctactagcgtttcaaggggcttttaaaacaagaaaaccggagtataaacattgcaatttcaatggtcatactccggatttcgcaatcgaagagcccctcgaaacgcagatagacctccggaaaaccgaaaatccgcccctcaaaagcgagttacctcacctcatgcctgtcatcacacgatcttgggcatgggggtggtgaggctggtggtcaggttgacgtggaccagaccggcaccggcatgcacctcaaccttcttcagggtcacggtgcgctcttcttcgggggcacggtcgttgtcggtcatggtcgccggggacttgaccgccacgaacgccagatcgtccagcgagatgcctgcgctctggcacagttccatggcctcggacacggactcggtgaagcccggcttgtaaatcacgcgctcggccggtacgccgtaggcgttctcggccacccacttggcgttctcggtcagggccatgcccttgtgcgagtgcggttcggccggcatggagccgttctgcaacgcgtcgacgaaaccgtcaagctgcggggccagcgcctcgccgccgtcgcggaacaggttgccgatgatcggcgtgcggaagcccagctcgtcggcggtggccttcagggacggaacctgatcgtcctcgccttcccacaggttgatgagcgggaaggtcggaatgtccaggttctccaggcgctgcacgtggaacgggtagcgccaggccagctcgggatcgtcgcgccaggtggaggcacgggtcaccacgatggcggcggacggccactgcgcgccgtattcgcggcaggcgatgtccagccacttctgggcgccggcgtcggtgccgtaaccggcctcgacgatgaccacgtcatgcagggcgcaggccatttccacggagaccagcgtcggaatgccgatggacacgttggcgaacgggccaccgtgcacgtagaccggggagccgtttacggtctcggtcttggccggcttgaccgcgtcggccagaatgccagtgatacgccacaggtccacgaattcgccgaaggtcacggccttgccgtccttggtgccggcgatcatcttggacacgcgctcggaaatctcgtccatcgagcgggagagcaccacaatctgcatgagctcgcaggtcggcgtgagcacgaccttctccggcacgttgcccttgccgtagtccacggcggtggagcgcagggagcggctcggcacctcggagacacgcggcacgagaatcgtgtcgagcttgccgtcatcgatggccttctcggcgaaggagacgagcaggttctgggccgcctcgatggcgcccatttcgccgcacagaccccagtcgatgagctcggggtgggtcagggaagccttgccgccgccggaggcaccgcccttggaaccggctgcggtgatgcccatgctcggctgacgcagcacggcggtcgcatcaatgccgcgcttgttcagggcgtcgatcagggcgatggtcgtggtggtcttgccttctccgcgcgatgccttgagcggcgtatcggcggtgacgagcaccaccttgccgtgcttgcgcggggcgtcagggttctcggccaggtacttcatgtagccgaatgcgtcgatcttctggaccagaccgtactggctggtgaagtcttcgatggtggtcatataaagcctttctgtgtttgtgtgatggggcggggtggtggggcggcagtcgccgcctcttcgcctaaaaacagcccactgggctgttttcttaacggctcagcccctcagggaggggagctcaatacggactaaaagtcggacatgtggaagccgttcttcatttccatgctgcgagtgtacagcacggagtcaagcagcttttcggtttcctccttgagctggtcggccatggtctggttggcggcggcgagaatctcgcgcacctcggggttacgcagcgcggcgatggtctcgtccggggtcatcggctgcacatcgccatccacgttgtcggcctcaaattcctcttcagcggcggactgcgcagcttcctcggcggccgtcaagcccagacgggcgatctgctcgtcggtggcggcgaccaagcggtggcccatcgcaccggtcttctcctggtagcgctcaacggcgttggacgtggagcggaaggcgccatcgcacagggcggcgatgatgcggttggcccagtagaagttctcggacgtcacgcgggtggtggtgtcctcaaggtaggcgggcgtggtgtccacgttcgggaagaacggtaccagcgtgttgaacgggttggagccgtatgccatccactggatggcgcgggaggcctgcgggcggtacgggcggatctgcatcaccgcgagctggctctggcggttgatgccgatcgtgcggtacatgtggcgggtgcgctcatcgcccagctggccgtacggatcgaacggggtgccctggtagtgggagctcagcacgtacttgatatcctcgatggtcaccttgcgctcaggctgacgggcccacgggatgtcgtcggaggtgggcttgtggtcggcgtccgggccgtcccacacctcgtcgtacgggttgaggaagcgctgcatgtaccaggcgcgcggggtgttgtacacgtggtcggagtcggagtgggagccgaaggcatcgcgcgggttgaacggggtagtgttctccaccgcgaggtccaaatggttggtttcgatgaattcggcaaggtcttcggaacacatgtgcgcttcctggtcacccagagcgtcctcaaggtcgaattcgtcgataccgagctggttcggcatggtcacgtaggcctcgtccggcacgcgcttggcaatccagtgatggccgcccacagtttccagccaccagatttcgttggagtcggagaaggcgacgccattcatctcgtaggtgccgaattcctcaagcagcgcgccgaggcgctggacgccctcgcgtgcggtcttgacatacggcagcacgatggtcaggaagtcctcttcgccgatgccgccgggcacctcgggctcatcgcccttggccggcgtgtattccacgaacgggtcggcgccgagcacgcgctcgttggtggtcagggtttcggtggcgctcatcgccacgttcgcctcgttgacgccggcctcgccccaaataccttccttgaggtccgcgttcggcacggcggtgtactgcagcgggtcgtccggcagggtgatggttaggtgggagatcaccgacttgtattcgcgcggctgttcctccggcttcacgacgatgaagcgcttcgggttgaactcgccgttcgcggaatcctcgttgcgggcgatgatggtcgagccgtcatagctcgcgtctttacctaccagaatcgtggtgcaggccatagtgtgatggtgtcctttctttgttgtggtcacgctcccactggcgggagctggacgacgaagtcggactgaaggtggttttgtactgacccacccccagtcagtgatgctgacagcccccgcctgcgggggctcatgtggctcacgccttgccggtcaggaagatgccgtcggtgtcgggcacttcaccgctgttgcgcagcgcgtgcaacagctcgttgagccagaatccctgattcaagccgggcaacggcttcttggtggcccacacctgcaggtagtactcatgatccttgtccggcggctgcggaccgttgtaccgcatgatcaccgccgggtcagtgctgcggcccaagaacttggaggccgaggagttgcacccctgcacggtctcgggaatcatggccggcagctgacgggagaagtccggcgggatggccaacgcatgcgaatcattgaagtcgtacatcagcgcatcaatcggcagattggccacggaccagtgaatccactcgaagccgcagaccggaatcgaatccgggtccacgaactcccagtgcaggtagcgggcctcgggatccacatcatcgatgtagaacgggaaggagaccacaggcacgccaccattgaaatattcaggggccgcagccttggcgaaatcgtccgggatgacggtgaaatcggcggaaatcttcatacgtcccagtatcgctcatatgtgtgacgtactgggagctgtgcgttacggggtctctcccccagtctcgctgcgctcgacagcccccactcatcagaggggggctagttgcgtcgggttatgagatcagggcgcagaagagggactcgaataccagtagcgggttgccgttgccggctaggcgcttgcgggcgtgggccacttcgtccagacgggtcacggcaccggcccggttcaatcgcaccgacaattcggtgatcgacgagcggttctccaggttgatgaggcccaccgaatcctccgcattgttctgcagcaccgccacatctcggtagatggaagcgatggagttcagcgcacgatccaatacgtcgcgcgtacggcgggtgaccaaacgcttcacatcgtctttcttggcaatctggttgaatgcgccacgcagtttcggcgggatgcggtcgctcggtgccagtccgttgatgcggcggaattccgcttcctgaccggcggtgatgcggttcgcgtctgcctcggcctgggccttggcattgtcgataagattgccggccaacaacactgcatccgaggcacgggccagattcagcacaccgaccacaagttcatcgcggtcggacataacccgttcgtcggtggcgtacaacttggcgatgccgatatggccttcggcgagtcgggccgcacgctgcgccacttttggctcgacattggtggtggaggtcaggaatccggccaccgcctgggtggagggcacggcgaggttcacgatgcgtgtgcgcgagcggatggtgggcagcacgtcctgggcgctgggcgcgcacagtagccagatgcaatgctcggccggctcctcaatctctttcaagagcacgttggtggtgcgctcaagcatgcgatccacgtcttcgatgatgatgatgcgccacggcgcggtggcgggcatctgctcggaggtagtgatgatctcacgcacctgatcgataccaatagtcaccttgttcgtggtcagcaccgtgacatccggatgcgtgccggcaagcacctgctgggtgacgcgcgtgggctcagcgctcatgccgtgatccgggctttccagcgccgccgcgaatgctcgggccatgttggaacggcccgatccgggaggtccacagatcagccacgactgggtgatctggctcgggtcgccctgcgcgatacgactgagcatgtcgattaccggcttttggccgactagtgaatcccatacgctcatgcgagctccttgatgtcggattcgatggcagcccataccgcttcaatgctctggctcgcatcgataacgcggaaacgattcggctcggcggcggccaagtccaagaaggcctggcgggtgcgggactggaagtcatcaccggccgattccatacggtcttccgcgtgttcgaggcgatggtgggacagggctgggtccatatccagcaaatacgtgcggtcgggcagcaggttgttggtggcccacatgcttaaggatcgaatctcttctggcgtgagttcgcggccaccggcctgataggccaaggaagagtctaaatagcggtcggtgatcaccacttcaccgcgctccaatgccgggcggatggtttcggcaacgtgctgggctcggtctgcagcgaatagcagcgcctcggcgcgcggtgcgatgtcgactgcgcccccatccacaccgtgcaacagcagttggcgaatggccttgcctaacgcagtgcctcccggctcacgggtaacgaccacggtacgcccctgagcctcaagatacgcatgcagccgctcgacttgcgtggtcttgcccacgccatcgacaccttcaaacgaaacaaacagaccgctcatgctattgaccttagcgttaggcgcagagttgcgcccaacaggcagttaaaccagctctacctccgtttcaaggggctgatttggtcttttctgaaggtctacttccgtttcgaggggctgttgcccaagtagacaacgttccaaaacggcggaatgacgttggcgcggagccgttcatactcgtggttcagcagatgaccagccccttgaagcggaagtagatattctcaaaacgagaaatcagccccttgaaacgcaagtagagcaataattccgctcagccacgcttgggaattacggcggggcgctcgtagtcctcgttggcggtcagccagtcgacgtcctttttcacagtggcgggggtggaaccgagtttttcggcgatgcgctggttggaccagcccttgttcgccaacttcttgacttcggcacggcgttcggcgcgcttggcctcctgcgccgaaaccgcagccgaggtaccgcccttcttgcccttgccggcaacggccttggcgccaccagcacgcccagcaccgcgacggccacgggtggagggaccagccgcacgcttttcggcgagcagtcggaaggcgtcatcaggggtgatggattcaggcgtgtactgacgcggcaccgtacggttggtctcgccatcggtgatgtacgcgccgaaacggccgtccttgatggtcacgttcttgccggtgttcgggtccttgcccaaatcacgcagcggcggcttggcggcaccacggccacgcccgcggccgtacttgggctgcgagaacagttctttggccttgtcgatatcgaccgtgaagatctcgtcttccgaggccagcgagcgggtctccgacttgccgtcggcacccgtcttggtcaggtaggggccgtagcgaccgttgttggcggccaccgtgcattcggatacctcgccggtttcggcgttggtttcctcgtatgtgcccacttcgcgcggcaggctcagcagctttagcgcgtcttccagcgacagcgattcagggctcatcgtcttgaacaacgaggccatcttcgggcgcgacgcggcggcggccgcggccttcttcgaacccttcttggccgcagaagcaccagcagtatcgccagcagcgccagccgaagcctcagccggcggcaccaacgccacatacgggccgaaacgcccattgcgcacctcgacggtaccgccggataccggatcaacgcccagctcgcgcggtccaccggagtggttgtcgatcaaatcgcgggccacggccaccgtcagctcatccggcgcgatggtgtccggcagagacgcgcgcttcgggttgccttcggcgtccagatgctccatgtcttccagatacgggccgtaacggccgacgcgcacgtgcaggccgtcgccgatgtcgatggtgttgatggcgcgcgcgtcgatctcgccgagctgcgcgacctgctgttgcaggccttcatgcgcctcgtcggcgttgcgggcggcgccctcgccggaaccgaagtagaagtgggtgagccagtcgcggccggattcctcgccgtgggcgatgcggtcaaggccgttttccatctcggcggtgaactggtagtcgaccagcttggggaagttcgtctcgagcaacttggtcacggagaaggcgagccagctggggatcagcgcacggccacgctcgtatacgtaaccgcgatccatgattgtggagataatgctcgcgtaagtggacgggcgaccgatctccttggcttccagcgtcttgaccagcgtggcctcggtgtagcgggccggcggctgggtttcatggccgtccggttcgatgtcgcttgcctcgacctgctggccgacgctcatcggcggcagggaggtgttggattcggaggcgtcacccctgacggccttggcgtccgtcttgccggcggcagcagcctggtccgagccagccccagcgccgggagcggcggccttgggcttgcgcccctcccccgtggccttcataaagccggggaattcgatgacggtgccggacgcctggaacacggcctcgccctcggtggggccggccggcgcagacaggcgcacggtggcggtggaaccggtggcgtcagccatctggcaggcaagcgtgcgctgccagatcagcgtgtataggcgcagctggtcgccgggaagtttggaagccagctcgtccgggtcgtggaagcgcgagcccgccgggcgaatacactcgtgggcttcctgcgcgccagcggttttggtggcgtactgcttgggctcggcggagaggaacttgtcgccgaaatggtaggagacggcgttgcgggcggcggtgatgccctcctgcgacagcgtcaccgaatcggttcgcatataggtgatgtagccgttctcgtacaggctttgggccgcgcgcatcacggcgcgagcacccatgccgaggcgattgccggcggtctgctgcagggtcgaggtggtgaacggcggctgcgggcggcggcggtacggcttggtttccatcgacatcacagtgaaatcggcggtcttcagcgccgaagccacggcggtggcaccagcctcatcaagctggcgaacgttcgccgcgaacccgtccggggtcagctggccgtcggcaccgaaatccttggagccggcgagtcgcttgccgccgagcgcgatcatgcgggcggagaattcggcacgctcccccagcgcgtcaggcgcggacagcgtggcgacgatatcccagtacggcgcgcgcttgaacgccatgcgttcgcgctcgcgttccacgatcaggcgggtggccacggactgcacgcggccggcggacaggcctgggcccaccttgcgccacagcaccggcgacagctcatagccgtacagacggtcgaggatgcggcgggtctcctgtgcgtcgaccatattgccatccacatcgcgcgtgttgttcagggaggcgttgatggcgttcttggtgatctcgtggaacaccatgcgcttgaccggcacctcgggtttcaaggtctgcaccaagtgccacgcgatggcctcgccctcgcgatcctcatcagtcgccagatagagttcatcggcgttcttcagggccgatttgagttcgctgaccgtacgcttcttgtcgccgtcgacaatgtaatacggcttgaacccgtcgttgacgtccacgccgaacttgccgaacttggccttgtctgccgcgggcacctggctgggctgcgcgaggtctcggatatggccgaccgacgccatgacggtgtaccccttgcccaggtagtcaccgatcttgtgggccttggtcggagactccacaatcaccagtttggtagccatacccactccttatgtattgcgcgaaacacacgacgtttctggcgtcataatactcatgaatcatgtccaactgccaaattccgccgttgtgccgggcaaattcggccgttcgcaccccatgttttaccgtttgggcggtgccggcggagcgccgatcagacccagccggcttaagggcgctgcagtaatctgacgcagggccagcaacagtccgaatgcgagcatggccacacccgcaatgcccacaacagcgctgacattcgccccctgaaccgcccagctggcgctgacattgagccccggcaccacctgccagatcacataaccgctgtaggcgagcaacagcaggcccccggtaatcagcacgctgccgacgatttgcacgctcactgaggagacgcggcgacccggctcgtccatgccggacttgcgcgtaactgccagagcgagcagggccaatcccgccaccagcaggatggacatcgccacatccgaagggcgatgccattgtccgtatatcacggagacaccgacggtcaccgcccagaccacgccgatgacgcccgccaaagctcgaaccgcacgaggcacggtaagcagcagaatcaccgcacaggctgcggccagcatcgtgtgaccggaaggcgcggaattagcggcaggagattcagtgttgatgatgaacggacgcggcaacagacccttgatacgggtgacggccaagcagaccacggcgaacacggcgatttgcccggccaaccaccagcggcgtcgaatcagcgccgtaataatgccgattgcggcaattgtgcagctgacagcgataaccagccaggattgtgcgacggcgttcatcacgccggtggcccaggacggtacatcgttgtgcaggtttttccagaccagttcgtcgtacgattgtccgttttcggtaaacacgcacccccaccacacgccgaagccgatagcgatcaggagcagaccgaataccacgcacagtacgcggctggagattcgcgggcgcacggtaagcgggtcaagccgggccaagccgcggtcgatatcagatgccccatccgcatcgtccatgtccagcggcctgaaatcccgtaaggagcctgatgtggatgccgatgcatctgaaccggagaccgggccgagcgcagccaatgggtcaacaacgttcgacgacgagtcaggctgtgctgcgcctgagccgaccagattgaccgccgcatgcgggtcgcgaattctaggggtctgtgcgtcattcatacgttcgactgtacggccgcgccccggacaggggaccacgctagtgccagctcacagccaaatccgcacataaagaaaacctccacgcacccgtcagaggccacttacccttgctgcattcctgccctgggggagttgggtgacatagcgccgcgtggaggctggggataagtctatggagacgtatggaccagcgcagcgacacgaaacgtgcgcgccgggtcgcacgacaggccaaccagcgcattcaggcaatattcatgcagcatcaagaagcgtgcccaattgtaagaattccggaaaaataccggcataaacgcgtgtggctacgctcacgtcaaacgattgttcaaggccaacagttacggtggacaccatggcttcttatactcgtcgtgcacattcgggaggcaatggccccgctctgaggcaaccgcgcaccgcgcaaagcagagccggccactccgcacaggagggcccctatacgccccaggagagccgttcccgccacgcaagccacaaggcttccaatagccatcgagccccgaacaggaagaaaaagaacacaggaaaaggcaagcaccgtgtactgaaatgggtgctgggcatcttcttctccctgattggactgggcttgctggccggtatcgcagtattcgcatacctgtacaccaccactgaggtcccgcaacccgagaagttcgcgttggccgagaaaaccaccgtgtattacgcggacggcaccaccgcgatcggctcctacgcggagcagaatcgtgaaatcatctcttgcgaggggctgccggactacatcggcaacgcgattgtggcgtccgaaaaccgtacgttctacacggataaaggccttgatctgaagggcatcgcccgcgcattcattaataatgtgaccaagggcacgcgccaaggtggttccaccatcacccagcagtatgccgagcggtattacatgggcgaaaccacatcctatgtgggcaaggcgcgcgaggccatcatggccatcaaaatcgcgcagaccgaatccaaggacgaggtgctgtgcaattacatgaacaccatctatctgggccgcaactcctacggtatccaggcagcggccaaggcatacttcaataaggacgccaaggatctgacgctgtctgaggcggcgatgatcgccggcattattccgtcaccgtccacgtgggatccggccgataacgccgatatggccaaatcgcgcttcaagcgtgtgctgaacatcatgcaggaggatggttacatcactgccaagcagcacactgatgccaagttcccgcagaccgccgcggtggcgcagcagaacgaatacgcggggccgaacggttatctgctggatatggtgcgccgcgagctggtgcagtccaaggcctttaccaaagaggatttggatactggcggatacaagatcatcaccaccatcgacaagagcaagcaggatcttatgcagtccatcggcgacacccgtctggacgacatgcccgaatccctgcaaatcggcggcatagcgctggacccgaagaccggtgaagtattgtccgtatacgccggttcagattatctgtccaagcagctcaacaatgccgatcaggccgtattcgaaccgggttcgactatgaagccgttcgctttgctgggggccgcgcaatccggcgtcagcttcgatacattgttcaacggcaattcccaccagcacttcaccggcttggatcaagaggtgaacaacgctctggagaacaactggggcaacatcaatctgtatcaggccaccgccaactcggtgaacacggtgttcatgaacgtcaatgagcatctgacgccgaagcgcacggccgcaatcgcccatgaagcgggcattcagggcgatatcgatgaaaactccatgtacaacgtgctgggcatcaacgccctgaccgtgtgggatttggcgcaaggccattcgaccatcgccaacaatggcgtgaagaacaccttgcatatggtgtccaaagtgcttgattccaacaataaggacatgtacaacgcgcccagcaacggcaccaaggtgttcgatgccaacgactgcgctttggtacagaaggccatgcagggcaccaccacgtacggtacggcggccggcacatccagcatgttgggccggcccgtcgccggcaagtccggtaccgccaacgacgaaatggcttcgtcgttcgtggggtacacccccagcatgatgaatgtgtgggctatctggaatccggacgataagggcaatccgcaagtggtgccagccttctccggatacggcgtctcttccactggataccccgcccacctgttccaggagttcatggctcaggccttgcaaggcaccgaggcggagcagttcccgaccgctaaagacaacggcaagatcggcggctccgacggcacttggggcttgggcaagggacagagcagcgacctgtccaacaacaccaacaagcagtccaccgaagacgcgcagaagcaggctgagcaggacgcacagcagaaggcggccgaagaggaagccaagaagcaacagcaggctcaggagttcgcccagcagtgcctcgccaatccgagctattccaccgagtgcccgaattatcccggcaccactaccggcggagatggcaacgccggcaacaataccggcggtgacaacgggaacaataccggcaacgataatggtaattccggaggcaccggcgggaacaccggcaccaacggcgtcactcagtagtaagtaaaacacagacaacaaggctccctctgatgcaatcagagggagccttgtttttgctctgctagcgctcagcgcttgcgctggaaacggttgatggcggagataatcgacttcagggcgctagtggtaatcgacgaatcgatgccgacgccccacacgatctgcgcgtcatcggcctcgccgacctggcattccacgtacgaggcggccatggcgtcggtgccgacggacatggtgtgctccacgtaatccataatcgaggcgtcaacgccaaagttggaaatggcgttgaggaaagcggcgatcggaccgttgccgatgccggagacctcgcgctccacgggcgcatcgaccccgacgttcacgccgcggtcgagcagacgagccttgagcacggtgtcggagccatcctcaccggagctgacggccaccttgagcagcttcaagcggccccacggcacgagcgaggcgtcatgagtatcgcccacaaccacaccggcggcggtcatgccggactgttcgaccggcaggtactcgtccttgaacagacgccagatatcctcgtccttgacttccttcttggtcgtgtcagcgtagttctgcacgatcttgtcgaattcgatctgcagacgcttgggcaggtcaagattgtggttggtcttgagcaggtaggccatgccgcccttgccggactgcgagttgacgcgaatgatggcttcgtacgtacggccgatgtccttcgggtcgatcggcaggtacggcacaagccacacgaagctgtcgagatcggcgccagcacgctcggcggccacctgacgagcctcgagacccttcttgatggcgtcctgatgcgagccggagaacgcagtgaacacgaagttgccggcgtacgggtgacgctcggaaatcttgatctggttgcagtactcaaccgtcttgcgaatctcgggcacgttggacaggtcaagctgcgggtcgatgccttgggtgagccagttgaggcccagcgtgaccaagtcgacgttgccggtacgctcgccgttgcccagcaggcagccttccacgcggtcggcgccggccagcacggccagctcggtggcggccacgcccatgccttcgtcgttgtgcgggtggagggagagcaccacggagtcacggtcgtcgaggtgggtggagacgtactccacttcgtcggcgaacacgttcggcgtggtcatttccacggtggcgggcaggttgatgatcatcgggtgctcgggagtcggcttgataacaccgatcacggcgttgcacacctcgacggcgtactccggctcggtgccggtgaaggattccggcgagtactcgtagtacaggtcgatgcccttggcctcgttctcgaggtccttgcacagttcggcggcgtcggtggcgagcttcttgatctcctccttgttcttgcggaacacgacctcgcgctgcaacacagacacggagttgtagaagtgcacgatggcgcgcttggcacccttgagcgcctcgtaagtgcggcggatgaggtgctcgcggcactgggtgagtaccacgatggtcacgtcgtccggaatcagctcacgctcgatgagcatacggatgaagtcgaaatcggtctcggaagcggacgggaagcccacctcgatctccttgaatcccatggagacgagcaggttccagaaacgcagcttgcgctcggaatccatcgggttgacgagggcctgattgccgtcgcgaagatcgacggagcaccagcgcggcgcgcgctgcagtcgcttgcccggccacgtacgctccgggtaatcaaacgggatctgcttgtcgtaggcggcgtacttgttgtacggcatacgactcggcttctgcggatcgccaatgaatcgcgccggaggcagcagcgggtcgttgttccccccattggacgctgcggctaccgctgcgagatcaaaaacggatgattgatcctgacccattgttcctcctttactggttattgcgcgggccctcttgcggacgcgactgcggcgttgtgccagggcggcgccgggccacgcggatttgtcaatacgcacgtaacatcctacaggccggttcgggcaaacccgcgggaaatgccgtatcgtggcatttgcttatgcacctggctgacatgagggcactcagcgtcggcgccgggccacgctttgactccggcacaacaccccgcctgcgataccccaccagatggccctccatacgtcggcggcgggccaaatattggtactgcaccgacagccaaacggctcagcgtcgtcagcggaccaacttatggcgaaataccgactctgggaaagcttatcgtcggcaaattgccaggctatggcacactaccgacgctacgaggcccacaaccatcggcaacgcgacaaatattggcccaccgccgacgctagcctctttgagcgtcggcgccgggccattctatgaatcagtaacgacgccaatggtctcagaacgtcagcatagggacgctgtctggatctccaccgacgctgcatgacaaaatcgcggcaccatcaagcaacaacacggctgcggcaccccgccctgccccgtcccttgctgtgccagtcctgtgaacgcgcgggcgatccgccgcccggcaacatagactgaagagctatgacgagcttgcgattccgcgaagacggcagcttccgcgtgctgcaaatggccgacgtacaggacggccccgatgtgttgcccgacaccatccgcctcatccgcgaggccatccgcgaagccgatccggatcttgtggtgttcaccggcgaccagatccgcggctatgatcccgcctacatcgacacgttcctgcgccgccgcggcgaagagccgggcgctcgcgtgcgcgcggtcaccgagatcgaggccaaaatccgcgggatcaagcgtcaccccgtaattcgcaaaacatccgatcgcgtggccgatcgtctcaccgaagccggcaagcctgtaccagccgcgctgcttgaccccgataccgtgacgaacgccgtcgccgctgccggcgccgattcgaccgacgtgatcacgacttccgaagtaggcgattccgttgagaccagccccacgcccgagacggtttccaccctcgtatattcaacgcaatccggcaaggccagccccgcacacgagacgccggcgaccctcgacgaactcatgattgagacccgcgaaaaggtccgccgcacgttctccggtttccttggtccggtcgtcgaggccggcgtgccctttgccgccacctacggcaaccacgacttccaatgcggcattctggccgacgaacaggatgacatctaccgcgaataccccggctgcctgaaccccgacgacagtctcgagcccggcacgttcgcgctgcccgtcgagtcctccgatggttccggccgcgtggccatgtccgttatgatggtcaattcaggcgattatgccggcaaacccgaagaaaacgacgcccaatacccggcgtatgtggtcaatccgcgaggactcgacctggccgacgccgacgggtacggcacccccacccccaaggccatcgaatggctggggtccgtccaaaccgagttgggcgagcgcaatggcgacggcaagcccgtgccggccatcgccttccagcacattccgccgcaggaattctacgattgtctgaaggaagtgcccgcatggacgccgaacgccgtggaaggcgcgcgcacgcacgccgggcgttgctatgtgctcaaccatgaggtctgccgccccggctcgcggctcggcgaggcgatcggctgcgcggacgagaatgtgggcgaggtggatgccttgcgcgaggctggcggctatttcgcgctgttctgcgggcatgaccataagaactctttcgttggtcatgtgcatgatatcgatctgggctatgcacccacgtgcgggttcgaatgctatggtcccaagtcgcggtaccgcggcattcgcctgtttgaattccatgagagcaatccggcgggctatgtgacccgcatgctcacatggggtaatctggtcggccgctactccagcaacgagctgcgcgtctggttcgaggatcattgcgttaccggagcggtcagcgcacgcaacgagctgcgccgcccgcaggtgttcgccgtggtggccggcgcgatgagccttggctttatagccatcatccgttcgctgatcaaggccgcgcgctaaacctacttaaacaggctcaccccgcgacgggccgtgcaatacgcgttgcccagccaggtatggcgggaattgggccagacggctcccagtcgcggtgcgttctggctcatccagatgctcggcacgcggccgtctgcggagcgtgagccgagcagattgaagccgttcttttccagcagccactccgggtgctgggtggcgatggccaagccttcctcgagggtgagcggcaggcgctcatcggagtcgataagcttgcgggccacatccggctcgcgattgatatagcacgtgccggtgtgcggattgacgaccagatagaacgggccttccggcggcatgaagccgtcttgaggcaggaagctggcgatgtcacgcggcggcatggtggtgaagcctgccatgcgattgatggaggttcgtgcaatcagcgactcaggcgaaaccagttcacgcgtgggcaccagcaggatgttcgatcccaaatcggaatgctcgagcgccccgatcagaggtcgggccagcgagcggaatgcggcggcggaaatatccgccacatccgggtagccgagagccacgatacggtcgagctgtttttgggcctctactgatgcgatagacatggctaccagtgtagaacatcgccttcgcttcattgggcagccaccatctgggaagaccactgccgttgttccgcgtgtttcgtacaattgcattgttttacggccacccgcatgacggccgtccgacgtaagtaatccatcgaaacccagaggtcatagaggtcatcatgtccgaaaaattgaaggtcggcatccttggtgccaccggtatggtcggtcagcgttttatcacgctgcttgagaatcacccgtggttcgaggtggtcacgcttgccgcttccgcgcacagcgccggcaagacgtatgccgaggctgtcggcgaccgttggaagatggaaaccccgatgcccgaatatgtcaagaacatggtggtcgtcgatggcgacgatgccgagtccgtggcttctggcgttgatttcatgttctctgcggtaaacatgccgaaggaccagattcgcgccattgaagagcgttatgccaagaccgagaccccggtggtctccaacaacagcgcccaccgctggactccggacgtgccgatggtggtgccggagatcaacccggagcacttcgaggtgatcgagcaccagcgcaagcgcctgggcaccactcgtggttttatcgccgtcaagccgaactgctcgattcaggcctacacgccggcgctggccgcgtggaaggaattcgagccgcgcgaggtggttgtgagcacttaccaggcgatttccggcgcgggcaagaccttcaaggattggcccgagatggtgggcaacatcatcccgttcatctccggtgaggaagcgaagtctgagaaggaaccgctcaaggtgttcggccatgtggacgccgccaagggcgagatcgtgccgttcgacggcgacctcaagatcacttcccagtgcatccgcgtgcccgtgctcaacggccacaccgccaccgtgttcctgaacttcggcaagaaggccaccaaggaagagctcatcgaccgtctggtgaactacacgtccaaggcttccgagctggagctgccgcacgcaccgaagcacttcatccagtacctcaccgaggatgaccgcccgcaggtcaagctcgacgtggactacgagggtggcatgggcgtttccatcggccgtctgcgtgaggattccatcttcgattggaagttcgtgggtctggcccacaacaccctgcgtggtgcagccggcggtgcccttgaatgcgccgaaatgctcaaggctctcggctacatcaccaagaagtagttgaaactgagtccgaaactgagaaagccctccgcaaggagggctttcgtcatatataccgcaaaaacgcggctcagtggctcagcggccagtaccgccgtacaccacggcttcgatttgatcggcatcgagaccgtatgcggtgtgcagcgccttgacggcgtcgttgagctgatcgagcggcacgagcgcggcgatacgaatctcggaggtagaaatcatcagcacgttgatgccctcatcgctcagggcctggaagaacttggcggccagaccggcatgggtcttcatgccaacgcccaccacggccaccttgcctacgttggtgtccacatcgaaggagtggtagcccagcacttcctgcttgtcgagcagtgtgttctgaacctgcttgacggccgattcgggcacggtgaaggagatgtccgcagtgccgacggatgcgccggcctgcacgatcatgtccacgttcacgccggcggtggccagctcggtgaacaccttggcggccatacccggctcgttcggcacgccacgcacggtggccagcgcctcggaacgatcgtgggcaatgccggaaatcaccggtgcctcggggcccaggtcagggaacaggtcgcccatggatttcgcttcttcttcagtcatgtcttgccttgtcttgcttgaaattacttacgattatcgttcgctgtagccgcgctcagtcgaggttcggcagcgtacgcgggtcaatgccgtcgggcaccaccaatgtgccggggcgacgggagaacgaggaacgcacgtgcagcggcatgttgaaacgctgagcgtattccacacagcgcagtgccagcaccttggagccgcaggacgccatctccagaatggactcgtaatcgatggacggaatgcggcgggcggaaggcacgatacgcgggtcggcggtgaagatgccgtccacgtcagtgtagatctcgcagatatcggcaccgagcgccacggcaagcgccactgcggaggtatccgaaccaccgcggccgagcgtggtggcgtcacccttggcgttgatgccctggaagccggcaacgatggcgatgtctcccaatgagagcgcgttcttcacgcggtccggtctcacggccttgatgtgggccgcgccgtaacgggcgtcggtgaagaagccggcctgctgaccggtgaaggagtgggcacggctgccttcggcgtgaatggccatggccagcaggctcatggaaattcgctcgcctgcggtcatcagcatgtccatctcgcgctcgggcgggttggagtcgatgctcagcgcctgatcgataaggtcatcggtggtgtcgcccatggcggagaccaccacggccaccttgttgcccttcttttccgtctcaacaacgcgcttggccacacgtttgatcgattcggtatcggcgaccgacgaaccgccgtacttctgcacgatgagagccactgctgtcctttgttcttctcttagggggagtttgctcaatattctacgcaaacgcaacgattataaaggttgccgcgttcaccccgcgaccccgcgccgacatgtggacacgggcatggcctacgttgttcagcaaaaattcaagttttcaccggtggttctttgaggcagccgcatccatcctttgagattcgagcggttaactatcaattaccggcaaacgaaagcaaaccggcgaggtttccgcagaccccataactgaataccttcttcttcctctctccttttcaaggcccggtcccgcagcccgggccttttccttttgtgttgggaacgatgggtcaaacgcacgatacgagctcacggagcaagcgtggccaacggcactaccaataccccatcatcccggcgataagcggcagccgtagcggtcagcaccatcaagaatgacggacggccttcgtgatcttgatcaattctgtcagccaactttttcaaatgggccgccgcaatatcaacctgcttttctccgagcttgacctcaatgagagcccatcgtccatcatgcaggccaatgaccgcatcagattccaatcccgtcttatcccgataatggaacacatctccgccaagcgcatcagcatacacacgcagatcgcgaatacacatggactcaaacagcaagccaaaggtctcgaaatcattaaggagtttctccggggtcgcgtgcagtaccgcacaagctatcgacgggtcgctgaagtgtctggttgggctcgttctcactgcagtcttagaacgtaaacgagggttccaagctggaagatcttcagttacgcaagctcgcgacaatgcatctaaataatcggagagtgtaccttccgaaggcggttcaccctgcatatccgccgcgatagtggattgcgacgcctgagaagaaatattgcgcgcatacgagcgcataatcagacgcatccaagttttattgcgctttataccatccatacgattgatgtcagaatcaagtagttcttcgacataatccgcggccatgcgcaaggcaacatttactcgagattcgactactgcttcaggccagccaccgcggcatagcgcaaacgcggtgttttcaatatcgaaatcggagaaacccgaaacatcatggttgccatcgaacaactctcccaacgaaacaacgcccgtcgattcctgcgattcaaataaggacatggtacgcatggttaatcgggcaattcttcccactccggaatgagctggttcctgttgaggagtcgccgatccagttaggatgaatcggccacgaccgcgccctcgatcgatggcgaaacgcaccgcgtcccacaattgcggggccatctgccattcatcaatgagtctcggctcctcacctcgcaggatgagagaaggctttgtatcagccaaggccaacagcgtagcactgcgatccgggtcctgcatgaagacctgactcgccgactgcctttctgccgttgcagtcttgccacaccattttggacctttaatctgaacggcaccagaagactgcaatgcctgagtcagcaacccatcagccactcgaggaaggtactcgccacgttgaatctccgagctctccactgccatatgtgccctcccgcaaaccgtcgaaacatcaacctataaatcactctattgcggaagttggaccattctaattgtggaagttggaccattttcgttgcggaagttggaccattcctattagggaagttggacactagattacgaactagacttttcctttttgcagcaacagtgccaccaacacgatgggcgtcatcaccgcctatcgccagacccttttccttgacctaaaaagatgagatgcccagacagtgccatcttttctctgagcacactagccaattcggaacgcagcggcgaacccgtgatccgcgcatcctctgcaaccgcgcctttgacgttcggcaatctggtgaatgagcttttgctcaggcgttcttcgcgattcatttctttggtcggaaaacagaatacgcgggaacgcccctcacgcctacgaaaccaacggctcgacgacgaaccgacatccacgaaaacagcaatagcgcctctttttatcggggtaacatattccctctttatgcattcatacccccctatttgaaagctctgccaaatattgccgacgccgcgacttatcatgttgccatactttgcaatcctttgcagccccttgcatctcaacggcttgtccgaagtaagccacatcgctgacggccgtagcaacgttgttcgtatcgcatttttcagacttcttatgcccccctatattgcccccatatggcccccgtcggcatgttgcatgaaaggcttggcacggagtaacgtttcgcagtgtggcgcgtgcggtgttgccatttgcgacagcacctatgccacgcacgactaagacagacccggccgtcttgtataagcaaatcatgagcagatcaaacggaggaacaggcgactatggcattgctgcatcgacgttcgacgagtaagcgtgcctcacagaaaatgcgggaaaacaacgcggtcatgccggatgacacatctgcaaatgacaacgtttcctcagcgcgccccgagcccacagcattcgttccaactccatttgacgaagtcatcgatatcagcgatctcgtggccgagcgccgacgcctgcagcgcaatctgtgggcgatgcgcatcatcaccattgtgttgctgatcgccgcaatcgccgtggcctgcttcccgctagcgttgcaattcgagtccgaccgcaacttggccgccaccacagccaccacggccaaagaagtagctggctggccttacccgcaggcggaagacaagctcacggcggcccgcgcatacaacaagaagctcgctgaatccggccagcctatcttgggtgaagccgtcgatccgttcgccgccgctcaagggggatcccaagccagcggcgaggattccgcctcaaagaaagacaaggaataccagtcactgcttaataccggcaacggcgtgatgggcacaatcaaggtgcccaagcagtccatcaatctgccgttttatcacggcacttccgaggaagcactggcttctggtgccggccacttgtacggcacgtcgctgccggtgggaggtaaatccacccattcggtcattaccgggcaccgcgggttggttgaagcgctgatgttcacccgtttggacgaggtgaaagagggcgacttcttctacatcgaagtcatgggcgaaactttgggctacaaagtggaccgcatttcggtgattttgccggatgacacgtcgaagctcaaaatcgtgccgggtgaggatcgcgtcactttgatgacctgtacgccatacggcgtgaacacgcaccgactgcttatctccgggcaccgcgtggcgattccgatgccggcccccgagccgaatgacgtgcttgacgcgcgcaatatcgcccttggtgttggtctaggcatactggcggcaggactgttcattatctggttggcacgacgccacaaggccgcgcgtatcatccgccacggcgcattctggccgtggatgcgccgcaagggcgaaagcgccaatgatacgctggcttaggcctcgcgccgaccggccagtgccctgcccagcgtgatttcgtcggcatactccaagtcggagcccaccggcaggccgctggcaagtcgggtgaccttgacacctacgggtcgcaatagctgggtcaagtagctggtggtggcctcgccttcaatattcgggtcgagcgccataatcacttccttgacctcatcgccttctaagcgtttgagcagaccgggaatacgcaggtcggcagggccaacgttggccattgggttgattgcgccgccgagcacatggtataggccgtggtattcgcgcgtgcgctcgatgctcatcacatccttgggctcttcgaccacgcagatcaccgaacggtcgcgtctcgggtcggcgcataccgggcaggggctggattcgcacacgttgccgcaaatatcacagaagcggatcttggccttgacctcttcgatggcctcggccaaatcgcgcgcttcatcttcgggcgcggacagcatgtagaaggcgatacgctgcgcgcccttcggcccgatgccgggcagccgcccgaaagcgtcaatcagtcgttgtattgcgccgtcataagcaagtgccatgggtattcctcgttattcgtcctcattattcatccgagtgcttcttggcaggctggatgttcttggggttcttcggatcatctgccgcgaattgctcgacttttttgacctcgaatagctttttcagatcgtcgagattcatggccgtcgcctcgccgagcgactggtcgctcatcgagtattcgtcatcctcggccgcgacttgcggttgtggtttcggctggggctggggctggctattccacgggtcggcattcggggtcggctgtgcgggttgcggttgattccacgggtcaccgccggcagccggctgcggaaccgattggggctggttccacgggtcatcgcccgacatattgcccgacactgtctgaggaaccgaagaagccggagtctgggactgaggctgattccacgggtcgtctcctggctgcggagccgcctgagcatggttcccctgcggttgattccacggatcatcgtgaggagactgctgatatggctggttccacgggtcggcttcggccggttgcgacgccggtgagaccgcggcctgagactgcgtctgattccatggatcgtcgctcgcgccggcaactgccgtaacggaagatgcggtggctggctgcccagtggactgtccagtgggtccagcggacgcaacggacgcagtgggtgcaacaggagcagccggagcggcccacggatcaacaccgtcactgatgtccggaaccgcaacatgcttcttgtgatgctcttcgggcgcaggcgtagcagcgggctcgttaggcgcgaacccgtctgcagattgcggcgaagcgttgcttacggccggcttggcccaagggtcatcgtcactccagttcttcgctgccgtggatgcactggattgtccggctcgatggctgtcgtctgcgtcctcggcttggcctgttgcagtcggcttcggagctttcgtctcgctccccatatgaatgtccaggctcgcgcccaaactcgacgcggccaatccagccttggccatggcaatctgctgcttgaccttggccaattgctccgggctcatacgtttgacggattcgactcgctcgccattcgccgcgaccgcagaaggtgcaataaccgcattggcgccgaactcgttgcgcacggcatccatcaccacggccgccgccttcttaccgctgttatccacggccaaggcgaaagcgtgctggctcagcgacttgtcgaacgtcatcgacaagcaaggcagacccttacggttggggccgaattttacggtcggcaccttgtctcgtgacacatattcacgaatggtttccggcaaagcggcgacggctgcatcccacttctcgtcgatggaccgattatccgatgccgcaggcgaggtcaccggttgagccgggacggccggcgacgcggcgggcgcgccccacccggcattggcggcaggagcggcaccggcagcagcagttgctacagcaggttgcacagacagagagcccgcgggtcggtcgctgaccgggccgttgacagggccattgcctccaacagattcatgggaagcggtgctctgaggcgcggctgcttgctggttgcgtgcagcaccggagaatccgccatgtgaggctccggcaaacccgcctcgcgatgcgccggcaaaaccactggcacccataccggaagcggctggcgtagtcgaagtcgaagaagcagccgcaggcggcataccagaagaagctggcgcgggagcggctgttgcaaagcctgattcactgccggccaacaatcgcgcggccagcagttccaagcgcatacgcggagaaatggctccggtcatggcacccaacgtagtgttgatgatgtctgccattgcggtcagtgcgcccagtcccagcgccttggcttggcggtgcagatcgtccatatcctcggcctcagccgtgtcggacagcacggattccgcacggtccccggccaacgtaagcaccagcagatcacgcacacgagccagtaggtcttcgacgaatcgtctcggatcgaatccgccgaccacgactttctggataacgccgtacagggcttcgccgttgtgatcgattaccgcatccacggcctcaccgatcagtgcctccggcgtgaagccgagcagggctacagcggcatcatgggtgataacgccttcgaccgaaccaaccatcagctggtcaagcacggacagggtatctcgcatggagccgccaccggcgcgcatcgccagtttcagcacaccgggctcgggcttgatgccttccttgtcgcagatcgtctccaggtagggacccatgacttcctgcggcaccagacggaacggatagtggtgggtgcgcgaacggatggtgccgatcaccttgtctggttcggtggtggcgaagatgaacatcacatgttcaggcggctcttcaacgattttaagcagcgcattgaagccctgctgcgtgaccatgtgggcctcatcgagaatgaaaatcttatagcggtcgcgcgcaggggcgaaaccagcgcgttctcgcaattctcgagcatcatccacaccgttgtgcgaggccgcatcgatttcgaccacgtcgatggaacccggaccgccggtggccaggtccttgcagctttcgcattcgccgcaggggtgggaagtcggccctttggcacagttgacgcaacgggccaggatacgcgcggagctggttttgccgcagcctcgcggccctgagaacagataggcatgtgtgagcttgccctcgtccaaggcgcgcatcagcgggaccgtgacttggtcctggccgatgaccccttcgaaggtgtccggacgatagcgacgatacagtgcaagtgccatagctactaacctacctttgccctcagaattaaccgataaaaagtcaagataaaccgggctcatagttgccgaatcggaaaactctttatattccaacgacattcacctgacaacggttaccgcatttttattgttattaaccgctttctttgtattaacatagtgtcaataacggttgtggtcaggaggcacccatgagcgataccctcgacgagaaacgccccacccgcggcgatgcccggcgcgacgccatcgtgcaagccgcgcgcaaggtgtgtctggaaaaaggcttctccaaaatcaccgtttccgacatcgcaagcgaagtcggtatgacgcgttcgctgttctaccactacttcgaagacaaggaagccgtagctgacgcagtactcgataacgtcatcgacgaaatcctcaccacgttgaagcagtggaaccaagcgcgcgaaacaggcaacgtgaacaaggcattagacgacatcgtgcatgtgctccgctccctgatcgccgacgagagccccttctcaaaccgtatgatccaagacggcaacgccgaactgtatatcaagttcattgaccgcgcggcggaccgtattgccgactacattgcccagaccaccgtacgtgatttcgagcagatgcatggcctgccgatcaccaacgtccatgagacgttcttcacactgattgtggggcttatctcgctgattcgctcgcatccgaacatcagcgaccgaaccatcaaagaggtcatggcgcagacgctgcatatcgaaagctatgtcgtctgaggtctgacggccattggctctggtaccgctctcccgcactcccctcagtccgcttcgcggccagctcgtccgcaattgcggacagcctacggctgactttcttctggttcgactatcgtcgaaccctcgcctacaaacagcccactgggctgtttgctttacggctcagcctaatgaggggagccaatataatcgggtcacgcgaactggccggtcacgggatcgcgaccatctcgggcaatggcgttgagcacttcctgtcgggaatccacctcacgggcggctacggccggcggcactagcacgcgcaacgcgcagtcctcggccactaccctaaatggcaaatgcccgatatattcgccgtccgccatcagcaccggcggctcgtctccttccgttgcccgcgtgacttcgatttcacggatacgtttccagccgaacacctttgaagcaagtagcttgccgttataggcattcgaaatggccaccgcgcattcgccgaagttcggcacgtggtccatccacaccaggtccaacaatccatcggagaagcaggagtacggcgagacctcaatgccgccaccgatatgcctcgaattcgcaatcgtcagcaatggtgtgatgatgtctcgttcatccgtggtcccgtccgccaatgcggctttgatgtggtaaccataacgcttcatatgcgtcagctccaccagcaccgccgcaaagtagcgcatggtgccggtcggcagatgcgaatgattcgcacggtcgttgatgctcgcgtcaagaccacaggacagcatgcccgcatagtaccggtcaatcggatgctcggcggacttgctctcctggtactcgtactcctcgccagtggagggatccacggcatagccgccgtccaaagaggtcacgcgtcccatgtccacatcgatgtgtgatccacgcacgatagcaccgacgataccttccactgcggtttcgatacggttgaccggcagcttcagtcctcgtgcggaatcgttgcccgaccccgtggccacgatgcccaacggcttgccactgcagcccacggcgttcgctccaagtgcgatcatgccgtcgccaccgaccactacgagatagtcgtactcgtgcgcgcgttcacgcgcctgattcagggaatcgtcgaaactcgtgccggtgatgtcgatgacatcaaagttatgggcacggccggcttcctccagcagacccaatacctgcgcgtccaccttagcgccacggcctttatcggaagtggggttacccaccatggccaccacgcgacggcgctcgttgcgttcactctcgctcatgctctcaccttagccaaaggcccagaagcccgccagagtatcggtgctttacggtccattattgtgataattgtctccttccgtacaactcaccggtccggcccgagccatccgctccacggatgatgccaccaggaccatggtttccaccttgatggttaccaacacgtcttcatcccgcacggagcaggagcccaaaactacaccattcgcttcagccatgttggcggcgagcgcacatggatcaccgatatccgcatgccacagcgcatacgcggcgtcaaaggcgataaggtcggcgagggaacgcgctcggttctggcagatcatgaggttgcccacacttgccgccaccgcgagcgcaatgcccaccaccataaccagcatggctccggccatcgtgcccgatccctcctcataacgcattccctgcaccgcagttcctttctgttgcggccgcccagccagccgaccgttattggcttatcgccgtagcgttgccggtaacccgcgttggagttacatccagcggaccgggcaataccgaacattcgaccgtcacactcgtcgattggccgtcgtgggcaatgctgacgtggggctctcccccggcaacgtccgcagctatgctgcgcgcggatgattcgtcaccggtaaccacaaactcgcgtgcagccgctgccgcggcactttgacagtccatggaaacgatgaccacacgtcctattgccaatatcagcccggcgatggcgataatgctgggcaatacgattgcgaattcggcggtggccgatcccgtgcataggtctggcggcagtctggcgagccgccaccggcatgtcatggtcttcatggctgtcacccgactttcagagcctgtttgatgatgttggtcagcaacgtcttgatggcatccgacttcaggatggcgaccagcaccgccgcaaagcctgtagccgcaacgagtacgactgcgtattccgcagtggccgcgccttcttcgggctcagccatgagggtgcggatgcgtgcgtccatgaggcatagccgttctttcgccttggcgttcagcgtggccacacgagccttgctgtgcgcaaagatgccggcctgcccgtcgacgatgacggggataggggtattcattggcgttcctttcggtaaggaggggaagctgcgcagtggcttcgcaccttccccatgcgtgtgtgagtggttggcccccgcgccgggttgacgcggggtgcataccactgtggactatcaacgcttcatgcaccagggaaaacggggtatgtggttctagcttgccgagttatccacaccccgacgtgtcgtccaccaccaatgtggataaccaaacgcagccaagtgcaataccgagcaatacaacaagattcaccctaagcgcactcagttcacgcctatattcacatcatgaaggacgcaatcgccggaatgactcctaccagcacgaatgccggcagaaaacatagccctgtaggcatcagtagctttaccgacagcttcgcggcattccgttcgatggcggcacgctcgtcacggtccagctgttcaatggcggattcgaggcgcacgccaggcatatcgccatgcgtccatgacgattccaaagccgattgcagcaggccaagatctcgttgcgttctgctggtacgttttccggatgaactatcagctggcgcaccctcatgctgaacagccatagcggcatgccacgcatcagcccagggaacccctctggccagggagctcccgacctcgctcatgcgagcgccgcagtcgccgccgacggctttgcccaccatgtcaagcgcccggggaatcgaggagccctgacgcaaggacacctgcaacatacgcaatatgagtatggtccatgacgacccgcaatcatgcgctacggccggttcctcgcccggcaagcggctgtcatgacgagacggagccttatacagccaactagcgatcgccgcacagcctgccgcggcgtgtacccacaccgtactcataatccgctgcctttcaacaatgcccgcatccatgccaagccggcagcataacaacatccccctaataccaagcagaccacaccgcgtggcgatccaagcaagaacgccaatggtctagctcccagaagctcgcccaatgccacagtgacggccggaagcgcgctcagcagccccacagtggctttaggaacggcacatgcttgcgatcgcaggttctgcatcagcctcatctgccggtaagcagtcaataccgcttccagacatggcactgcttggcaaccgagctcatcgctcaaaaccgctgcggcggtgaccccgcgtgcagcttcaagtacctgcgctggtgattcgtcgggcagacgccgctgttcgaacaccgttatgagccgttccacagtaatgcgctgagtggcgaagcgtctgctggattgttcctcgaatgcttcaaccaatgtgccgccacctcgcaatcgcgcgatggcggacgtaatcacctgcgcaacgcccacgcgaggtgagccggcatatcgaggttcgtttatggctgcggaatcgaccgcacgcccgcagtaagccagccgatacagcctcccggacttgttccccggccatatcagcacggcgagcgccaccagaacagcacaccacatcatcacccaccaccactcggcccgggaacgatgccccatcgttcaatgaagtgcccccattcggcggcataccgaggaggatggcagccattccataccgccagcggtgttcctgccagttcaccatgtgctacacgcagttcgccgatctgcgtgatacgccgctgtccgttcactcgctccaaatgcaccaccgcgtcgaaagcgcctgccgccagcatggccaacgcctgtggactgactccggcgagtaatccaagcgaaatcagcctggacggtactcggttcacgccgtccgcatgcacagtggtcatgccaccgtgatgaccagaattgaacgcgcgcaataggtcgacgatttccgcgccacggcattcgcccagcaccacgcggtcggggcgcattcgcaacgtcgctttgaccaagtccgtcagacttatggctccgacgccctccacattcgcctcgcgcgttaccaacgacacatgatcgccacgccccagttctcccagttcacgaacttcctctacggtgacgatgcgctcgttcacatcgcattgcgccagcagcgccttgagcaaggtggtcttgcccacgcctgttccgccggtaatcagcactgtggcatgtctgcgcaccagtcccacgaacatcggcagccaagcagccgggaatacacctaattggctcagatgtcgcaacgatgccatggtcctgtcagggaaccgtatggagattgcggcaccttgtggcaccaatggggcaatcaccgcatgcacgcggatgccgtctggactggcggcgtccgctatcgggcaggcatcatccagtctgcgcccaagctgcgcgcacagttggacggcgtattctcgaactacttgcggcgagcgaaacggcacacgcaatactgtttctcgcatgccgttgccgcggtccgcccaaacgcggccatcacaggtcaccgccagatcggtaacctgcgggtcggatgccacatcattcaatagaccgaagaacacagttctgggcactgcgccgggctcatcagcccgagtgattacggcagccataccgcatcaccggtccttgcaagaagctcccgaaaccgggcgaatggcctgctcgacaagatcggcaagcaagctcacggctttgcggctgcctttggtcaccgatctgatgccgaggccttccagtacgtctccacacagattgacacttggtttgacaggccccaataccgtggcagtcaaatagtcctgcgcctcaccaatacccacgtggcctctcccacgtggagcgccacgtggttccacgccgacgatatgtggcgcttcacagccccatgaatccagtctggaccggtgcgacttggctctggccagccccatcaccgacaattccgcggcaatcacctgcatgccactgcgcagatcgggtacggtctcaatgagtccaccctgaccggcatctacgatgacaacgtcgttcgtttccgccaaggctcgaatggccgcttgaacttcccaccagtcaggctggcgcgcgctccaagggtcatagggaagtactcgcacaccctcccacatcatcagctcatggttcatcgcatcgccctcgatgcggccgaggggtgcgtcgacttggctgaatcgtaaacccggctctcgttctacacccagcagcaggtcaaggcatccggccacgaaatcagcgtctatgagagcgcagctgtgttcacgtctcgccaatgtccatgcaagcatggaagccatgacactcaaccccacgcctccatgacctgacgtcatcgtcacaatgttatggaagctggtgtctgtagttagggcgagtgccggagcctcgcccgatctctgccgttcgcatgaggccaacggcctgggcggcggagtgtagtagcgatgcgctggaatcggcgcatcgtccgtgggcagcggaatgcccggaggtgctaccgctggcgaggtgatcctacgcgccacgcggggtgtggtgttgctattcataagccgattgaaacgtgtccgagttcaatgctcaacacgaatcgaccattgtggttctagcttgctgagttatccacaccccggcatgtcgtccacgacaaatgtggataaccacgctgttgtttcacgcccatctcatgcagaaaaggccctgacctcatatgcacagtcagggccttcattttcacgacgattccttatgcggtaatctacattccttgcttacttatcgaggttcttgatgccgtcttccatgacgtccaactgagcatcggtcaccttggccggcttcttcttgccgaacttggccttgagcagaccgatgatggtcggggcgagcgaaaccagcagaatcagcacgatcaccagttcgaagtgatcctgcacggccggaatgttgccgaagaagtagcccagcagcgtgaacaacgtggaccagcacaggccgccgagcactgagaacggcgtgaaacggctccaacgcataccggaaataccggaaatgaacggcatgaacgtacgaatgaacgggaagaagcggcccaggaacacagccagcgggccccacttttcaatcatgccctcggttttggccagtcgctcaggagtcagcgccttcaccttgccggattggataatacggcggccaaagaaatgaccgatgaagtagttgcactggtcgccgataatcggcgcgcaccaaaccaccggcagcaaccagaacagcggcagcgcggccttgccggtcgcagcatccggggctgcgaacacgccggccgcgaacaacagcgaatcaccgggcaggaacgggaagaacaccacgcccgtttcgatgaatacgatgaggaagatgaatccgagggtcggcgccacgcccatggcaatccaaccggcaatcgcggcacgcggatccttcagcagttcgatgatgaaattaacgaagcccatgtgtttcctatgagtcctaaatcttgtattgagctgccagcccaatgaaccagacagttatatgcaaaccgtcaaataccctaccagccggcctataacatcaggtcgactggggtttcccacacaaactccgcaatacaaacgaaatttctactcccccaaacgctgccgcacaaaggcgtccagcgcggccgcatcgatgccctcatacgagtcgatggaggcaaactggccaaggccggaagtgtcggtgcgaatccagccagtctgcgcaatcagtgtggcccccgaggcggcgccggagcgcagaccggatgaggaatcttccattaccacgcacttgaccatgtcttcaggcgcgatgccgagtctctcagccgcggccagatatggggcagggctcggcttgtgctcgtacggatcatcgccgcagacgtagccggcaagcaatccatcagcctgcttcatgatgttctcggccatgcggcgaggcgaagtagtgaccagcatggatgggatgtcggcttccttgagcgaatgcagcacgtcttgcacaccaggaatccacggcagacgttcgacctccgccttgaacacataatccttgagctgcttgtcgatttcgggaacgctcaatgtgcagccatgcgcaatcatgacctctgccacgtgtggtaccggagtgccggagcactcccaaccgaggtcctcgttccactcgccgccattgttgtgcgcgatctcaatctcaccgtcatgccagagcggctcagaatcgatgagagtaccgtccaaatcccagaacacggctttgagcagcatagttacctccgtccacatgcccgcacgccaattggcgcctttactcttgctgcattccattgcaccaatcggatgcgacaaccatagcgcgtcagcacaccgcccctgcgcctcagcgcatggtcagcccaccatcgacgtgcagacattgtccggtaatgaagccggccatgtcggacgccaacaacgcgacccctccggcgatgtcatcgggacgggcaaggcggccaagaggcgtcatggcaatgattcgttcacgaacatcctcggtggtggctgcgctggatgcggttccggccgtcaaacctgcggcaatggcattaacggtaatgccgaagccgcccagctcctgggccagagagcgggtcatgccgaccaagccgcctttggcagtgatatacgaatggtagggcacgatgggcgaatcgaccagattgctggagatgttgatgatacgcccggaggtctgggctcgcatcagcggcaccacatgtgagcacatcagatatgcaccatgcaggcatccctcgatctgtgcgctaaactcatcccaatcgcctccagcaaaagtggaacggcgacgcgggtcaaaggagaagcgtccgaaagcattattcactaagatgtccacgccgccgaatgagtcgacagcggtacccactagcttggaagattgcgattcatcgcaaacatccgcctgtacagctatagccaagcctcccagcgagtggatgtcttcaacggtgcgctgcgcgctggcggcgtcatgtacgtaattgatgacgacagcggctccgtgcgatgccaggcatttcgccacagccgctcctatgcccttgccggaaccggtgatgatcgctgttctgccatccagattcaccattggacgccgtgccatatcgctttgctctgtcattacccttgcctttcgccctgctaccagcctctgctgcccgcaacagcacaggcctattccatatccatatcgaacgaatcgctgtacgcgtcgctgccgcgttcgacatccaccacgcgcaacagatcgatgaggttgaagcccccatcatgatgccagccggatttcgcccgatccatctcaccgagcggacagatgcgattcacaccgacctcggccaatgtatctgcaagaccaaacagtctggttgaatccacagcgacaccgcagctctgcagccagccacggcaggaagtcagtcttctggcagcgtccaacaaatctggcaccgccaccacgttgacggtgcggttcaacggcgacatcagcgaagcaacatcctcgtcggcaccgctaccgtcaagttctcgatacagcaccgaccatgccgtgctatggccactggcgaacaccgcggccttcccgcccatcaaggctctcatctcagcgtcggtgcgcgcccgctgaatggccacgttctcggcgtcactcaatacggagcgcggatatttgcgctgctgattctcaagctcgccaccgagcagctgagccacttcacgaggggtgagggctccatcagtctccacgaacacggtctgcggagccaggcagctttgctggtcatatgtggcgatgtcaacagccacacgatgcacggtatcggcataggtatcaggacgcaaagcctctcggccaatgaacgccaacccgacttttgctccgtaacctagacagggcttggacccggcgactttgcccgcaatcaatttggtagtctgcgaagaaccgtaaacaaccacggcatcggccgcatcgatggctgaatcctcgagctgctgcgagccgcccttccatggaaccaccgcaatggcatcagcgaggtcggaattgaccatcgcaatgctgcgagcaaagaacgcaggcatcaccggctcggaaaatgaagatttgccaagaatcgcgcctttgaccagcagggtcatcgccatgctccacacgggaatccccggcacattgctggagaacacctgataggtgagcgctgggcccacatatttagagtatccccccgccttgttcggccggaattcgtcgagcatagacggctgaccgatttcggagtcaaggaaccggagcagttcacgacgcctgaactggcgcatataccgtttgagctcaatccgcaccatgtcaggctcatatccggtgattgcgggaatcagcagttcagcctgacgccgcagctcaaaatccggatcggcccatagttgggccgcgtcggccacgatgtcgagaatatcgttgacactcatcgcggcaagcgtgcggttgcgaacatcgacaagctgcttggcaagggaagtcacctttgagccatccagtcgcggatagcgcaaacgcttcaccccatccgatgtggcgacctcatagatttcgtaatccgaaacatccactcccgagggcaggtggaagacatcaatggcctgactcacggattcatcaacggttggcactgatgacctcgtctaccgcgattgagcacccacgagcctcggctcccttcgccctgccctgcagcaggaatccgtccggggtccgatggccgaggtcctcggtcagaataccgatgcatgaattccaattggcaaggtcgtaatgggctatcacaccggtctcaccatccttgacgggagtcagcgtttccggatcgaggaagaccgtgcgcacccaggcggggttcgccttgagatagttgctggtgccatccgtataccacgacagaatattttggtcatagatctgcgagctcaactcggtcatgccatacatgttgacgcagtggtggcgcggcacccccagtgtctgttccagctcatcaagcatctggtcttcggtgatgtcgcgcttagtgctcttgaagccgccagtgtcgaacaaccggctatcgggggccagcgcgaacgtcagatcatgctcatgcaggtaatcgaacagatacagataggacgacgagacacccatcagcatcaccggttcaccgtcagacaccgcacggttaaggaaggcgatgatttcatcgaacttgagtccatgctcgtcgaagaacacaccgctgccttcgctgccgcagcactccacggccttggtaaggtagcgcgacagggaggagttctggttcatgtcccatgccggcgaaatcacggcgatgcggatacgctctcgatccggcatgatgaaatgacggaacggcacaatcattgattcatcccacacctcaagatcgggatggaagttgcgcccacgcatcttgccgccatgcgtggttccgctcgtcatgaatacggcttcgcactgctcggtcggtatggtcgaaaggtcaaggtgcttgaacccgtccaccggcatcggcggaatctcccgccaatccttgagcgttgcgggggtgacgcgtttagccgcgcagtaacgacggtacggcagatcatacgtgtactgatagatgaacacgtcgcgcgccaacgcaccaaacgcctcttccggggcctgctcacagccataggtatggataaaatccagaatcccgcgcttgatacgacgcgcgtcatccatcacatcagtcattgcatcgctcctgtcaatatccaatatcaaccagcattatcgttcatcgtacgccgcagcgccagtcccatccgccggatcggctgctggaacatccacggacgccggcgcacgatgcttcgccaccaaatccggaagagcgacgaaaagcgcattgagaatgatggcgctgaatacaccgaccatgatgttgttgccaaagaacacgcttgcgccgccggtcaggccggagagcgccttgggcagggcgatgccgagcaacagagacatgccgatgaccgtttgacggcgctcgtcatcagcgaccttgcgcagggcgcgcaggccggtcacgattaggctggccgcagccggcaggaaaatgcctccgacgactgccgagggaatgacggacagcaacgcgcccgcctttggtacgaagcccagaatcagcaacagcacagcggcgatgatcacaggcgtgcgcgtgcgcaacttgccttcgccggtcaggttgagcaggccgacattttgcgggtaggcggtggtggtgaatccaccaatcagcgaggaaatggctgaaccggccgcctcgccggcaagaccgtagcgcacctgcttgcgttcgaggggcgtgccctgaatctcagaagccgcctgatagacgccgagagcttccatgacggcaaccatgtaggcgatgaagaacgggatgaagatcttccagtcaaatgtgaacggaccgtagggcaggaaggtcggcaggcccagccatcccttggatgccacaggagagaagtccaccatgccaaatgctgcggcgaccacggtgccgacgacgagcgcgatgaggaatgagaacgacttgagcaggcccttgccgagcaacgacaggacaagcacaatcgccgtggtcagaatcgacacggtcaggatgtgcggatcggcgaacgtcttgtcgccgggagccccgcctagaaactcgctcagcgtgaatccagacagcgagacaccgaccataaagatgaccacgcccgaaatcatcggagagaacaggaaccgcatccgctctatcacaccggtcaggcacagcaacaggaacacaagcgaagcgatgagaatggacgaactcgccgcccccagcatgccggccgtacctgccgcgatcatcaacgcgtcaaacgcggctgacggcccctgcaccaccggcaggcgaaccagccgagtggcctgaaccaaagtaaccagaccagagacgatgaagatggcgttaatcatattcgacgacagggcaataggtaagccgattgctccggccacaaacaccggatcaagccagacgttggaaacaagcacatgctggaaacccagcagtacgttctgggcggtcagctccttgcgtattgacatacgcttcctctctctcaacgcgtatatgggatgccgagccgaacagaggagttcaaccgtcgcattccctacgcgagtgttagctcacaggttcgaagggttcggcacataccgtctcagcctaaagcaccccttacgaatcggttttcgcacgtcaccgtaacaaaccttgacatctccgtcaagaagattcgtgcttttcggcagctgcccgatgtgagataacaaacagttttacgaatggagaaggaatcgaagcaatgcggccagactcaccaaccccacaggaccatggacttggagtcggcgggagtgtagttggagtcgccggtggcgccggcagcgatatcggcggcagtatcgcggccgggcagttcgcgggtttcgcggcggatggcgttgcgccagaggcgggcgcggttggagcgttgtacctccacgatattgccgtcacggcctgcggcgaaaacgctctcctggtcgccggtttgcatgcgtttgacttcgcggcgcagttggcgattctcttcttcgaggaccaaaatgcgcgcgataccggaaaggttgatgccctcatcctggctcaggcgctgagctcgggtcaggcgggcaatgtcgcgcaggcagtagcggcgtgcgccgccatcggtgcgctgcggacgaaccaaaccgaggcggtcgtactgacggagagtctgggggtgaatgttggccaactcggcggtctggccgacggtgaagatgggcagttcgatgtcgaagccgacgtcatcggctccgtcgagatcggccctgcccatcacgagcgcggttgcgcacatcgcgtataactgcttcatctggttggctaaccgcgccattgttcacctcctgattacaggctgagatagtcgccggctttttcgtcgaattctttggcggcgtgcttgacggccagacccggcttggcggggaccatgatctgcacacggccgatcaggtcgcccggctggttgctgcgctggacgccaagtcccgcgagcttgacttccgcgccggagctggagcctgccggcaccttgaaggtgacgggattgccgtcgatatccttggcctcgaccttgccaccggccacggcctggcccacagttacgggcaggtccatgacgatatcatggccgcgcatcgagaatgtggcatcgggcttgacagtgacgtgcaggtacaggtcaccggccttgccgccgttgatgcctggcttgcccttgccggccagcttgattttctgtccgtccttgacgcccgcaggcacgtgggccttgaacttcttgccgtccacggacaaggacacggtagcgcccttgaccgcctgacgcagggtcaggctgatcttggagttgcggtcctcgccgttttcggggcgcggggcctcctcatagccatagccgccggcattgccgtacggcgattggccgtagccgccatacggctggccgccctgacctgcagcaccgccgaacatcgagaagatgtcgttgatgttgttggggccgccgcccgaagtggagaagcggatgcgcgagccattgccgccggcaccctggccgaacatggaaccaaagatgtcggagaaaccggaagcatcgaagccgccggtgccggaaccgccggcgaagcgggcaccgcccatgccgaactgacgaatcgcgtcgtacttctggcgatcttccttcttgctcagcacgtcataggcttcggagatgtccttgaacttctcctcggcttccttggtcttgttgacgtcaggatggtatttgcgggcgagcttgcggtacgccttcttgatgtcgtcgtccgaagcgtccttggagacaccaaggactttgtagaagtctttgctgagccattcgttttcagccattcatgtctcctttctagaaaagtctttatgattggctcccctcagagaggggagccaaggtaaatatcaactcattgcagcgagctggatgtcagttttgcggggaggctactactactcgggcggcgcggattacgcgatcgccgatgcggtagccggcctcgaccacggtgtcaaccgtttccttttcggcatccgcgtccggcttgtgcaggatcgcgtcatgcttggtggggtcgaagtcctcgcccttttcgccgaacttctcgacgccgaacttctcgaaggccttgtcaatcttggtggcgacggccttgaacgagtcgtccatctcgctgtgttcgcgaatgcggtcgatatcgtcgagggcgggcagcagcgcggtcagcacgtcgatgatgccgtgctggcggaagcgctcctgctccttctgcgtgcgattgcggtagttgatgaactccgcacgttcgcgttgcagggcttcgaggtagtctgcggcttccttcttggccttgccgagcggggtgagggtgtctgcggaatcggactggccttcgccagtcttctctccctcagctgcggcaggagccgcgtcggctccttcattggaaggagcctgggcagccgaatcctgcgcagagccggactcggcggaggcgtcagcccctgaagaggcctgagcggcagcctcagcatctgagggatccggcaggtcgttcaggtagtcgtccttgttgaactcggacatcacttgttgtccttgtcgtcatcgtcgtccacgacctcggcctcgacggtgtcgtcgtcggaaccggaggcggagccagcggaagcgccggcaccgtcagcaccagcggcagcaccctcggcaccctgctgggcgtagaggacctggccgatcttctgggcggcggtcatcagctcggtctgagcggtcttgaccttctcggtgtcgtcacccttcagggcttccttcagagcgttgaccttgtcggtgacttccttgacgatgtcgtcggagagcttgtccttgttgtcgttgacgagcttctcggtggagtaggcgaaggcctcggcctggttgcgggtctcggcgtcttccttgcgcttcttgtcctcagcctcatgagcttcggcttccttgaccatgcggtcgatctcgtccttcggcaggccggaaccaccggtgatggtcatggactgctccttgccggtgcccttgtccttagcggacacgtgcacgatgccgttggcgtcgatgtcgaaggtgacctcgatctgcgggacgccacgcggagccggagcgatgccggtcagctcgaaggtgcccagcggcttgttgtcgcgagcgaactcacgctcaccctggtagacctgaatcagcacggacggctggttatcttcagcggtggagaagacctcggagcgcttggtcgggatggcggtgttgcgatcgatgagcttggtcatgatgccacccttggtctcgataccgagggacagcggggtcacgtcgataagcaggacgtccttacggtcgcccttgatgacgccggactgcacggcggcaccgacagccacaacctcatccgggttcacggactggttcgcttccttaccaccggtgagctccttgacgagttccttgacggcgggcatacgagtggaaccaccgacgagcaccacgtggtcgatgtcgctcacggagatgccggcgtcgtgcagcacgttgttgaacggcgtgcggcagcgacccagcaggtcggaggtcatttcctcgaagtgcgcacgggtcagagtctcatccaggtgcaccggggtgccgtcaggggtcatggccaggtactgcatggagatgctggtggaggtggaggaggagagctccttcttcgcctgctcagcggcttccttcagacgctgcagcgcgatcttgtccttggacaggtcgacgccgtacttgttcttgacttcggaaaccagccaatcgatgatcttctgatcccagtcgtcaccaccgaggtggttgtcgccgttggtggcctgaacctgaatggtggagaagccgtcgtcatccttgccgatctccagcagggagacatcgaaggtgccgccgccgaggtcgaagaccaggatgcgctcgtcttccttgcccttctcaaggccgtaggccagagcggctgcggtcggctcgttgatgatacgcaggacgttcaggccggcgatcttgccggcgtccttggtggcctgacgctgggcatcgttgaagtatgccgggcaggtgatgacggcgtcggtgacgggctcgccgaggtaggcctcagcatccctcttcagcttcatcaggatctgcgcggaaatctcctgcggggtccacttcttgccgtcgatgtcgacagtccagtcggagcccatgtggcgcttgacggaagaaatagtgcggtcaacgttggtcacggcctgacgcttggccacttcgccgacgaggatctcgccggacttggagaaggccaccacagacggcgtggtgcgcgcgccttcagcgttgacgataacggtgggctcgccaccttcaagagttgcgatgcaggaattcgtggttcccagatcgataccaactgcacgtgccataatgtgtgctccttaattactcgtttgttcttacgttctttgcccaagttccgattggtcgtctcttggaccttccaaacttgagcctacatcactcaacttccatttggcaagttctattcccaatttcaacacaaaaagttgagtatgtttggctcaagttttttgtgggagtgactgacggcgatgacggagtggtgcgtttggagccaaaatccacttatacagaaaactgcaaggggtgactggggcgcgccatcagccttgccatcagacttgccagcggcggcgcgcgattgcggcgcatggggtgtgtcggcgacgttattgtcgctgggggcatcgatgcgctgaataactcagacacagtgtttgtcgccgattttctgcgggaattgtttggcaatatcgccaggtatgccgattcgacgcagcgttacgtggtgctggtttccgccgctcaggaccgcgtcaccattgatgtgacggaccgtccgcgtcaaggtgacgcgacgtttgagggggcggcattccgggcttgcgtactatcgggagcgtgtgctgcatgcgcacggggattgggatgtgcgggagaaacgcgggcagtgggtactgcatgcttcagtgccgatcgataacgctggctaatcgacaacaccggctcatcaataacgccggctaattgataccgccaatcactcgataacgccagccagtcaataacgccggtccccggccgcgccggcgtgggtcgcgagcgaggccgccatcgcgaccgcgcagaccgcggcggccaccgcgacgcccttgtgctgtttcaccttgtgcatgaaaagttcctttccactgaccgcacgatgagtgcaatcgcgaaggccatcccacgcactgcacccggtatgccacgctcttcggcaaccatgccgaacttatcgccgcataccggggcgcacccggatgttgcagaaagctgcaaccgggctcagctgcgcagcaaaatttcttcgagcgcgccggccaccgcatcgggcatgtcggtgatccagaaatcgttggcgtagcgcggaccacggttcatggtgcgcagggcgccgatcgcgccgatgccgagcttgtggaccgcctgcagcgcgagctccttggtgcggtagagcatctgggcgtgcagcagtaggtccatcgcgtccgattcgaccggattgtcggcgatgcgcagaccgccgggaatctcgatgcgcagactggcagccgagctgatgccggtgacggacacggtcaggctcatggtcgcctcgtcgtacgccaccgtcgcctcgaccggagcctcgccggaccatgcacgcacgccgctggccgcgtcaaccggcgcgacgccgcggaacacgaccgtccagtcgcgcaactcgggtacggcggacgtatcgccggtaaccggcgcgacggtgaaggcgctgggcgacgcatcggccccgccccacgtgaacgctatcgcggtgtcggcgctgggggcgccccacgtgccgcgatcctcgcgcatgacgaacgagccgtcggcaccagggaacaccagcacgcgcagggcctgcgggttggcgatagagttgatcgcttcgccggattccgcgacgtcctgcaacggcacgatcgcgccggccttggcgaacaccggcgtgcggtcgagcgagcgccagacctccagtcggcggccagcggcgtcggatgagacgtatcggcggccgtcgaagaagtcgaaccactccccctgcggcagccaggcgtcggcgcggccgcggcaggcggcggcatcgtccggggagacgatcggcgcgaccacgagctcggtgccgaagcggaactcatccggcacctcgtaggcgtccggcgtatccgggttctgccagtacatcggctcgaccagcggacggccggcttcggcggcacggtagttcatggtgtacaagtacggcatcatcgcgtggcgcagacgcagcgcgtccaccatcgcggcgctcacgtcacggttgaagttccacggctccttgccggagaacggcgagttggacgaatgcagtcggttgatcgggctgaacgcgccgagctggtaccagcgggcctccagctcttcgttgcggtagccgaacatgtggccgccgatgtcgtggctccaccagccatacccgatgttggaagcggtggcggtgaactgcggctggaaggcgagcgattcccaggtcacgatcgtgtctccggagaagccgaccggatagcggtgggagccggggccggcgtaccgggagaaggtgagcggccaattgccaccgcgccctgagtcgaggtagtgcatgtggttgagcatccacagcgggtcgagacccttctggcgggtcacgccgccctgctgccagtccagccaccagaagtcgacgccttcggcctccatgcggtggtgcatgtcgaaataggcgtccacgaagtccgggttggtgaggtcgaattccacgttctcctcggtggccgggtcgatgccgacgcgcttggcgacttcggggtaggcgtcctcgaacgcgcgcacgccgtcgcgcgggtggacgttcagtgtggtgcgcaggccgcgccggtgcaggtcggcgaggaaggccggcgggtcggggaacagttcgcggttccacgagtagccggtccagccggaaccgtacttcgggtccacgtcgtccacgcgatgccagtccatgtcgatcacggaggtggtgaacgggatgccctcgcgcttgaagcggtccatcagggccagatagccgtcctgcgtgtaccggtagtagcggctccaccagttgcccatggcgaagcgcggcaggagcggcgtggggccggtcaggcgatagaagtcgcgtacggcctcgatgtagcggtggccatagccgaagaagtacaagtccgtttcggcggtggcgcgcggggatacccaggtgccgaacgggttcgccttgccgttcaccgtgtcggcttcgatgatgatgttggcggcggaatcgtcgatgacggcccagccgtcgcgcgagatcacgccgttgtcaagctcgatggcgccgtccgcctcgtccagcgtgcgggcggtgcctttgaggttgccgcgctgggcgtcgccgtaatgccaggtgttgaactgggtgtcggccacgcctttgacgaccacgctcaggccttccttgctgaacggctgctggtcgtagacgatggtcagggccacggtgtcgatgatgacgcggccgtcacgctcggtgacgcggcgttcgactgggctaccgaaatcgcggttcaggacggtctgggtcgggcggttctcgaatacgccggaatcggaccattcgaatcgcacgagcgaatcggtgatgagtccgatgcgccagtgctcgccggacaccacattgtcggcgcgcatggccggcgtggcgtcgaggcggaagtcctgcggatcgggcgaggtcggagacgactgcttgagttgtggtgactgtgccatggttaccccttctgtacggttatccacgatgatacgagtgatgcggccgcggctccccgggactggtgggagactgcggcgcggttcggattcggccgaaaccggccgggtttacttgcccgagccggtggcgatgccggcgatgaactgcttctggaacaccaggtaggcgatgaccaccgggatgatggtcacggaggtggcggcgaacagtccgccgtaatcggtgccgtactggccggagaacatcttgatgcccaccgacaacagctgcttgtcgtcatcggcgatcatgaggaacggccagaggtagtcctcccagttccacaggaaggtgaagatggcgagcgcggcgatggaattgcggctcatcggcagcaccacctggtggaagatgcgccagtcgctggcgccgtcgaggcgggcggcgtgcgggcggagcagggcatcctcggagttgtggacgttgaacagcacgggggcgttcttgttgcccttgcgcgagagcggggtcttgacccagtagtcgctccaagccacctgcgagatcttgaaggtgacgttcgggtggatcttctcgtactcgcggagcatggagatcaccgggtcagtgctttcgtcgccccaggaccagtagcccagttcgatgggctggccgtcgttgaccaagtggttggggtcgtaggtgatggtgtcgcccatgacggccaggcccttgtcggcctgggtgtcgacgacgcctgacgaaccgctcgaactgcaaccggttgcaagtgccataatgctcacggttgcagtcagcgcggcgagagatttcttgatcttcattatctcccttacttcctcgcaagctctaagtgaaaacggttcagtatacgggtgtcgaactagttcggcaacccggctttctcagccatgcaaaccgttacatttgcaacctgttacattccaaagctattgagaccatattggtctatattttcggcgtgtcgcaatatcgcaacccattgcactatgactgtcgtaaaacgtactgcaatgatttacaatgaagagaagtttgtcacaccgtcaactttgaaaaaccgggaggggccatgaaagccagcatcgaggacgtcgccaggcaagcaggcgtctccaccgccacggtctcccgcgcgttctcccgccctgacatggtctccgccaaaacgcgcgccaaggtgatggaggccgcccaacaactcgacttctcggtatcccgcatggccggcatcctcaaatcgggccgctcccaccgcgtggcgctgctggtgggcagcagcaagctcgactggttcacctcgcgcatcatcgaaggcctcaacgaagtgctgcgatcggccggctacgatctggtcatccaaccgatcggcgatgcgggcgcgcgcgaggagttcttcgacgaactgccggtgcgcggcaacgcggacgcggtcatcgtctcgtcgttcgccatcaccccggccgaaatcaggcgactcaacaccacgcggatcccgctcatcggcatcaacacggcctcgcaggggttcaccgcctccgtgggcatcgacgacaaggccggcatccggctgatcgtgcgccatctgaccacgctcggccaccgcaacctgttgtatttgtacgagacgttcgatgccacgatgggcttcagctcgcacaaccgcgtcaccggattcctggaggcgtgcagcgaactggacggcgtgaccggccagacgatggacatgcaggccggcgacgatccggtcgacgccgccctcaccgcgctgctcgcgcgcgacgacgccccgactgccctgtgcttccatcaggattcgctggcgattccgctgttcttccgcctgcgccaatgcggcatggcgattccgaccgacctgtccgtcaccggattcgacaacagcacgttctcgggcgaggtggggctgaccaccgtgcgccagaagccgtacgacatggccgtcgccgccgcgcgcaaggccctggaccttatcgaggggcgcaccctggaccagccgcacgagatcttccccgtgcaactgctggtacgcgactccaccgccgcgccgcgggtgcgcggctgagcggggccgaatcagtcgttattcgggccgctgttgtcggactgggctttgccgttcctgcgagctatcgccatgaacgtgacgccgacgatgacgggcaggaggatggcggcgagcgttgcggcgcggcggatggcatcggacgttgcctttccggacttggcgtcgcctgacttggcggacgctgcggaatcggcggacttggcggcggtgtcatcgcccttatgcggtgtttcgccggtgaaccaggcgggatcggacggatcgtatttccgggtgccggcccagtttgcgggcgtcgcgccggcgtatagggcgacggccgagcccttggccacggtggcggtgaaggtgccggccacggcgttgcggaagccgatcatgccgcggatggcggtccagcgttgcgcgcagtgccaggtgccggcggtttcgatgccgtcggtcggacaggtcatgtccggcacggaggtgcgggtggcgccgggagcgccgtcgtcgacgccggcgtagtagtagccggagaagatgtgcggctggccgtaatcgtaggcgagcatgaaggcgttggcgagcaggtagctggtgccgtcacgggtggtgagcgaggagccgttgcgctcggtgtcccagttggtcacccatacggccgccttatcggaatccacccaggtcggtccgccgatggcgtccaggccatccgaacgaatcgatgcaggccggcttcgacatggacctctacctcgactggcgccgggacggccacccgaacggctacaacctgttgctgcgcaataccgacacgcctatggagcacgaaggcgattccagttatttcaacgccgattcaggtgcctcaatcgcctcattcctcacggaatacctgccggacgagctctcttccgacgccgacgtgctgctcagtcttggtgaaccggccgtgagcggcgggcagctgacgctctccccgcaatcgttcgtcgtgtttggttaaacccgttcgacctcacctccgccggcgaggctgtcggcaaagtcgactggggatagtcaacgggccatcacgacaaacaccaacacctctagcctcgtccaactcaccgaatgtattgcaatcgttgtcaatatgagttacggtagaggcagaacagctcgaacattggtctgtcaggttgccggaacctcaacgcagagcggccctcgaacagcaatgcaaacgactagcagtacccgatttgcaagcaaggagtcatcatgaccgacgcatacggcaacgacgcagcaaccagcaccggcaccatcgcagacaccaccaacaacgccgcttccggtgccccgcagcgcgcggaaagcacggaacgactcgcccgcccgctcatcaagctcgccaaagcctgcggacttgccacctcattcatcgaccagctcggcacctacaccgaaatcagcgacgcggccttggtcgccgtactcaaggccctcgacgtggacgcatccagcgacgaggccatcgtacgctccatgacccaacttgaggtggaaaacagcaaacgtttgctcccctccaccatcgtcgccaccaccggcaaaccgaccggcatcaccctgaactgctcgtcggacgcggacatcaccgcctccatcgaactggaggacggcaccgcgtttggccactttgccctgctgccgaacctcaattccggcaagccggacttgaccatcgcacccgacctgccgatgggttaccacacgctgaccgtcacggttgacgggcgcgagggcaaggcggccatcatcgccgcccccgcgcgcattcccgtgccggaggcggtcgccgagcaccagcggtggggctggatgacgcagatgtattccgtgcggtcccgcgaatcgtggggcatcggcgattacggcgatctgaagcgtcttttggcagatgccgccgagaagtccaaggccgacttcatgctcatcaatccgattcacgccggcgcgccgattccgccgcttgagccatcgccgtatctaccggaatcgcgccgattcctcaacgtgacgtacatccggccgcaggatatccccgaatatgccacactgccggccgacgtgcgcgcgcaggtggatgcgctgcatgattcggtggccgcgcgcaacgacgaatcgaccccgatggacatcaacgcggcgtgggaggccaagcgcccggcgctgcgcctgatcttcgaagcgggccgcaacaacaagcgcgagctcgaattcgagcatttcaagaccaccgccggcccggacctcgattccttcgccacatggtgcctgtgcttcgaggtatggggcgcgccgtggggcgagaaccgttggttcttcgagaagaccatcgacgacccggccgtgcgccagctcgtcgaggagcaccacgacctgttcgagttcaaccgctggctgcagtggatcgctgccgagcaggtgaacgccgcgcagcaggaggcgctggaccacggcatgacgctggggctgatgcaggacatggccgtgggcgtgcacgggctcggcgcggatgcctgggccaatccggaacgcttcgcctcaggtggcgtcacggtcggctgcccgccggacttctataaccagcagggccaggattggggccagccaccgttcaacccgcgctacctggaggccaccggctaccaggtgtaccgcgagatggtgcattcgatgtacgagcacgcgggcgcggtgcgcatcgaccatgtgctgggcttgttccgcctgtggtggattccgcaggggctcggtgcccgcaacggcgcatacgtgacgtacaaccacgaggcgatgttgggagtactggccatcgaggccacgcgcgccggaggcatggtggttggcgaggatctgggcaccgtaccggattacgtgcgccgcattctggccgatcacggcgtgctcggcactgacgtggaatggttcaaccgcgtggacgattcgccgaacgccggcgacccgtaccgtgcacccaaggactatcgcaaacaggcattggcctcggtgaccacgcacgatctgccacccaccgccggctacctgaacttcgcacacgtcaagctgcgcgaggagctgcatctcctgagcgagccggtggaggcattcgccgcctcggcgatggccgagcgcacggccatgatgaaccgtctggtggagaacggctatatctcgcagaccgtggcggatgatgtggaaggccatgtgcaggaaatcgtggaagcgatgcacgccatgctcaccgatacgccgtcgctgctgctgcaggcagcgctggtggacggcgtgggcgaatgccgctcccagaatcagccgggcacttccagagagtattcgaactggcgcgtgccgctggcggacagctcaggccacgtggtacataccgacgaggtcttcgacctgccacgcgtgcagtccctagccgccgtgatgcgccgagagaagcggtgatcgattccggcaatgggaaattggtctaaatcggcccctcgtaatcgagatagccgaagacgatgacttgttatgggcatgttatcgttgtcatgacaatgattgttcgcgacggcgaaggagcgacggctatgaccaaggcaagcattcaagcggtggcccgcgaggccggcgtttccgtatccacggtgtcccgaaccttcgccaagccggatctagtgcttccagagactcgagaccgagtgatgaccgcggccgaaaagctcgactactccgtctctcgctcggccgccgcactgaagtccggccagtcgttccgcattgcgctgctggccagcgagaccatcaccacctggttcaatgcaaacatcttcgccggccttgactcggcgctgcgcccctccggctacgacactgtgccctaccccatgcgcaacgccgccgagcgccatgacttctttgcggatttgcccgtgcgacgcaatgcggatgcggtgattgtcagctccttcgacattgagccggctgaagtggagcgactgaagcatatgcacgtgccgattgtcggcatcaacattccctccaccgatgggttcgacgcaggcgtgagcattgacgattacgccgccacacgttcggccatcgagcacctgattgcactcggccaccggcatatcgcgttcgtcggcagcgccccgaccgaaaccaacatgcgctacagtgccgaggctcgtttgcagggcgtcattgatgccgctgccgcccatccggggatcgagctaacgcccctgagcattcaacgcggtcttggcgaaagcaacgcggcattgaacgccgtactgaacgcctcccccagcatcaccgccttctgttttgaggatgatgaaatggccgcacccgtgctgtatcgcctgcgtcaatacgggcggcgggtacctcaggacatctccatcatcggcttcgacgattccaccctgtccgccgccgtgggactgaccacactgcatcaggacccgttcgcaatgggcgtggccgccgggcacatggtattggatgccattgcgggcaagtcaatcgaaccggcattcgtacggccggacactccgctaatactgcgcgaaaccaccgcgccgcctgccgcaacagcagcgtccgcgcaggcgtgactacgttaccaccgcaaaacgccgataaatcgacttttgcatgcgtaattcacatgatatcgttgtcatcatcaatacaacggttgggccttcacacagcagttcgagcacaaccggaacaacccaaccacaacgcacccggaacaggaaggaatcggcatgaccgccaacaacctcaatgacgactggtggaagcaggccgtcgtctaccagatctacccgcgcagcttcaaggacgtcaacggcgacggactcggcgacatcgccggcgtcaccgagaagatggattacctgaagaacctcggcgtcgacgcgatctggctctccccgttctacccctcggatctggcggacggcggctacgacgtgatcgactaccgcaacgtcgacccgcgcctaggcaccatggacgacttcgacgcgatggccgaggccgcgcacgaggccggcatcaaagtgatcgtggacatcgtgcccaaccacaccgccgacaagcacgtgttcttccaagaggccctcgccgccgagcccggctccccggcgcgcgaccgctacatcttccgcgacggccgcggcgagcacggcgaactgccgcccaacgactggcaatccttcttcggcggcccggcctgggcgcgcgtggccgacggccagtggtatctgcacctgttcgataaggcgcagccggacgtcaactggaagaatccggacatccacgaggagttcaagaagaccctacgtttctggtccgaccacggcaccgacggcttccgcatcgacgtggcgcacggcctggccaaggatctcgaatccaagccgttggaagagctcggccgcgaatacagcgtggtcggcgtgctgaatcatgacttcagccacccgctgttcgaccgtcgtgaggtgcacgacatctaccgcgagtggcgcaaggtgttcaacgaatacaacccgccgcgctttgccgtggccgaggcgtgggtggtgcctgagcaccagcacctgtacgcttcgatggacgagctgggccagtccttcaacttcgacttcgcgcaggccaactggtatgccgacgagttccgcaaggccatcgccgcgggtcttaaggcggcggccgaaaccggcggctccaccaccacgtgggtcatgaacaatcacgacgtgccgcgcagcccctcccgctacggtctgccgcaggtcaagggcgcgccctaccaccagctgccgcacgactggctgctgcgcaacggcaccacatatcccgaagaccgcgagctcggcacccgccgtgcccgtgccgccgcgctgatggagcttggtctgcccggcgccgcctatatttatcagggcgaggagctgggtctgtttgaggtggccgatattccgtgggatcgactggaggatccgaccgctttccacaccgctcaggccacgatggataagggccgtgacggttgccgcgtgcctctgccttggaccgcttccgacgagcccgctctggccgatttcagccgtccggctccggccgacgatggcaccggcgagaaccatgtgccgctgtgcgccgccggccagttcggcacgggcgcttccttcggcttctcccctgcggttcgcgccgatggcgtgacgccggccgccgacccgcacctgccgcagccgctgtggttcaaggattacgcggtggacgtggagcaggccgacccggactcgatgctcgcgctgtatcgcgccgcactggcgattcgccaggagtcgctgaccgccacgcgcgacaccacggccgagcaggtggacatgggcgacgatgtggtggcgtacacccgcgcggcggttggcgggcgggtgttcacctcaatcaccaacttcggcaatgccccggtcgcgctgcccgatggctccgtggtgctggcgtccggcccgctgacccccgaaggccagctccccaccgacacttctgcgtgggttatcaagtagatcccttggaataagcgaaaggccgccgttccgaatgaatcggagcggcggccttttggtatgcactggggaccaccctcaggcgcttacgcgccagcgtactgcaacacggacagcctgaaggctgcgattgccggctcgctgttcgtgcgcacctcacccgaggggagccaaggaagaatcactgaacctgagcgcgggcgatcttaccggtgaaggaattggcctcgtcggcatccttgacgccatccttgttccaggagaacatggcgcgcagcttcgggccgacggtctcgatgcgctcgttggagtacttctcctgcagctccttgaagtgcggggcgccggcatcctggtcgtcaatgaactccttggcgaaggagccgtcctggatgcgctgcaggtggtattccatgcgcttgcggcagtcctcgttgatgacggtgttgacgtagtcgccgtactgagcggtgtcagagcaggaccaacgagccttgttcagaccgccctcgttcatcaggtcgacgagcatcttgagctcgtggcagacctcgaagtaggcgatttccggctggtagccggcgtcggtcagaacttcgaagcccatctcgacgagcttgttcacgccacccatgagcacgttctgctcgccgaagagatcggtctcggtctcttccttgaaggtggtcttgatggcaccggcgcgcagggcaccgagggccttggcgtaggccagggtcagagcccagccgtcgccacgcggatcctgctcgacggccacgacgaccggcacgccacggccagcggcgtactcacgacgaacgatgtggcccgggcccttcggggcaaccatgaacaccgggtgatcctcagacggcttgatgtagccgtagtgaatgttgaagccatgagcgaacgcaacagcagcacccggcttgatgttgggctcgatgtcgttggcccagatggtgcgctggtactggtcgggggccagaatcatgatcacgtcggcctcggcggaagcctcggccacggacttgacctcgaggccctgctccttggcgaagtcgaccgacttggaggtcggacgcaggccgacgaccacgtcgacaccggaatcgcgaaggttcagcgcgtgggcgtggccctgggagccgtagccgatgattgcgaccttcttgccttcgagaacagagagatcaccgtcgttctcataccagatctgtgctgccattattggcactccttttcagtagtgggttgtggcgccgctgggcgccgggggtatctacggtgtgcagataagtcctgttttgcgaggattgtgtccttcaaaccgagttcaatcctaccgagaacgccgtcgcagccccgctggagtccacaacgtgagctaggtcactattggagtatggacagccgtgtgcagagaacgattctcgataacaactctgcacccttttgaacagaatcgcacaatcccacatatggggaaaggctgagatatcaacgaccttgcatattcggtgttcgtttgcctgcaagaaatcagcgcatagttgttattgagaatgattcgctgcgcgcaacaacacaaaaccgccgctcccgtatgggcgggaacggcggtttgctagcttaaatccccttcaggggcgacaatcactgaacctgggtacgagcaatcttgccattgaaggactcggtctcatccttgtccttggcctcggcgttattccaggagaacatggcgcgcagcttcgggccaacggtctcgaggtgcgggtgagagtactcttcctgcagcttcttgaacttcggagcgccggcagcctggtcatccatgaactccttggcaaaggagccatcctgaatgcgcttgagctggtactgcatgcgcttcttggtctcctcggtgatgacggtggaggtgtagtcgccgtactgagcggtgtcggagcaggaccaacgagccttgttcagaccaccctcgttagcgaggtcgacgagcatcttcagctcgtggaacacctcgaagtaggcgatttccggctggtagccagcctcggtcagcacgtcgaagccgaggtcgcacaggtggttgatgccgcccatgaggacgtcctgctcaccgaacagatcggtctcggtctcctcggtgaaggtggtcttgatggcgcctgcacgcagagcgcccagagccttggcgtaagccaggcacagcggccaggtcttgccgtccgggtcctgctcaacagcaacgacgaccgggacaccacggccagcggcgtactcacgacgaacgatgtggcccgggcccttcggggcaaccatgaacaccgggtgatcctcagacggcttgatgtagccgtagtggatgttgaaaccgtgggcgaaggccaaggcagcgcccggcttcagattcggctcaatgtccttcttgtagacggctgcctggtactggtcaggcagaagaatcatcacaacgtcagcctcggcaacggcctcgccaaccggcttgacctcaaggccctgctccttggcgaactccacggacttggaggtcggacgcaggccgacgaccacgtcgacaccggagtcacgcaggttcagcgcgtgggcgtgaccctgagaaccgtagcccaggatggccaccttcttgccatcgaacacggacagatcggcgtccttctcgtaccagatagttgctgccatttttggcgctccttttatttatttgtttatttatggggttgaaattttcttgcgttctgcggggtttcgctgagcgatattctgttgtggctttccttgtgggcttttccgatatgcaggtttagtcccgtcgcatcggaaaagccctgtaggggttcacttagtggaattaggggttttcacgttgtgaacatcgtcacttggtaaagtcaacgtccttagtctccttgcaggtgagcacggagacgaggcagcacacggccatcacggcaaggtagaggcccacggagtggacgccccagtgggagctcagccaagtggcgatggtcggcacgaaagccgcgccgacgatggcggccaggttgtagccgatgccggagccggagtaacgcacgttggcgtcgaacagctcaggcaggaaggcgccgatcgggccgaaggcgatgcccatcagggcaaagccgacgcacaggaacaccatgttggcgaagaagttcttctggccgaccagaccaccgtccagcaggaacgggaagagtacggcgaacaccacaagtgcgcaggaggagaaggtcagcacgcgacggcggccgatcttgtccgcgtacaggcaggacagcacgatgaacagggcgaacacgcagatggagatcatgagcatgagcaggtattcctggttggtgaagccaaggttgccgccgccttcgccctgctccttggtgccccaagcgagggaccaggtggcgagcgtgtagaacagcgtgtaggtcacagccacaaggaaggtggcctgcagcacctgacgccaagacttgcggaagacctcggtcagcggggacttgacaaccttcttctgctcctgagccatacggaagatcggggtctcctccatgtgaacgcggaccacgagaccgacgatcaccaggatggcggacagcaggaacggcacacgccagccccaagccagcatcgcgtcctgattgttgaaggattcgagcacgaagtaggtgccgttggacaggaagaagccgatcggggcgccgagctccgggaaggagccgtacagtgcgcgcttgtcttcaggcgcgttctcggtggcgaccagtgccgcgccggaccattcgccgcccaggccgatgccctggatgaaacgcagcaggcagaggatggcgactgcaccaacgccgacctgatcgtaggtgggcaggcagccaatcaggaaggtgccgacacccatggtcatcaggctgacgaccagcgtggtcttgcggcccatgcgatcgccgaagtggccgaagatcagcgagcccagcgggcgggcgatgaaggcgacggcgaaggtcagcaagctcatcagcagtgcgacggtggggttgtccttcgcggagaagaagatgtgcgggaagtagtttgccgcggcggtgccgtaggcgtagaagtcatagaattcgatggcggtaccgaccatcgacgcggcgatcacggtcttgaccgaatcgcgtaccaaggtagcggctttacctgccgcctgccctaagccagtctcttcgactgctgcagtcattgttactcctgttttgctctcgttcactctcatcggcgggcgattatttcgccccacagggaggttgttgttctgtcgctgtgttgttgccgtgtactgtccgctaccgtttccgtctgcgggattctgccgtaagccttgtgagcgcaacaaaaaaagccccgcatcatgcagggccgtgccgattgtgtcagcttgattggccctgccttcgttgacggggcttcaagcatcagtgccgaattagtccgccagcgaagacgggctaataattcgtgcggatacaaacgcagaagcattgaatccagtcatcgcgtggcctcctttcggtatttcctcaggccgttcgacctgaactggaatgtaaacataggtttgtatgtcttgccaatccagcaagggttcacattgtggacattgtgacgtaggagtcatgtgagatgggtgactgtgggcggccgtgactcggttcccctcagtcgcctacgccgccagctcggccgcaattacagacgggctaccgcccgcagtctgcctgctcgcctcccggctcgccttcgcctacaaacagtccaccggactgtttgcttcacagctcagcctcagagaggggagccaagataggagtcaccgggtggtttcgccggggatgagggctacggggatgacttcttcgggagtgggttgggtgtcaacgtccgaagcgctatcgttcttggacggagaggcggggccaccgtcggcggcgatctgtgagtccatgcggacggcgagcgcggcggcgatggccgggaagtcctgtcgaatcgcggtcaggcgtttgccggcggtttcggccatgagagtgccgtcataggcgatgacttgcagatcagcaggcacctcgataccccgtcgtgaggcttcctgcaatgccacggatgccaccacatcggagccgacgatggcgtcgacatcaggatactgttcgaaaatggcgcatgcggtggcttcgtgggcggcgatgtcggccacggtgccggcttcgacataatcgcaggcaatgccggcctcagccagcagacgctcgacggtgagatggtagcgaatcgtggggaaagtggtgccttccgcgaactgggaacgcgggccaccaacgagcaccacgtggcgcgcgccggaatcgatgagctggcgcgcaatcagacggcctccctgttcatgatcagaccggacgaccggcacaccctcaccgagcgtgcggtcgaaagcgacaattggccgatggatggaggtccagtagtcggccggatgctcggtgtgggccgccatgatgatgccgtccatcatgtgccgctggagcatgtcgatgtactcgctctcgcccttgtctgtatcggcggtggagcagagcagggttttgaggtcgcgcgcggcgaactcgcgctgcagatgcgcggtgagtgtggagaagaacgggtgggcgatggtcggcatgatcacgccgatggtgttggtgcggtttcggtagaggttgcgggccagctcgttgggaatgtagttgagctggcgcatcgcggactcgactttggcacgcatatcggccgagacgtagccggtgttgttgaccaccaacgaaacggtgcttaaggacacccctgccgctttggctacgtcgcgcatgccgaccatggttttgctcccctgcgagtactggactggatcactgctgaccagtgtactcgaaccggtttattattcggcagatttggtggtgagggtgacgattccggccagcagcaccatgacgatggcggacgggaagagcaggtaatagccgaagctatgctcgaaggcgttcaccagtagcgcgccgatgatggcggcgagcgccagaccggccgagttggcgagcgcataaatgccgaggtcgtggccggctcggcgcgggtcgggcaaagagtccatcaccagttcaagtccgagcgaatcatagacgccaaaggcgaatccggaaatcaacgcaaacagcagcatgccgttttcacgggcagtgccggtggaccagacgccaaggccccatgcgagcgccaaaccagcggcatacagcaggcaggcaccggccaccacacgggccacgggaatgttcttttcctcgattcgctcggaaatcggcccggcggcccaggaggcgagcgcggcaccgatcaatgtggccacagccataccggcaatgaggaatccggccggaatggtcagcggcgcggacgtaagtaccacggccttgccataaacccagaaacgtacgagataccacagaaacacaccggtcagcccaacaccggccatcatgcacgtacgggcggcgaacacccgggagaactcgggagcgtgggccggcgggcgcaattggtcaagtacctgactgcggtcaaaaagctggttcggctgctcagcgctagaaggctccttgggcagaatcaatacggtggcaataccggacactgcaaatagcacggcggtgtaactaaacggcgcaaacgaattgaacatcacaccaagcgcacccatgcacacgccaagcgcttggccgagcatcacaccgatgccatgccagcgttcgatgcgagggcggaacttgtcgggcacccgttcgctgatggcgctggtcaacggcacggaaagcatcgcataggcgaactgtaggaacacccagaaaatacaaagcacaatgatgccgatattctgccccagaatcagcgtgatcagcgcgcacagcagacctccgccaaccatccacggggtacgacggcccaatggcgtgcgtgtgcggtcggacaacactgaaatcagcggcatcgcaaacatggaggccactacgccgacaatcaccaacacggccaggggcatcgccaattcggtggcgacgggcaacgggcggccagtggccggattgatggcgatatgaccggcaacagcagtgtcatagccgaacgtacgcgcaatcgcgttgggcatggcaatggtgttcaacgccacccaaggtgcgccgaccagaattgaagcagcgaagaaaccccagttgagtcgggagacctgacctgcggtagggcgttggccattgacggcgaccatgggatcgcgcatgtcgaggtaggcggacgacatatccggcgcgggagtgtccacactggcggctgcagcagcggctgccgaagaaccggcggaagccaatcgcacagcctgggcctcaggctggtccgcagaggcttcgggcgggcggcggcgattcttgatggccagtctggccacggcggctttgtcttcgggacttaggaccttgtccaaatccgggcgatcatcaatacccggacgcacatacggttccaacatgatgctgctctttctctgttctgctgctcgtctcgtcgattccggcgggatgcttgggccgcgcccgcaggagcatgaccttcaaccccgcatacgcaaaaccgcccgggcgcactggcttcagtgcactgcgggcggtttgctctccatgaacccagcttacgccgggcgcactacttggagcgcgcacagcggagtgacgtttatgggccaacggttagtcgatatcggcaatcggcgggttggcgagcagatcgtgggtttcgtggtcgccggcggcatcgctccaggcaaggctggcgaccggggtggcgttgtctgtgccgaggccgcgtccgggctcgaaggtgagggcggccgtggacgcgccgtcggcggcggtccagcggaaggtgatggacgtgtcgccatcgacctcgtagctgaactcgccatcgaatgcagacagctcgttgcggaacttggccagggcgttcagggccttgaccaccgggcgttcgaggttttcatcgatttcggcggtggagtagtagtggcggttgatgtcgcggccgttgttggtgcggcgcagcagttccatgtcgttgcggccggcgagcgcgcccacgtagtagacctgcggcacgcccggcaggaagaactgcacggcgcgggcggccaagtagtgctggtcgttgcagccgagggccgagtagtacgtggagttgacctggtagaggtcgaggttggacgcggcggcaccggtggcggcctgggattcgccgtgggtgttggcatggatggtgttgaccaggttgtcgacgtcctcgtcgggcacgaggcccttgagggagcggtcgagctggtcggagccgatgtcgatcacgccgatgccatcgtgcgtatcgagcacggtgacggcgttgttcgggcggatctcggtccagtgggccacgggttcgacgtgaccggtgaacagcgagtgcagaagcagcggcggcagggcgaaatcgtagacgcggtccaccttggaggcgatctccacctgcttcttgtaatagctgtgaacctcgatgaggatttcaaggccgcgcttgacgccctcctcacgcagacgggagatcagcttgaacgtcttcggagtcatgaagcagctcgtgccagcttccttagcgccgtagccgacggcgtcgaggcggatgtagctgacgtgagaggcggccatctggtcgaaaatcgacatgaggtattcccaacccttgtcggaatcggtgtcaatatcaacctgctgcggggtgaagctcacccagaccaagcgcgtcttgccggcgaacttgtagtgggtgaacggcaggcccggacgcggacggtagatgccggccaggtcctcttcggtggcgccgttcgggaagacggagctcatggtcagaaacatcgggtaatactcggattcctcacctttttcaagcacgtcttggaactgcttggattcccagctcatgtggttgacgatggcgtcgaccatgatgttgtgggtcttggagagttcggcgacgtcgtcccagctgccgagacgttcgtcgactttggtatggtcgatcgggtcgaagcctgcatccgcaccatcgaacggagtgaagaacggcaggatatgcacgccgtcatacacgccgtcgaagcgggtgcgcaggatgtcggtcatcgagctaagagtgccatcgccgagacgatcggcgtatgtgatgagttgcactttgtttttcatgggacctcccttggctcatgggcgcgggtgcaatttgcgtgcgcatctgcctgtttgttgtttacgtatttgcatactcacgtatgtatcgaaccggttcgatattacctcgaaagggacgtcaatgtccagtcgcgcagtgaaatgcgcgtgtcgaaccgattagatgcggtgttctatgcagcttagcctgtccgactccaatgtgtccgattgataaggggctgcggacattttcttggagataatcacgcagccattccttggctttgacggtattgtaccgggctcatccaaccaagcgactgtttgatgcgctcgtggttgtaccagcgtatgtactcatcgaccaaggcgagcacctcgttgcgggtgtgttcctcccacttctcggggtagaccgcctcggtcttcatcctgccgaagaatccctccgcggccgcgttgtccggcgaacagcccttcgcgctcatcgaacgcgtcaggttgttgtccatgcagatgcggatccattccggccaccggtagtggcagccgcggtcggaattaaaccgacatcggtttaactccgattaagccgggtttgttgttaagccggggaacggttcggggtcttggtggctggccgtgtcccatgtggtttcccggcttaacgttccgggttatttgagggtgtgtagttgtcggagtcgttgctcgctgagccatgtctccttggaggggtcggggccggggttggccgcatcgacggctttgcgcatcatgtcgagggtcgcgaacgcgtagaacgcgctggttgtgctcatgctttcgtggccgagcagttgcatgatgagcggtagcggcacgccctgttggtagaggtccatggcgcgggtccggcggatcaggtggcagtggacgcgttcgggcatggacgggcacgtcccgcggcgtgctctggccgccgcggttttgaggatctcgtcgatccggtccacggagagcggctggatggcgccgttcctcgtcgagtggaacaacggcctgtcgccgtcgcgcatggacggtccgggatggaattcctcgaggtaggcggccaggtgggttcgtgtcctttctcccaggggcacgacccggctcttgccgcgtttgccggtgagcgtgaccctggccggcttatccatacccacgtccgcgatggtcagtgcggcgagttcgccgatcctggcggcggtgtcgtacatgaggatcaggagcatgcggttcctgcgcgatttggcgtcgccggtgccccatgcggtcagcaacgctttggtgtgctcctccccgaggtggtcgacgggtttgcgcgcgggtggtttgacacgtatgccggccgcgtcgttgcccagcgcggtcaatgccgggtgttcgaggcccgcgtggtcgaggaacacgcgcatcgtcgtcatcctcagcatgatggtgcggtccgagtacccgcgctcggtccgcatccattcgacccaccggcccaggcgcgcccggtcgaaatgcccgaaaccgatgtggctgcgctgcgtgccttccgtggtttcgagccatcggacgtaggattccaggccgatgcggtacgcctcgacggtcttcggcgagctgccccgcaccttgggcagccagtggtgcagccagtcgcgcgcgactcgccagaagtccggttcaccggagctggcggccgttttccttgccttgctcatggttcctccgtttccgggaccacgcgttcggcgtcggcgacgaggtccgcgtatccgtccatgaaatcggggctggcgtgcacgtagtagagggtgctgtcgatgccggcgtgtcccatgtaggccgccagatagggcagcatcgccatcacgtccacgccgtcgcgagtccaccgctcgatgttcgcgaacgcgaaccggtgccggaaatcatagggcctgggccgtttgccggcttgtggccactcgagcccggcacgcgtccagacgcggcggaacaccacgccgggcatgcccggggagaccggattgccggtggaggcgacgaagaacgcgggacggtcgtctccgaagcgttcgcgggaccgttggtcgcattccagcagttcggcggcgacctcgtcgcccacgggcagcctgcggctgcgaccggccttggaatcgaccacgtcgatggaacgggccttgtggtcgacgtgcccgacggcgagtctcctgacctctcgggtgcgcagcccgcagcaggccatgagcatgaagaacgcgcgagactgccacgcccacggcgacggagactccaacgttcccgcggcccgcaggaacagggcggcctcgcggtccgtcagcaggtacggcgtcggacgcggggatccggccttccactggtcggagagcacgtacgcgtcgggatcgtgggccagtcgcatccacctgccgaagtccctgatgcacgagaaccacgagcggcaacccccgggattcgcgtcgatcctatgggcgatccatcgctccacgacgccccgctccagacgcacggccccgtgttcgaggcaatgccggtcgaacgagcgcaggaccggttcatgaaaccaagcgagaagatcatcgaactgctcgacgccgcgtgataacctcaacaaccgacaacgtgaccatggaaggccgctcaaaccccaggtgttgcaaccaccactagaatctgccgctgccacacgctggcagaccaacaccactgtgtgcattctctgcgtcggcggcagtccaaaacttggcccagcaacgacgcttgctgtgcccagcgtcggcagagggccaagaattggacgcatacgacacagaacgcaccctcagcgtcggcagaactccaagatctgtaccgctgacgacggtaagccctccacagcgtcgtcagagatacaaaatctgtcccaacaccgacgcctgccacccccagcgtcgccggagtcccaagtctcggcccagcaacgacgcctgcgatccccacacataagaaaccgcacctccgatcatcgaatctgaattacttcagtccaacaaccggggtgcggttcactgaggagagttccgtcagtatagctatatcagtcgtcgccgagcgtaacgtgcacaccgccgaccagagagctgaccacgttgtagatcagtgccgcaatggtggccagcagagtgaagatcaccacttcgacaatcgagaagatggtgacgccggagaccacggtggtaagggacaacacgttcttgagatcgaaaccgcctgcatcaagaccggtggaagacacaatctgcgtaatctggctgaatacaccgaccacatcaagcagcacccatacgatcgcggaggcaacgacctgaataatcgccacggcgatggacagcatgaacgtcaccttggccacggaccaagcatccacgcgggtcagcgacaagctcatgcggcgagccctgggggcgctacggcgaggtgccggacgcacgggagtggcggcacctgaagaaggcaacgcggattcttccggatcgctggacacggagcgtgccacgcggggagcgtgctcagtaccgatcagcggctcgacatgctcgttctgcgtattgccgactgccggcggtatgatccggggctcgttgtcttcgagattctcgctcatcgtttctccttaacaggcttggcggtagcctctgctgtatgcgaggctaccagcttttcaggacgctgctcacgcctcgtccgcgttgttcacattctcgccggattgtgcggtctcggcggtgccgttcgccgcggcatcgccgccatcctcgggctcgtccttctcctcgttacgggcgatggagagaatcgtgtcgcccttgtcgggcttggcaaaggtcacgccctgggtgttgcgcccggtgcgcttgacttcgtccacgttggagcgaatcaccttgccggacttcatgatggccataacctgatcgtcttcggacaccacgagcgcgccgaccagagcaccacggccctcgaccagttgcacggccttgatacccaggccattgcggccctgcagacggtattcgctgatggcggtgcgcttggcgaagccctcgttggtgaccacgaacaggtccttgtcggagtcgccagggaccacatccatggccagcaggctgtcgtcgttacggaacttcatgccctgcacgccggcggtctggcggcccatcgggcgcagctgctcgtcgtcggcctggaacttgaggctcatgccgagtttggagaccaggatgatgtcgtcctcggcgttgcacagcgcggcgccgatgagctcgtcggcgttctcgccgttctcgtcggccatgaggcgcacggcgatcaggccgccctggcgcggggaatcgtactcggccagcggggtcttcttgaccttgccggaacgggtggcgagcaccagatacttggacacctcgtagttcgggatggacagcacggtctggatggactcatcaggcgcgaactgcagcaggttggccacgtgctggcccttggagtcgcgcgagccctcgggcagctcgtaggccttgatgcggtacacgcggcccttgttcgtgaagaacagcagccagttgtgcgtggaggtcaggaagaagtgatccaccacgtcgtcctcgcgcagcttggtgcccttgatgcccttgccgccgcggtgctgggagcggtattcgtcggccttggtgcgcttaatgaagccggagtgggtcacggtgaccaccacgttctcttcggcgatcaggtcttcgacgttcatctcgccggagaacggcaggatcttggtgcggcggtcgtcgccgtacttggcgacgatctcgtcgagctcgtcgccgatgatcttgcgctggcgttccggcttggcgaggatgtcgatgtagtcggcgatcttacgctgcaattcctcatgctcggccacgatcttgtcgcggttcatgcgggtcagcgtgcgcagctgcatggccaggatggcgtccgcctgcacctggtcgatgtccagcagccccataaggcccgtacgtgcggtgtcggtgtcttcggaggcacggatgagggcgatgacctcgtccagcatgtcgagggccttcagatagccctgcaggatgtggtcgcgctcttcggcctcgcgcttcaggtacgcggtgcggcgggcgatcacgtcgagctggtggttcacccaatggcggatgaaggcgtccaggctcagcgtgcgcggcacgccgtcgaccagcgccagcatgttggcgccgaaggtctgctgcagctgggagtgcttgtacaggttgttcaggaccaccttcggcacggcgtcgcgcttgagcacgagcacgaggcgctggccggtacggccggaggtctcgtcgcgcatgtcggcgatgccctggatcttgccgtcgcgcacggcctcacgaatggagacgacgaggcggtccgggttgacctggtagggcagttcggtgaccaccaggcacatacggccgttgatctcctcagtgttgaccacggcacgcatggtgatcaggccacggccggtgcggtaggcctgttcgatgcccttgtggccgaggatggtggcgccggtggggaagtccggtcccttgatgatgcggatcaggttttccagcagttcctcgcggctggcgtccgggtggtcgagcgcccagtggacgccgtccgccacctcgcgcatgttgtgcggcgggatgttggtggccatgccgacggcgatgccggcggagccgttgacgagcaggttcgggaagcgggccggcagcacggtcggctcctgggtcttgccgtcgtagttgggcacgaagtcgacggtgtccttgtcgatgtcgcgcaccatttccatggccagcggggccatacggcattcggtgtaacgcatggcggcggccgggtcgtcgccgggggagccgaagttgccctggccgtcgacgagcatgttgcgcatcgaccaggactgggccatacgcaccaaagtgtcgtagatggcggagtcgccgtgcgggtggtacttacccatcacgtcgccgaccacgcgggagcacttgttgtagccgcgatcggggcggtagccgccgtcgtacatcgcgtagatcacgcggcgatgcacgggcttcataccgtcgcgcacgtccggcagggcgcgctcgacgatcacggagagggcatacgccagataggactcgcgcatctcctgctgcaggtccttgcgctggatgcgttcgccggtgtccatcaggccgtagtcggtagtgtccgcctcctgcgggctcaacggctccatcgagccgtccggcgtgaactgctcgtcgccggtgttgttttcatctgccactgttgttcctttagttgtctaagtccgttgtgtacctccctctgacgagggaggttggaggattccgttacgcatcgatccaacgcacgttcttggcgttgcgctggatgaagaggcggcggggttcgacctcatcgcccatcagcatcgagaaggtctcgtcggccgcggcggcgtcctcgatgtgcacctgcttcagaatgcggtgctcggggtccatggtggtctcccatagctcctggtagctcatctcgcccagacccttgtagcgctggatgccttcgcccttgggcagctggcgtccgttggccttgccttcggcgagcacgcggtcgcgctcggcgtcggtgtacacgaagtcgtgcgggcccttggtccacttcaggcggtacagcggcggcatggccacgtacacgtagccggcggtgatcatcgggcgcatgtagcggaagaacagcgtcaggttcagggtggcgatatgcgcaccatccacatcggcatcggccatgatgatgaccttgtggtagcggaccttggagatgtcgaagtcctcgccgtagccgccgccgaccgcggtgatcagcgattcgatggtgtcggacttcatcatgcggtccaggctggcgcgctcggtgttgaggatcttgcctcgcagcggcaggatggcctgcgtgatcgggttgcggccctggatggcggagccgcctgcggaatcaccctccacgatgaacagctcgcactcttccgggttgttcgactgacagtccttgagcttgtcgggcatgccggcggactcgaagatggacttgcggcgggtgttctcgcgggccttcttggcggccagacgggcgcgggaggcctcaatggccttctggatgatgttcttggcctcggccgggtgggcgtcgaaccagtcgccgagcttgtcggtcatcacgcgctgcacgaaggtcttggcttcggagttgccgagcttggtcttggtctggccttcgaactgcgggttggtgagcttgacggagatcacggcggtcaggccttcacgcacgtcgtcgccggagaggttctcgtccttgtccttgaggatgcccttgtctcgcgcgtaacggttgaccagcgaagtcagcgcggcgcggaagccctcctcgtgggtaccgccctcggtggtggagatcgtgttcgcgaaggtgtgcacggcctcggagtaggcagtggtccactgcatggcgagttcggcggagatgccgagcttcaggtcttcggcctcgaagctgatgacgtcctcttccaccggcgtggccttgcgcaccttgaccagatagtcgacgtagtccttgatgccgttgaggtactggtaggtgacggtctggtgctttgcgccgggctcgtccgcggcgtcgccggccacctcgtcgccggcctggtcgttctcacgctcgtcagtcaggctgatcttgaggcccttgttcaggaaggccatctgctggaagcgggaacgcagcgtctcgaagtcgtagatggtggtctcgaaaatcttcgggtcggcccagaaagtcacagacgtaccggtggactcgccttcggtcatcggctcgccctgcttcaagggcgcggtggggtgctggtcgatgtacgtctgggtccagtggaagccctgacggcgcacttcgatgtccacgcgggtggagagtgcgttgaccacggagatgcccacgccgtgcagaccgccggacactgcataaccgccgccgccgaacttgccgccggcgtgcagcttggtcatcacggtctccacaccagagacgccctcgccgggcacctcatcgaccgggatacctcgaccatcgtccaccacacggatgccgttgtccggcagaatggtgatctcgatatggctggcgtatccggccagcgcctcgtcgaccgagttgtcgacgatctcatagaccaggtggtgcaaaccgcgcgggccggtggaaccgatgtacataccggggcggatacgcacggcctcaagtccttcgagcaccctcagatcggaggcctcataatgctcgggggccatggattcgtcaagttcgccttcggtcaattccgcattgttgatgcgttccgcagccgccttcagctgctcctctttgctggtttcgtctgccaacaggcttccttccgtgactacagggtcaacctccgtcatgaaggtcattcacggaggtgatatggcttacgaggcccgtaaagggctcttctagccatttgaccatactgcatgtgattttactcgtctaacccgacgagcgccatagcgaggcttctgcgaatttgtttggtatcttggctaccgccgccgagcccatttgcgtgtgtatccggcggccgggccggtcacgcgaatctcggtgatggtcaatcctttgagattgcgacggatggtatcggtgagttgggggataaggtaggtcagctgcgtggcccagaccgtggattcggcgcggatggtcagtacgccgtcagtgaaatcggcgactgccgaatggctggcgatggcctgacccaccacttggtcccaatggttgcgcaattgcgcaagcttcatattcgccgtccagacgccgttgccggcgatggtggtcatcacgctgcccagttcagccggatcgcgccccggtttgccgaagttttcgatggcctcttcacggcggcgtctgtagtccttcaaggtcgccccgcgacgggagagccgctcgaatatttcggccggcagtttggtctcgtccaggttgagttggcgggcgatcggcgggttcatgacactttccgttctacggacgcgctgtccaccgcggttttttcgtcatacccacccaaactctcattttcccgcgaattggacaaattgcccagagttggcaatatcacggaagctggttcgtccagtgcggccacgtcgatgcgatgggccgattcatagtcgggcacatcgccttcagcggccacggtaatcagcacctgatcctgttttctggcgaaatcaagaatctgcgtgcgccggctgtcgtcaagctgggcgaacacatcatcgagaatcacaatcggctgcaatcccaaccggtcacgcactatttcgaacaatgccattttcaaggccaacgccatcgtccacatctcgccgttcgaagcgaactcgcgggcgggaataccgcccaactcaaggttcatgtcatcgcgctgcggaccgataaggttcacgccgcgagccacttcaccggggtagatgcgttggaaatgctcgctaatctgcggatgcggatcgtcgaacatcagcacttcgtcgaatgaaggcgcataagtgagcgtcacctgctcgccggcaccggccaagtcggcgtaaatcgcggcaaatggctcggcaagcagaccgatcacatgagcgcgcatacgggtcaacgccacaccggcttcgatgaactggccggtccagatttccaaaccgctcagaaccgcatccatcggctggccattgttgacattggcattcaattgcttcaacaatgtggcacgctgtttggcgatgcgcgtgaactgttgcaacgtctgcatgtatccgggctcgagcagagccgcagcctgattcatcatggtgcggcgtgctcccggatcgccggacaccaaccgctgatcttcgggagtgaaggaaacgctgggaatcttgccgatgatatcgcgcagatacagcgacgaccccgagttgatgcgggctcggttggcaccacgcgcatgaattgacgcttcatacgtagtggtttgaccggcatcatcagcgacgttcgcgcggatggtggccgtggtctgcccgcgttcgatcagcggcaacgtgctggacgtgcgatggctcgatccggtggacagcacttcgacggcttccaccagattggttttgcccagaccgttcttgccgaacaggatattcacgcctggtacgaaatcgaccactacctgactccatgagcggtagtggtcgagtgcgagacgggagatgtgcattagcgaatcgttggaaattcagggatttcagttgttaaagcgcatcggcacgagcaggtatcggtagtccatggactcgtcggaatcagcttcctgctggccattgaactcgaccggcttgaccggggtcgtcattttgatgcgcacgaatggttcggttacggcggacagaccctccttcaggtaggacgggttgaatgccacggtgatgtcgtcgccatccatgtcgatgtccagtgtttcgttggcctgagcctcgtcgaccgatccggcggacagcgccacttcctgaccggtgaaggtcatgcgaatcggagcattgcgttcggcgaccaaagccacacggctgatggcgtcgagcaaatcctgcttgttgactacggcctgaatcggatattcgtcggcgaacaggcggtcgaccgccgggaattcaccgtcgatgagctgggaggtggagacgcggccggcgttttcgaagccgagcagcgtcgggctatcggcatcgaaatcaaggcggatgttctggtgctcgtcaagagcacgggccacatccttgagcagggagccgcgaaccagcgtggtggtgtcgacgtccgggttctgcggagtccaagtgaaggtggcgcgggccaaacggaagcgatcggtggaggtcatgacgaccttgtcgccttggaattgcatgcgaacgccggtcagtaccgggcggttttcttcgcgggagacggcaacgcacgcctggttcacggcctgaacgaaagtcggggcatcgacttggccgagcatggccggtaccacgggcagatccgggtactcggtgtcgggcatgagctgcaaggtgaacttcgacttgccggacgtgatggtcagcgtggagccgtcggtgaccaggtacgttttctccgaacgcagcgatttggtgatatcggccagcagcttgccctgaaccagtacggaaccggcttcgtcaacgccggcttcgatgtggtggcgagcggaaatctcgtagttgaaggcggagaattgcagcgttccgtcaatggcttccagcttgacgccagcgagaatcgggttggagggacgtgcgtcgatgactcgggaggtccaggctacggcgtcggccagggctgcggtatcgatttcgactttcatgtgtgattgttcccttcgtcggattggctgaggaatattctagccgttaggtggcgaacttacgtacgctggatgaccggctgttactatggcgatgatgcttttcacgtaactgagtaagtaatcgccataataaggccggtggatagtgtggataagtagggctgagccctacaactgcaacggttcataagtccctgaaaattgtggacaaattctgcatggcttgtggataagtgggcgagttttccacagccagttcgtcgaatttgagttttccacatcgaggtcgcggttatgcacgagttttccacaacaaaatagtgggtaatccacgagttatccgccgagtttacccacatctgtgcacaactatgtggataacttttttggttttcgcactttcgcacggcgtgttgaagactgtttttcgtcgaggagaatcgattctggagaccgttttcggcacttttccgtctcgctcgcccaaacccgcaaaatcggtcctcagaatcgattctctcgtttcatggtttttttgcgtgttccccttcgaaactcccctcagtcgtctgcgccgacagatcccctcacaaaggggagccatgaggaatctaatgtctcgaatccgttgcctcgacgtatccaccagaatccgcctgagcaaccaaaaacggcacttttcggaaagtcagtccaaaaagtgccgtttttcgtctctcagaagcgttgtgtcagttggtgttgctttgcttgaggcgaaccgtgagctccataacgtagttatagatctcctgtttttgctgcattcggtcactgattcgagtgcaggcatgcattactgtggtgtgatcgcgtccgccaaagacctggccaatatccatcaggctcatactggtcatttcgcgagccagatacatggcgatctgacgaggaacagccacgtttttggttcgtgatttaccgacaagatcctcaaacgtcaggtggaagtacttcgccacctgactgatgatgtccgtgggcttgatttccacatcggtggtgaagaagtcctgcaacgtctgctcggccaaggcgcgggtcaccggctgattactcagcgaggccacggccgtaacacgggttagcgcgccttcgagttcacgaatgttctcggtgaagcgttcggcgatgaggtccaacacatcgctggggattttcgagccgttcatcgaggcgatcatgcgaagaatggcgattcgggtctccagatccggcggcttgacgtctacggtcaggccggattcgaagcgcgagatgagtcgagcctcgaaacccttcaaattcttgggcgctacatcggaagcaatgacaatacgcttatttgcctgatgcagtgcattgaacgtatggaagaactgatccaaggtggcttccttgccgccgaggaactggatatcgtcaataagcaacacatcaacctgtcggtatcgacggttgaattcagcaatctgcccctggctttggttcgggttttgcagcgcgtcaatgaattcgttcgtgaattcctcagacgtgacgtatcgaaccttcagcccgggatccttgaccagtgcatagttgccgatggcgttcagcaagtgggttttgcccaggcccgatccgccatagatacacaacgggttgaaatcctgcccggaaccttcggccacggccagtgcgaccgtacgggcaaaacggttggaatcgccgggcacgaaggaatcaaacgtgaagttcttattgagatgagtctcgggatcgcgattcatcttctgctgaccgaccgggaactgcggctcggtggcgggcatcggttcccgcggtgcggctgccggctttgcaccataggattctttaccgaattcggcgacagtcggagaaatttccgaaggatatggctgcgccggctttgcctccgaaagcggttcgggctcggttttcggcacgaccttgaacgcgggaaacatattttcgccggttaccgtacgcaatgcctgaagcagggaatcgttcaaatcaccctgaatggcttgaagcgtgtcgttgttgtccacacacagcacgatggtcgaaccgaagacgccttcaggaacaacgccttccaaccagcctttttctcgtgggctgagcgaagcgctgtgtttgagcaccgtcagcgtgtctgaccagatgtgggcggcctcgattacggggtcgccggaagcgttaaccatggtggccccttctgtcgctgtggcgaaatacgtacaacagataatatttactctggtttagacaagttatccaccgtgtcgcgtgttgaaataactggattgtgaataacaaacatgtaatttgtggataacttttggccgtgaatggttggtattccgccgattataagagatttggggcgtgtctcgcaacgtgtcgaaatgtgaaaatactccgtccgttttgacttgagggtaggggtgagagtactttggtatagcttgactcacgtgagggcagcgcgaagcgttgccgaatagacctaggagcaatggattatgaagaggacgttccagccgaacaaccgtcgtcgccacatgaagcacggcttccgcctgcgcatgcgcacccgttctggccgtgcggtgattaaccgtcgccgtgccaagggccgcaagtccctctccgcctgatcattccgatcagtgccacaggcatagtcgaggtggagaggcttcaaagccatcgtgatttcgtcaccgtgctgaaacgccggcgcaaagcaggtggcaaggatatcgtcgtacactatttggtgcccgacgaccatcatgatgatgacgaccggacggtgcatcgccgtttgggattagctgtctccaaatcggtaggacatgcggtcacccgtaatacggtgaagcgtaggtttcgtgtattggccagagcccatgaggatctgctgcccgcgcattgcgatatcgttttgcgcgccaagcccagtgcagcgaccgcatcgttcgcttcgctagatcagcagatcgcgaaggcttttgccacggtggcgcataaggtggctgaggcatgacagcttctttcaaggcggtgatgattggtggggtgcgctggtatcaacagcacatctcggcaaacacaccgccttgttgcaagtattatccaacgtgctcgaattatgccattgaggcattggaacggtatggcgcgttcaaagggggagtgctcgccgtgctgagattactgcgttgccggccgtggagtcgtgggggaatcgacgatgttccacaacggtattccgttttttacaggttttcgtggtcgaaggctcatgaagagcctcgactgacaccattggccacaacccaaagagaggcccaacgatgaactcaaatgaatttctgcttgatagcgggttttggggatttctatataaaatcctgactcccgttgagtggttgcagacctggatcatgaagatcgtgcatgacttcttcgtgatgctgggcgtgagcccgattggtgtctcatgggtgcttgccattatcatcctggtgctggtggtgcaggcttgtatcttcccgctgttctacaagcagatgaagtcgatgcgcaagatgcaggcattggcgccgaagatgcagcgtattcagaacaagtacaaaggtaagacggatcaggcttccagggaggccatgagccgtgaaaccatgaaactgtatcaagacaatgacgtcaatccggctggctcctgcttgcctatgctcattcagggcccggtgttcatgtccatgttctacacgctgtccgccattccatacattgccaacggtaaacgcgatgcgttgggcgcgttcgacgtagcaaccgccaagcaattcacccaaaccgatgtgttcggcattgtcagcgtgaccgataacttcaccagtgctgccgctagtggcaaggcggtcatcggtatcttcgtgttcctgatgtgtttctgcctgtggtttatgcagtacttcagcatgaagcgcaacatggcagctgcttcgatgaacaagcagaccgagaccatgcagaaggctatgctgtggctcttcccggtgatgtacatcttctccggtgtcgccatgccgttcgccgtgctggtctactggctgaccaacaacgtgtgcaacctctgccgcacattgtggcaggtgtacgcattcccgacccctggctctccggctgcggcggacaaggagaagcgcgatcatcgtaatgagaatgctcgccgcgcaaaggccggcctgccctctctggaagaagaagcattggccaaggccaaggaagaggccgagcgtaaggccactcagggctatcagcgtcaacagcccgtgcgtaagcgcaaaaagaagtgacgactatgtcggtgcgagttcgatgtttcacgtgaaacattcaacacgcaccgacattactttctctgttcgggggagcagggcttagacttggaattcaaacacgacatgaaggagtagcgtatggcacaggatgacgtgaagtcgatcgaccagctcaacgaagaggctgacatcgccgcggattaccttgaaggcctactggatatcgccgactatgagggcgacattgagatgggcgtgcgtaatgaccgccccaccgtgcaaatcgttgctgatgacgatactgacatcaaacatcttattggccgtaatggtgaagtcgttgatgctctgcagcaattgactcgtctggctgtacagcagaagaccggcgagcgttctcatctgattgtggatgtcgacggtttcctgaagcgcaagcgtcagcacctccgtgatatcgccttggatgccattgacgcagtgaaggattccggcgagccgtatgacttgaagccgatgaattccttcgaacgtaaagtcgttcacgatgtggttcgggaagaggggctgaagtctcgctcgcacggtgaggagcctcatcgttacgtgacggtgtatctcaagaatagagtcgaggataccgccgaagacgacgagcttgatcaggagtaattgctcggcgagtttttttgagatgacagggacgttcgacggatgtcgtctttgaacaaactaaagtgaccgcatggagaatggcgtcgtaatgagcggcgccattctccatgttgattgtttcacgtgaaacatggtgagggagatggctatgacggatcagctgcaggggtcacctgtacttgctgaggtcttgggtgatgcgttgccgaagttggagcgtttccatgccaagattgccgaagagggtgaacctcgtggattgatcggcccccgtgacgtcgatatcatttgggaacggcatattctgaattccgctgcgattgtgccgtacgttcggaatgcgacgaatggtattcgcttcaaaacagttgccgacgtcggcagtggtggtggttttcctggattggtggctgccgcgtgtttgccggatcatgacttcacgctgattgaaccgatggagcggcgaatcgaatggttgcatgaatgtgttggcctgatgcaactgcagaacgttgagattattcgtggacgctccgatgccgtcatccagcaggtacggaagcgggaaattcatccgttcgctgttgtcacgtgtcgtgcggttgctcctatgaccaaactctctggctggacgttgccgttgctgaaaccgtcaggacagttgatcgcactgaagggacggtctgctcaggctgaaatcgacaaggctggcaaggagattgcaaaattcggtggtcgtcgtccacgcgtcgttgaggcggctgtcggaccggatcttgagcctacccacgtggtgattgtggataagcgatgagtggagtactgattgagttatccacatttccatatgtgcgtaaaagttatccacatttttacgggacgatgtgcagaatgatgaaaacactgatttttcaatgtttttcgtctgcgaatacataatctaacactcaacgtcattcacacttatccacacttatccacattgcatatcgcaattgtggataacgagcatcatgtccatacgaatgagaacactggaacttacgtctgtgcaaggaggagcgatgtccaccaaggatcatcagtcggaacctatagaatcggcttccgaaacgcttcagcgaatattcgatggtcacggttcagtgcttggcagccagatggctgatgaaagctcacgctacgatgtactcaagaaaaccgatttccccaaacctcaacgtacccgtcgtattgccgtggccaaccagaaggggggagtgggtaaaaccacatccacggtaaacaccgctgcggcgctggcgaacaagggcgcgcaggtgttggtcatcgatatggacccgcagggcaatgcctctacggcgttgggtgtatctcatgcatcgggagagccctcggtctatgacgttatcgaggggcgttccgatctgggtgatgttatcacggtctgtcctgattttcccacacttgatgttgtgcctgcatcaatcgatctcagcggtgccgagttggaagtggctgatctgcccaaccgaaacacattgttgaaggaggccttggacctctacctgcgtcaatcagataaacactatgattacgtgttcattgattgcccgcccagcttgggcctcttggtcatcaacgccatgtgtgcagtgaccgagatgctgattcctatccaggctgagtattacgcattggagggtcttggccagctgattaacacgattggtttggtgcaagagcatttcaatcccgtactgctggtgtccaccatgctcgtcacgatgttcgatcgccgaacgttattgagccgtgaagtatataacgaggttaagggacactatcccagcattgtgctgaataccaccatcccgcgttcagtcaagatctccgaagcgccgagtttctcccaatcggtgattgcctatgatcctcgtggcataggtgccatatcgtatggtgaagcagctttggaaatcgcacagcgttcgcaacaagtccttgacaccattgatgcgaggaggaacaagtaatggcatcaaaatcacgacttggtaagggccttggcgctttgttccccacattgccaggggaggagccggtggcggagcagcccgcaatgattgcggaggattcgtctactccggaggccactgctgacataacccccgccaagaaggctactgcccagcaggaatcaaaacctgccgtgcctcagacgatatcgtccagcaaggcagtcaagaaagccgccggtaaacgcgcatccatgcccgcattggacaccattactcatcctagcgacctgtttttcggtacggagaaacctcaaaccggtaaggtcgccgcacctcagcagggcggcaagtcgtctgcgtctcagacggcacatcgtacatccgtcactgtcaaagatgtttcacgtgaaacatctttgactgcatcggcggcaaagaccgctgacacagataagaaggacgagctcaagccggtagccggtggttatctggctgaactcaaactgtctgatatcgggcccaatgcacatcagcctcgtaccatcttcgacgaggatgagttgaatgagctgtctgcttccattaaggaagttggtgtgctgcaaccgatagtcgtgcgcaagcgtccggcaagccagattgctgcggccaaagccgccaagcacgacgagacggaatccagcacgaatccgtttgccggtcatttggacagcccgtatgagctcattatgggtgaacgccgttggcgtgcttctcagttggctgggttggagacgattcccgccatcgtcaaaaccactgcggatgatgatatgctccgcgatgcattgctggaaaacttgcaccgtgtggccttgaatccgctggaagaggcggctgcctaccagcagatgattgaagagttcgggttgacacaagtacaactgtccaagtcggtgtccaagtctcgcccgcaaatcgccaataccttgcgactgctgaacctgccggcctctgtgcaaaagagagtggctgccggtgtgctatcgtccggtcatgcgcgtgcgctattgggcctgagcgatccggaggaaatggacaagctggcttctcgtattattgcggaaggtctttctgtacgcagcaccgaagaaatcgtcgccatgaagattgcgtcgggggagcagccgaagaagcctaagacgtctaagaccaatccttgggttggttccgccatccagcagagtttggaaaatcatttcgataccaaggtgtcgattaagggcagcaccaagcatggtcgcatcgaaatcgtcttttcgtcaccagaggatatggatcgcatcctgcagctgctggtgccgagccaaggcgatgccgattccaaatgggtgtaacacgataagaacattcgtgttgtcgccggcattattgctgtgcagtgcgttgtatgcgcaagacgttatagcctctgcgtgattcctggcaggggcgtatgcccgcgctgtagcccctgtcgcaatagaaaacccctcaggctggagggacaatcacacatcgtgattctccgtcgcctgaggggtctttctatgcctttgaccgatacgtactatccaagggcggcatgctgtaacactgacctagcgttgctcctatgtcacaggcagcagccagaacagcaagccaccatcagtccgccaccatcagtccgtaagataggcctgcgtatccagcgctgcacggcagcccatgcccgctgcgctgatcgcttgacgataagtacgatccacgcaatcgcctgcagcaaagatgcctggcgcactggtcaccgtgctggcaccctgcaccacgacatatccatcatcgtcacggtccacaacaccggccgcaaaatcagtggctggcgtatgaccgatagccacgaatacggcgttggtgtccagcgtgctttcttctccggtcaccacattacgtacggcgatgctgctgacactggccggtgctacagccggtcgtttgagcgtcaagccaggaatggcaataggtgcaccggtgttctgtgtgggggaggaggtgccggtaatggaggtcaccactgtgttggtcatcagagtgatggtcggattggctttggctcggtccaccatgatctgcgaggcgcggaagctatcgcgtcggtgaatcaaggtgaccgaagaaccgaaccgggtcaggaataatgcctcttcaaaagccgaatcgccaccgcctacgaccacgataggcttgttcctgaagaagaagccatcgcaggtggcgcagtacgagacgccatgtccggacagctcctgttcaccgggcaccccaagcttacggaatgacgaccctgtggcgatgataagcgacgatgcctccaattgggagtcatcggagagtgttacacgataggtcggcttgaccgaatcactctcacacgcctcgatggaagagacatcgtctgcgatataggttgtaccgaagcgcttggcctgttccttcatgcgatccataagatccgggccaagaataccttccgggaatccggggaagttctccacctcagtggtgttgaccaactgtccacctggcgacaacgcaccagtgaccataacaggattgagacctgcgcggccaagatagatggcggccgtgtagccagcgggaccagaaccgataatgatgacgttatgtttcacgtgaaacattgtcacacccccatacgatattccgtgtcattcagccagatgcgaagaaggggcggtaccgtcgaatgtatgcgaacggtaccgccccttcttgggtcagttatcggcatagatgccgattagaagacctccaccttttcgatgtacagctggttctgcggcaggctatccgatggcacccacagcagcagatcctgcgtcttgacggctttggtgaacttcacctcagtagtgccaccttcagcaaaggtgaattcggccacctgcttgccttgagtggggtccccagtggtatttgcgcgaatatagcccttaccaccggatgtgcggatggtgataaccatgcggtacgcatcctgcggctggtcaaggtgcatgtagtatgcgtacccggattggccgccaggattcgacaggaagttggcgctggaaatcgtaaacgccgtgttgttctcatggctcggttgcggaacagcgctggaatccttatcgccggacttcttggccttggtcttcttggacgacgaatcagcagtctcggacttcttggacttgtctgatgccgagtccttggattcgctctgagtggcatcactcgattttgaagaatcgtcagtggtgccaccgttcgtcgcgttctcgctgccaccaaatggcacagcgtcagcattgatatcaggccagtcaccttcactggagttgctggaagcatcggcaggattgtctccggaggatcggaacgcatgcactgcccaaacagccgctgccactaccaatatcagagccacaatgatggcaacgaccttggtcgacagtttgccgaacagatgttcatcgggcagcttgctgtcaacctcgtcatccggcacatccttcggtgtgaagctcggaggaatggcgcttacttcggcaatgcgggcctgctcctcttccaaggcacgcagtgattcctcaccgggagccacagcacggccgctggcgtcgaacacgggaatacgactggttgtctctcccgcggtggcatcggaaataccgccggtaacaataggcactgtcaaccgagtattatcacccggaccgccgataggggccggattcatttcgctgtaccagtcaccggtgccttcaccggaaagattttcgtgctcccaggcgtcagaaaggttgaagtcaaacagacggcgggcatcagactgagactggttgccgttagcagtactggacccatcaggcagaggaaccggtgacatcgcgtgcggagcggggacggcggccggctgaaccggcagggaaggggtaatagacaattccggaagactgttgctgttaatcaacgtgctgggaataggcacgatatcagtctcgttggcaggcttcagtatcgccttggtaatcgagcaatcgctttccacgctcggcaaagcaatatcagcatcgctcagttcagagagcggcttccaattacccaacaaggcgtcgagttctacaagggctgccattggcaacgtatgctcgtcgggctcgctcaaggccaatccacgcttgcaaatcacgcggaattcgccaggggtgtcttgcggcaaggcacgcagattgaatgtgggtgtcgcttggcttggcgtgcgtgtcagcagggtatagagtaatgccgcaagctggcgaatcgcataccgttcaggaccgtccgtacgcagatcggtagcggacgtatcggccagcatcgtggcacatggtgcatcggcaatttgcacaccggaggtagtcactcgaacggtgtcggttgtgatgacgatgccgctgggagtatccgcaatgacctcgcgcagcacgttggcgcattctccgataatcgaccggatggcgctgtagctgagcggcttggcggtatccaccatgtagtcagtcaggcattggccgctatccaccggcatgacaatgagaagtacgtcggattccatacggtatttcagtacgggaatcacacgatcagggcgagtggcggccatgcgaccagcgagctcatcgattgcggcgaaagcgctgcgattggtaatgatgaacagctggcaatcctttgccagcacacggtcgttggctttccatgcctgaatgccaggctcctcacgcaacgatgacaccaaggtgtatcggttgagaatcgtgtctccgagttgcggtttcatagtgcgttcggctccgtgtgattggtgttcgagactggtcttagatattctacgtgcggggctatccttgacgggctccgtctcaggattgatttgcgtatcgtcgacttttttccggctgggctgtcacagcaacgtcctcactggccggagtcttgtgtagacgggccagtatcgagtgataggcgctgatgagttccggggtgtgcaccacacacaacacagccacatatactacggccagcacaatggtgagcaccacgcagatggccagcgcagaccaccagctcatgtgcccgcctactggtcgaatatccgcgccgaacagtgcgactaccggtcgtttgatcagccagaccacaactccggaagccagtgccgccacaatggccttggcatatgtcctcgtgatctcccgaccgccaagattgccttcgaacttgcggcgcaacatcatcaacgtcagcggcaacgccagtaatccaccgagggtcaccgagcaggcgatgccgagtacccaatgctcaggaggaagtaccatcatgccgatgatcatgaatattgaggtgaatccatactgcatcaccgcggacaggaaggggtgaaggccgtcctcaaaggcgtagaacgtgcgctggattaacaggaacgccgaccccaatggaatgcccacagacaaggcgataagcgcataggagatcaacatagtctcgtccatcgagacggacggaagcaatgcgcggatgatcggttcggggaacacgaccatggcggcggcgaagaacatgatgagcaggcccacattattcagtgcgctgaccaggtcgtgccgtgcctcatccagattcgcagctgcgatggaacgggagattttggggaacatagccgtggataccgatacggcgatgagcgaatagggcaggatgaacagtgtgtacgcattctgataggtcgcgttgcctgccacgctgaacaggctggcacccgtcagttcgtgggcgcgctgcggtgcggatgtggcgatacgggtaaggataatgccgcagatctcactggtgatcaccacgcccaaagagcctaacgccacgggacccatagacctgagtccaaagccgccaagcccgaagctgggtttgtacttgaacccgatacgggccagcggcaggaacagtatcagcgcttggaaggccacgcccaaagtccaggtgcctgcggtaagcgcgattttgtcggcggtccagaattcgaggggctgttcattggccttgctgaacagcagaataaagccagtaaaaccggcgcaactaataatgttggcaccggttgagctccacgcatacgtgaggaaatggtctttggcggccaggatctgccccaataccgtatacaggccgtagaagaacacctgaggcatgcaccacagggtgaacgaggtggtcagggctatcatctggtgatcgtcgctacccacgtacaggcgggcaagcagagggctggccgccgccatcaccacggtcatggccaataggatgccgatggccaacgtaatcaggcgattcagtcgttcttgggcgtctttttctttcaacgtgcgcacgatctggggcaccagcacggcgttgaagatgccgccggacaccagcgtgaacacggattggggaatcatggaaccggcctgataggcgttggccgccaatccggtggtgccgatggccgcagcgagaagaatcgtgcggagctgaccggtcacacgggaagcagcggttcccgtggccatgatcagggaattacgacctacgcttgaactcattcgtcggggtccttcttccgatggaactgccgccacaggccgataatgcccagtagcacggcgaagccgatgataatgaagccgctggcatcactgatgcgcatcacactggtgatcgcggtgtcctgcgtgttgccgaagctgttgccttcccggtcggtcaacgacacatgggccgtcgatgagccggaagtggaaacgcggatggtgaaggtcacctgagcgtcgctatgcgagggaatatcgatgtcagcggttcgcgaggtgacgatctgcatggagtcagtcagtgagttgacctgcacgctgacggcgtagggaaggtcattgctgacggtgattggcattttcgcggattcgctgaacacggatattgattccgatgggttgatgcgtacgccgttcagaagatcgctggccagtgttttcgtggctttgaccatggcttttcgcgtggctgtcggctggggggagccagacatggaccgcagcgccatatcgtcatgcagcgccagtaaagagccaatccattgcgtcggatcgttgctatgcgaggcggtgtcattggcgtcctgccgggccagggcctgcgggtccaacgacgagacctcgtcggaatcaatctcgttcctcaatatggaggtggccatgcgcatgatgtcatgccggctgtcggccaactgtctcaatgccgaccgggtattggcggtgttggcatcatcggccttgtcgggattgaccgaatcgctgacattgtacggatcggccttggccatggtcttcaggtccgtcagattcaaccaagacgcctgctcgaaggcgctcatcacctgatcgatccagctggcctccgtggtgtgggagaacgtcataagcaggtatcgggatgtatagggctgttccatctggtagaacgcgctctgagcgatcagtcgggccaaccgaccggcatcgctggactcggcctgcgcgtccgtgctggtggcttggcccttggccagcgtgcccaaggtcgattgctccttcagcacggtgacatcgccggcaggcgtatgcaccacgtaggtgcctgtgtgtacggcttcagtctggtcggcatcgaaagaggcatcggcgatcaccgtgtcatagccctgctcgcgtgctgcggtcagcgcatccaacgtccaacagttgttgccctgccatgcgtacgcggagggtgtttcggagtcgcctccgtcggcataccatgcggccgcctgcttggcgttccactgctcagtggtgatgccggccttttcgtaggccgcggtatcgtccagtgcggtataggcggtgatgtcgaagtcggcgggctgcatgatgccggcaatggacggttgcactgcggactgacgccaatacagaggatccgcgatcacttgcagcgagcggtgcttggcgaatgtctgcccaagggatcgcgcggtatcggcatcctgttcggataaggatatggcttgcgtatcagtggctttggccgcgttgctggcgtcggcgttatcggacttgtcggccttgtccgtgctgttggacttggacgatgttgatgtcgaggaagtggtggtttcggcaatgcgattgctgatggccttattatcgacctgccagccgctggcggtgtagggcatggccacggtcaggttcatggccggtgttgtcgcggtgttgagcccatccgaagatcgggtcagaaaactcggcaaatcggcgagtatctgattgccaacgatatacgacagcatcagcggtttcggtccccaactccctatggaggcaagggtctgctgattggcgttcacctcgatggtgacggtggcagtgccgccggcgggaatcgatggcacgtcaacggaacccaactcgttgggggttgggatgggggcgttgttctcggcccaattctgaatatcggtgcgcgagacaaaggtgaacaacgcattggtggtcaggtgcagtgtgccgcttgacgtggccgtgctgtccgtattgctgatgaccgcggtgacacgatagcccgatttggaggtgacgatgggggtgctttgcgtgatggcaatgctctgcttgggctgattctcggtctgattgcccgttgcgtccgtcgtatcggatgaatcagtcgtgtccgtcgtatcgttcgcgtagacggtcaatggagcggccagcatcgccacaacggcgacgccagccgccagtgcgtgtgccagacgtgtgcaatgtcgtaagactccgggtaggttcactcgtttgcctgcctgttcttcttcctggcgtagagccacgcgattttgcgttcgttgggatagctcaacacgtcatccaaatcttcaaaacgcacccagatggcgtcttccgcctcatgatccgggtctccttccaccgtcagttcaccgccggtctgtttgagcgcgaagtgatggaccagcttgtgcacgcgctgcgtggtaccggtgaaccagtagtcgatggtggcgatggaatcgatcacctcgcccaggatgccggtctcttcatgcacttcgcgcacagcggtctgctgcggggtctcgcctttttcgatatgccccttcggcaagcaccattcgagatggccggagcgggaatgacgggcgataatggccacgcggttctggtcatcgaaaatcagaccgcctgccgaatattcgcgtacgaccggcagttcctgggcatccagtgaagcgaatgtggtcggaccgtccgacgtacggcgttgcggcatcatggccggagtcgggccggatggcgtcaccggttctaccggcactgccggttccggcgaggcaacatctccggacgggtgccggccgaagaccgtggccggcgtgggatgcgctgacgttgcgggcctcactggtgctgcagacggcgctgagaccggcatggtgaccggcgttgcggccggtgcggtacgtgccgcaggcggcatcagcacgtcgcgcggagtcggtatcgctgtggtgtgcgcggcggcggccttggcgaccgcaacggcagcatctacggccgcgtgagcggtcgccgcgggatcgttcgtgacgatggttacggacgtttgtgccgtggcgataatcggctcgacctcggcaatcgtctcggcaccggcctcgccggcgataccatcagcctgcccctcgatagtgccgctggtagtggcgatggtgacggtggcatgcatgccgaagacggtggccggtgtgggcatcatcggcttcggtgcgggcatgtcgctggcggcgtccgatatttcggattcggatggttcgggtgtggcgggcgttgcgggtgtgccaggcacaccggaatgttgcgcagtcggtactgcgtctacttcgtcttgatgaacggcctgattggtggagtggctcgcggtgccgccgacatcggaagaatcgcccgaatcggcggaatgatgcggagtttcggacgtatacagcaggtggtcttgggtatggctatccgccgaatctggtgtttgccccagcatgcgggcaaggtcggcgggcgtaatcatattctccaccttactcaaccccgtgtgcaggtggggtaacggtatgctggtagggcagaaaaacgtcgcacgcgggaaggtgcccattggatttcgaagtatggcctgaagccatcgaacttggtcgactgttcgccgaacagggttacgagctggcattggtcggcggcccggtcagggatttgctgctccatagaaagagccacgatttggacttctgctcatccgcacggcctgagcagttcgagccgatactgcgccggtgggggcatgacggcttctgggacatggggcgcaagttcggcacgctgggtgccatgcgccgccgcccggacggcaccgaggtcaaggtggaggtcaccacctatcgctctgacacgtacgatccggactcgcgtaagcccgaggtcaattatggcgacacgcttgagggcgacctgtcccgccgcgacttcaccgtcaacgcgatggctctgcgcgtgcccgacctgcaattcgtggacccgttcggtggtgccagtgatctgtccaagggcgtgttgcgcacgccggtggatccgcgacagtcctttgacgacgatccgttgcgtatgatgcgcgccgtgcgattcgtggcccagctgggcttccgtatcgcgccggacgcggccgaggcgattacctcgatgcgcgaccgcatcgacatcgtatccgccgagcgtgtgcgcgacgaactgaccaaactgctgctctccgaccgtccgcgcgccggccttgaggcgttggtcgaatccggtcttgcggacatcgtcttcccggagattccggccctgcaattgcagatcgacgaacaccaccgccacaaggacgtcttcgagcacacgatgattgtgctcgaacgtgctatcgccctggaaaccggcccggacggcccggtgcccgcccccgacctgacgctgcgcttggccgccgtgatgcacgatatcggcaagccgaagacccgccggttcgagccgggcggcaaggtgagcttccaccaccatgacgcggtgggtgccaaaatgacccgcaagcgtttgaaggcgctgcgttttgaccaccatctggtcgaggacgtctcagaactggtgaatatgcacctgcgcttccacggctatgtggacgagccgtggaccgattcggccgtacgccggtatgtcaaggatgctgggcacctctatgagcggctgaacaggctcacgcgcgcggatgccaccacacaaaacaagcgcaaggcgatgatcttctcccaggccatggatgagatggaggagcgcgtccgcgaactcaagaagaaagaggacttcgacgcgatccgcccggatctggacggcaacgaaattatggagttgctgggcctggagcccggcccgatgatcggccgcgcctacaagcacatgctggaataccgcttggataacggtccggtggaccacgatgtggccgtcgaagaactcaagcgctggtacgccgagattcagtagtccgatactagtccgataccaaaaaaccgtacgctgaatacgtgtcagcgtacggtttttcgcgaagatgaagctgtatgcgctttactgcgccgtgtatgcgtcgtgtttggtgtcggcgggcagcttggtcatgctatcggcggccttgcaaccctcgatattggtgatggtcttaccggattgcggggaggagttggtgtcctgcagatcgttgaacgtggcgccgatgaccacatcgatgagctgatcctcgcgagccgtcatgatcatggtggcgtcggtgaaattgccgatcagcgtatacgcctgattaatggcgttcttgccgaagtagatggtggtgcgttcaacgtcggtgctggaatagttatcgattttctgcacgctgaatccacgattggccaaagcttcacccacggccttggcgaattggccgtgagaggtgccgttcatcacgcgaatgccgaccgaagcgttggacacgtattgcgctttgccgctgctgtccttgaccgcgcacggtgccgcgttgccgtaattcggctggcgggccggagtctccacttcgccgaggccgaaaacgtggaaattgaacagtagggctatgaccagcactactgccaataccgcgccgctgatggaaaagacgatggtctggcggtggcgcacgtacgccttgcgggcttcacgttcatcaacctgatacgtcatcggtggacttctttcatgggtcgggtggctggttgctaccttagcgtcactgtctgacgccgatattggggtgtgcgggagatttggctcgaataatgcgatcgaccacagccgtatcgcgccacacatcgataatgcgttgtgccgctgcctcgtcggcggcgaaagcgaccactgaggggccggatccggagacgaatgcatggctggcacccgcctgcgtggcggcgtcgatggcctgcccgctgcggggatgcaggctgattgccgcagcctgcagatgattgcggtcgccttctgcggctcccacgaggtcaaaggtgtggtagacctcaggagtgctgagttgcgactggtacgcgccgaccaatacttcgccgctgaatccctgttctatcagcgccagctcatcgcggctgccgggggcgatatccgtgatgcgttcgccgaaaccggtgccgtatgcaaggccaccggtcaggcagaacggcatatccgcgcccaacgtggcggcaatggtgcgcagacgctctataggccagttcagctcccagagacgattgaccgccagcatggtcgccgcggcgtcggctgaaccgccgcctagtccggcacccacgggaatgcgcttggtgatggtcaacgccacatccggctcgcactcggccgcctgggccatggcgaagagggccagtaccgcatggttgcggcgcatgtcgctgcgtgaggaggccaagtcgcccaaataagcgccttcgagctccagagagaatcccgctccgggttgcttggcggttgcggtgacggtgtcgtatacgccgattgcacagtaggtggtgtccagttcgtggcgtccgccccattcgtcgtgagcaggtcccacttccaaggtgagattggttttcgccgggcaatccaccgtaatggtgatgggggagagctcatcgaactgatgtcgggcagcggctgggcgtggatgtgagattaccggactcattgtgcctcatctccatctccacacgattcgatggccttggccagagcggtgaattcggcgatggtgagcgtctctcctcgacgggtcggatcgatgccggcgatggagaatgcctcggagggcgcaatggtcttcaatgccgcgtgcagggtcttgcgacgctgaccgaacgccgcatcgatcagacgaaatacgagttcccgttgtgcgccgccgtcggccgtgctgttcgaggctcccggggcggccgggtcatcggcctgataccgggtgaatctgacgagcgcggaatccacattgggagccggccagaacacattgcggccgatggtgcccacccgttcggcggtgccataccaggcgagcttcacgctcggcgtgccgtagatcttggaaccgggcttggcggcgagtctgtcggccacctctttttgcaccatcaccaagaacgagccgaggttgtcgaaacgctccaacagcgtgagcagaatcggcgtggccacgttgtacggcagattggcgaccagcgtaaacgatgcgtcatcgctgaaatcaggcacattctccggggtgacggttaaggcatcccgattgacgacggtgagtcgtgacgtggcttcgggcatgaattcggcgactgtgcccggcagtcgttcggccaacggcggatcgatttcaactgcggtcatggtggcgccggtttccagaatcgccaatgtcaacgatcccaggccggggccgacttccatgacatgatcggcagcggtcactcccgcctctcgtacgatacgacggaccgtgccggggtcgatgacgaagttctgcccgaatttcttggtggggctgataccggcatcggccgcgatacgacggatatcggcggcacctaacaggtgaccggtggcgggaatggtgtcgttcataagcgtgtgttccttgtgggcttcgtaaccgatcagtaccaaccgatttgttcggaatgttgccatgccttggacgggctgccgtaggtttgtgcgatgtaccacagaccccaatcgatctgtacggcggcatcgtcacggtaattggcgccgaacgcagccattttgtctgctggtcgcgactgaggaatgccgtaggcaccggagctcgcgttttcggcataccacagccatctggactcgcggttccatagtttgaccaggcaatcccagtcgttgcctgtccacccgcgctgcgcggcggcaccggcggcataggcctgagcctgggctacggtggcgtgccagagtcggccggagggcgtggtggttgttcctgaatcggagccggaagagccggaattgttgttcgtaccgccgccggtgttaccggaattaccagtgttaccggagttgttgccgccggtgttgccggcattgttgttggtatcggtgttcgtgttgttgccagagctgctgttgttcttgtcgcctgtgttgttggcattgttaccggacgactcgtgctgattgttgaaaccggaatcggccttgccgttatcggcggagtcggattttttgtcggaacctttatcggtatcagacttggcggcgcctacggcgatgatctggtcgatggccatcgtggtgacggtttcggatttcagcgtctccgattcggccacgccatcgacatacgtgacgttatacacctgggttttctcgccattgacgccttgctggcggatctccgactggccttcaggaagattggagtcgatgatggtttgtgtggagtatggcactacggctgtgcgcgtttcctcgccatgcgtcacgcgccgtacgcgcaggatagtggtatcgccgtccttttcgacgctcacacggtcctctttgttcagcacgatgcctttggagtcaagaatggaggccgcgggcagtttgccgttgggggccacggaagtcttgccgtccgcaatgacggtgaccgggccatcctgattgatgaccagtccgccggtgagctggttgtacacattgtcgatgtcgacggtgattttcgcggcgttgttctggttttcctcgaaaaatcccagtagctggtcggcgctggtggccacggtccagaacggcacggcggtgccgtcgatgttgatggtggtctggtaggcggactgtacggtgaccacggcatgattggcgagctggtcgccggacgaggtggtcacgatatcgtgggtcttgatatccaccccttgttcctccagaagacgggtggccgtcatcgcatatgtggtgacttgggtggtttgcccgttgatgttcagggccacggatttacgcgcggtgaacgcgaatgatccagccagcgcgatactggtcgccgcgatacaggcgattacgcggatgcgacgcagtgtaacaaaccgctgcggggtccaacgccgtgccattgccatactcttcctgctgggtgaacgattacgccacccatcgtaacggttgttccggcccgtactgcggtttcaccggccaccgtcaccattcctgctcgtcagattgttctgagctcaaaaaaagaaaagaaaaggggggcgggagagaaggggatgttcccgcccccttgaaggcgcggagctggttgggggacgctccgccctcattccaggaagcccataattgggggaaggctcctggagtacttacccaaggtaagaattatatgcgtagaaaagtctacgtatcacataatacgccattttttctgcgcgacgagcctcttgtcgggatcgaaccgacgacctgccgcttacaaggcggccgctctggccatctgagctaaagaggcgattgttcttaacgcgtaaatcgttgcgaacaaatgactagtataccggtacttcccgagtggtcaatttaagccgagccgcaggcggtattgcatatgtcgcggcgtcaacttattcggccacgcagcatcaggaggcgaccgaaatcggctttccgctggcaccgatggatggcattttgccttccacgcctacctggtcagcatccagcccaatggacttgaggaagccgtccaccatattcgtgtccgccagcgtgagctgcttcagatcccagtattcgccgttgatggtgagtgtgggggaggagaaggcgccggagctgttgaacagttcggggcgcaggatcgtgtagttgttggaggcggtgagccagtcgaggtattcgttcttgccgctgaacgccgcggcggccacatcctcgctcacgccggccttgacggcctgcttctccagcttggcgttgtttaccggctcgtaattggacaattcgcccggctggaaatcctcagcgtagatgttggagaggtagctcatgaggtggtcgggatcgtcatcatgctcggcaatgtagatggcaccgttgaacacgcggttggagtagttgtcggagctcttattgttctggaaattgaggaagtgcaaatcgatgttgagctggcctgcgttcatcagcttgacgagcgtcgggtcgagttggcggttcaccgaggcgcagccggggcacagaggttccatgtagatggatacggtgggagccccctcggctttctggccataccctttgttggagattacgaagccggccttgtcgtcggcgttagccggctgggtactgactttcttgagcttgctataggcctcgtccacggtcatgttgctttgctggctgctgctgctggtgttggacggccgcatagccttgtttacggcgaatccagcgatggccaccagcaccacaataatggccaccacaatgcagccgatgatggtctgctgcttacgttccttagccgcctgctcggcccgtgcctgctgggcggcctcctcggccgctcggcgctcagcgcgtgtggcacgcttggcctgacgcttcggatctgacatagctatccccttgcaatcgcttcaatgtttgggccccatcataatgaccgggcctgaggaggactgcgcccagagctgatctgaggtgaattccctgtaaaagtgtgacggaacgaacgtatcggatacacaacggccatgtgtgcggatggctgatgtgtgagattccgccccgctctaggcgaacggcatccagttgatcggcatgcccagaatcggcatcgcgcacaaggccacggtgatgatggcccatatggtgaacagcacggtgccgcgcccgccgcccttgggcgccggcgccactggagcaggtggagccccacccacttcggtggatggcgcgcccgccgggcgactgtgtttgagcccgcgcagtacgccgccccccagccgaatcatcatcgactgtggggcgaacacagtgaccagccagccgatggccatgaaaccgcccagcgccagcccggaagcggagaacggcacatcattgagcaacggcaccggaataccccaatccgcggtgaaataccaggagatggtgtgaacgggcagtgccagagccgcggtggccacggcggttcccgccatatagatgatgactagcagcagtatgcggggaatggccagcagcagggctttgaccagatgccagggaaaagtcgccacgcgaatccacgaatcggagcttttgcgctcgccgccgcgtttgccctcgcgctcaagctggggttcggtgttataggccagggtgagcagtagccacaacaacgcagtggccgcgatgatggccacgagcggagcatttgccgccagtgccgccagcggcgccgccagcaggatcaatggcagggtgccgcgctgcagatattcccctcgcttcacgtccaccggattgggcatgggaggattttggaccatggtttcggtgggggccgcttgggcggtttggtcgatgatgcgctgcaatgccgggcgaatggcggggtccactgctgtgggctggttgcttgcgggatcccagctgctctgggcggtgccggacggggggaatgatgacggctgcggcgtggggagtacggtggtgcgctcggccagcggcgtggtttggtccggcatcggtgtggtcgcgccggtgagtacctgtgtgccggcgtcgtcggtgaaatcggcagcagcgtcgggcaacagttgcgtggcctgctccgcaccggccggcggacgtggcggcatatcggctaagggcagcgtggcggtagcggcgccagccggcgagaatacgacggtttcgccatcgccgttatcgcccttattgccggagaacacggccatggtgggagcctcagcggcttcctcggccgcgcgccagatggttcggggattattgcggtcaacgccgccggccgcgccaaaagggggcatcgcctccgcggcttcggcaacgatcgcagccggttgtccagccacggctcccgcggcgaacggtcccgcctgctcgccctgccaagcgttgggattcaacgcatccaaggcgatggcattcagcaattgatccggcgtgcaacgatccctgcgatccgggtccagtgcagaacggaaggcagccaatgtgccggccggtagtccggaaagattcgcgttgcccgaggcctcgcgctcaagtaccgccatcatcggcttggtgccgaacacaggcgcgccggttgcggcaaaagcgagcacggacgccaccgaccaccaatcggtggcgtcgtcggattcggcaccgtcaataatctcgggtgcgatgaatccgggtgtacccatcactaggccggtgcgggtcacgtgactttcgccctcgcccatcgcgataccgaaatcgaccaataccggtccggcggccgacaccatcacattggtgggtttgatgtcgcgatggacgatgccggccgcatgtacggctttggtggcttcgatgagcttgcgggccaagcgttccagatcgtcgcccacataccggccattggcggccacatcatccttaagattcttgccctcgatgagttcagtgacgatgaacgccaacgtatcgtcgagttccatatccacgatgccgcacacacccggatgattgaccttcttcaaggccatggcctcgcgccgcaggcgctcgcgcggcgtgacatcgggcttgaggtcggggtcgtgcagggccgtggacgcagagccggagcctgccactgactcgtcggtcagggagtcgcgcagaatcttcatggcataggtggtgccgccgtcgtcgcgcacccgccacaccgaccccatagctcctgagccgagccgggagatcagcgtatacccaccaaccacttcgccggactcaagattcaacgcgttcaaatcgctcatgccctccatcctaatgccttgctggtgcattattctggctctctcctgggaggccgagcttgatatttcttggctcccctctctgagaggggagccaagaataaatgccgtttacgtattgagaagtgccgtttacgccattaaggtcgattgccctgaccggatgtggtagcaaattatgcgctcgaaatgacaggataggtgcgtgggcaggtgcgccagtcgtgaatttgcgactctataaccatcggcatcaaggatgtgtcggcggtgacccaaaggtgagccagccgggcacattcaacagtggcacagcgatgcaagggcagtatcgtgagccgctgatcgaatcgataacgatatcagattcgaatgccgcgacttcgccggtcgtaccttcgaatacttctccgaagacggctacctgttcggcgtgatggcctcccagcaggtcgctggcgctccggtcaaggcctgaggtgtgtctccgataactgaatagctaaatagaatggacggcctgctgagtgctactcaacaggccgtccattgtgtatctgaatgcgaaaagtcattatatggaacggaatatatcgatactgtgcattgtgccgattactgattccgacgcaagtattcgcgcaggaagggcacggcaaaatcgacttcgcctcgttctgtttcgcggataacgaaggcgtcaaggaggcgtttgcggtaggtggcggcatagttaggcgttttgcccatgcgctgtgcaacattcacggtgggagagggaccatctgacgctgccatggcttcgagatactcacggtcgtttttggataagccttgcaactccgggatgcacacggcgttatcaaggtcaatacgtgcttcctcgatacctgccgtaacatcagcgtcgatgatggtatccgagtcccgcatgtctgcggcatcccagatatggtagccaaccagttgaatcatataggggtatccggctgtcacattggctgcagtgcttaattgagcgtcggtgatggacatgccggaggcgcggaatgttgtggcgaaagcatcgcgcacttcatcaagaggaatatctgtgagtatgttcgttttcgcgcgacgtaggaacgtgatgacttcgtcattgaacaaatcagaaatcatctgtgggagaccggcgaacacgatggcgatattgcgtcgttccctgatttgatgctgtatggcagtggcgatggcaatcatgtcggatcgctcagccgcttgagtctcatcaatggtgataagcaacccagcatggcgcttctcaagcgcatccaaccgtccggcaatggcacttctcaacgtttcgggcatacgcttcggggatagttcggcttctccgaggccgatgcccgctccagcaaaagtcaacgatggtcggatagtgaggtggtcaagggcccctcgcccggttcgtaaggcatcaacaaggcgttcgcatagtccggcagaggccgtttcttcgatgacatcccatctgcgcgctttggcccggtctccgaacacagtgagcatcacggtttttccggttccacgagcgccggtgacgagcataatgcgccctggggcaccgactccgttatcgagacctttctcgaaatcgcggataactttgcctcggccgatgagcaggggcggttcccctcctgccgttggcttgaatgggttttcctttgccttcatgtggaccgcctcctcgctgaatcaacctaaaataaaaattatcaaaaatatcaaaaaaataaaaattatcaaaagttgggttgagccgactgaagaaaacagccgtggcgacaatgattctgccgcaatccgcggtgacaacaactgacgcggaccttcttggcagaatcgttgtttgtcccgcttcgccaatcaacgtcgctcaagttcggtgcgcagaccggctaccgtagcggtcagctcacgcacttcctcgcgcaataggtcgatttcgggattggctgatgttgcaatagcctcttgcgcggcttccttggccacttccttctcccgagcgtcctcgcgccgatccgtctccagattgacctgatccacgatccacgaggccagcgtggccgtcacaataccgatcaacgcgatgccggtgaacatcagcaccaccgcaatgatcttgccttggaaggtgaccggcgagaagtcgccatatcccacggtggtcacggtcacgaacgcccaccacaacgccgtgccgaagtcggtgatcgtggatccggacgccccgcgctccacggaatacacggccagcgcgcccacgtacatgagcattcccaccgcgccgaccgcgtatacggtgatgcgcccgcgcaccgccatgccggaggtgcggttcagcacgtgcagcacggtcagcaaacgcaacagtcgcaagggccggagcatcggcagcgcgatggtcagcagcgtgaacaggttgtgcttgaaccaccgccagcgatcgtcggccaaccacagcgagaccacataatcgacgacgaacaccacccagatcacgttgatgacggtttcacacagcgcgatatgcgtgcgggagagaatttcccacgaatacaccaccagaaacaccacggacagcaccatcagcggccagtccgtccacttcttccacgtcttcagtcccatattccgattgtagtggcgcgcccgctgcgccactgcggagcatgactccggacgtcagtgttgtatacgttcgtatacatttcacgttgtgtacgaacgtatacaacggtatctttcatctcgcatttcccttatgactatcaccacagtgatataatcaagaatatgtaaggagagagagaaagagccggccaatggagaccgcatcgatcgaactgtggcatggctcttcgcatgtcatcaagcatcctgaatacgggctggtcaagccgaacaacgattatggccgcggattctattgcacgcgcagcgtcgagctggccaaggaatgggcgtgcgcgggaatggatgacggtttcgcgaatcggtacacgttgaccacggacgggctcctcttcctggacctgtcccagccgccctacaccatcctgaactggctggccatgctggtcgaaaaccgtcgtttccagccgaccaccgccgtcgccgcgcaaggcatcgaatatctgaaacaagtgtttctgccggatgccagtcaggctgacgtcatcgtcggatatcgtgccgacgattcgtatttctcgttcgcccgcgcttttgtcaataacgcgatttccatcgaccaactcgctgaggcgatgcggttgggcgagctcggcaagcagatcgtactcgccagtcctcaggcattcgcggcactgcggttccaaggctgcgaaatcgcccgcgcttcgacctaccacggattgcgtaacgagcgcgaccgcacagctcgcgaagcctaccgccgcaaaagtgcagaagccgatctcgacggcctgttcatgcgcgacatcatccgcgagaaagtgaccaacgatgatccccgcctatgatgagacatacttgccggacgccatggccaacttggccggcgccttcgattatgcgctgaacgattgcgggttgccggtcggcctattcatggacttcttcgccacctccgaggcggccgcgcttttcgggcgaggcacgcccaaatacgtgtgtggcatgtccggcgaggagctggtggccgaaatcatgcggcaaaccggttgggcgcgcattctcgatatgccgccagccgcactgcgcgccggctcaacacccgaatactgggccggatgggtactcgcatactgccaatgggccaggggagtgcggttctcggacattctcgatgtgctgtcgctcgacgatatcgtgcgactgcacccgactctgcacgaagccgacgaaagccgattcgtcgacgtgtacgacgagcgggccgcccataatcgcaccgagggcgactcccggctgcacacgatccgcgtgcgcgccggactcagccaatccgggctggcccgccgctccggcgttaccctgcgctccatccaaatgtacgagcagcgccgcaaagaccttggcaaagctgccgtctccaccgtgctcgctttggcccgcacgcttggctgccgcatcgaagatctgttggagccgtaaagacgcggagtagtatcgcgccgcatcgattctgataactgaacaactacttttaaggcccggccggatgctcgtttggacatccggccgggccttctggctccacacggggtgccgaggtatccgttctccgcttcgaggggctgatttggccttccgtagaggtttactcccgtttcgaggggctggtggcccgctagaacacgggtataaacggcttcgccccaccgtcattccgccattttggggatgcgcttacttgagtaccagcccctcgaaacggagatagatctccggaaagggtcaaaacagcccctcgaaactcaagatggcggttgcagggcggttgaggatcagtcgaagagcggttcaaacgcaaatgtgaacaatgccacatgtgattgggcgggtcgctgcacgccgattttcgggggtgcatgggaatggcggaatatcaacgaaaaaccctatatctaggtttgttatgtgacacgcgccactacatatagtgccttgatttcaaatcacaccgctgtaatatggccttcgcttcactgttcatcagaaccacatcaaggggagtcgccatgaccgtcaccgtgttcaccaagccgcattgcccgcagtgcgatgccaccaagcgccagctcaccaagctgggtgtgccgtttgaaaccgtggacctgacgcagaacccctccacccttgagcagctgcaggccgccggtttccagcaggctccggtggtcatcacgccggacaactcctggaccggctaccgccccgacctgattcgcgaagtcgcccagcaggtggccgccgacaaccgcgccgccgccacggtgtccgcgtgagtctgagccagcccgaattcgcggccgaaggcaagacgatcggcgcattggtctacttctcgtcggcctccgaaaacaccgcacggttcgtggccggatgccgtttgcaggacgaaggcatcaacgtctaccgcatcccgttgcgggccgccgacccggcgctaaacgtctgcgaaccgtacgtcatcatggtgcccacctatggcggcggcgtggtcaagaaagcagtgccgattcaggtcaaacgcttcctcaacgatccagccaaccgcgagtggattcgcggcgtcatcgcctcaggcaacaccaatttcggtgaggcctactgtgccgccggagacatcatcgccgccaaatgcaaggtgccctacctctaccgttacgaactcatgggcaccccggaagacactgccgccgtgcgaaacggcctcgtccgcttcttcaccgaacagtaaatcttgaccccctcgaggtattggctcccctctccgaggggagctgtcaacgaagttgactgggggagcaactgtctgagtaaacacacttctgccatattccaaggatttccaatgactgacctcaccgccaccggcctgccgctcgacaatactgccgacaccgcagcggaacagtacgacccggcgcacgattaccacgcgctcaacgcgatgctcaacctctatgacgccgacggcaagatccagttcgacaaagacaaggccgccgaacgcgaatacgtgacagggcacgtggccaccaacagcaagcggttcgcctccaccgccgagcgtctcgaatacctgatcagcaaccagtactacaaccctgcggtcttcaaccagtactccgctgaattcctcgaccgcatctacgagcacgtggaatccgccggctttgagttcggcactttccttggtgcgttcaagttctacacgtcctacgcgctcaagacgttcgatggtcgcctctatcttgaggacttcccgcagcgttgcgccgctgtggccctggagctcgccgccggcaatgagcagcaggccatcgaatacgccgacgaaatgcttgccggccgcttccagcccgccaccccgaccttcctgaacctcggcaaggcccagcgtggcgaaccggtcagctgcttcctggtgcgcatcgaagacaacatggagtcgatttcgcgcggcatcaacgcggccctccagctctccaagcgcggcggtggcgtggccctgctgctgagcaacctgcgcgagctcggcgccccgatcaagcacatcgagaaccagtccagcggcgtgattccggtcatgaagctgctggaggactccttctcctatgccaaccagctcggcgcacgtcagggcgcgggcgcggtgtacctcaacgcccaccaccctgatatcctgcgcttcctggataccaagcgagagaacgcggacgagaagatccgcatcaagtcgctggctcttggcgtggtgattccggacatcacgttcgaactggccaaacagaaggcccagatggccctgttcagcccgtacgacgtggagcgcgtgtacggcaagccgttcgccgacatctccgttaccgagcattatgacgagatggtggccgacgaccgcatcaagaagacctacatcgacgcccgtaagttcttcaccaccatcgccgaactgcagttcgaatccggctacccgtacatcgtgttcgaggacacggtcaaccgcgcgaacccgatcgaaggtcgcgtgaccatgtccaacctgtgctcggaaatcctgcaggttcaggagccgagcgcatacaacgaggacctcacgtatgcgcatgtcggccgcgacatctcctgcaatctgggttcgctcaacatcgctaaggcgatggatggcggcttgggccacacggtggagacggcgatccgcgcactcacctcggtggccgagcacaccagcatcaacgcggtgccttcgattcgccgcgccaatgaggagggccacgccatcggtctcggccagatgaacctgcacggcttcctggcccgcgaaggcatccagtacggttctgaagagggcctcgacttcaccgacatgtacttcatgaccgtggcctaccacgcctaccgtgcctcgcacgcgctcgccgtggagcatggccgcacgttcgccagcttcgctacgagcgactacgccaagccggccggccagggcaactacttcgacaagtacaccgatggtcgtcgttcgctcactccgcgcaccgaacgggtccgtgcgctgttcgaacagtacggcatcgcgattccgactgcggccgattgggaggccctgcgcgacgcgattctgaaggatggcatttacaaccagaacctgcaggccgtgccgcccaccggctcgatctcatacatcaaccattccacgagctcgattcacccgatcgcctccaagatcgagattcgcaaggaaggcaagatcgggcgcgtgtactacccggccgcctacatgaccaacgacaaccttgagtactataaggacgcctacgagattggctggaaggccatcgtcgacacgtacgccgaggccacccagcacgtggatcagggactgtcgctgacgctgttcttcccggacaccgccaccacccgcgacctcaacaaggctcagatctacgcctggcgcaagggcatcaaaaccctctactacatccgcatccgccagcaagccctggaaggcactgaggtccaaggctgcgtctcctgcatgctctgatcgttcgatggagcgtataccgcctttcttcggcactcgacgtaccttcgtacgccttcggcctcagacggcggtctccgcacacatcgaacaaccagaggccactctaaggaacccacaatgtcacgaaccatctatagagcactgctccggctgaccgcgccggaggagttcgaaaacaagcccgccgacaactcccaagacgagtaatgcaaaggaatccccatggcaccgatttccattccgcgcaaaccgctgaaactcatcgaccgcgtctccgcaatcaactggaaccgcctcgaagatgagaaagaccttgaggtctgggaccgcctgaccggcaacttctggctgcccgaaaaagtccccgtctctaacgacatccccagctggcagaagatgaccgaggacgagcacacgctcaccatgcacgtgttcaccggcctgaccctgcttgacaccatccagggtacggtcggcgccgtctccctgattccggacgcgctcaccccgcacgaggaggccgtgtacaccaacatcgccttcatggaatccgtgcacgccaaaagctactcgtccatcttctccaccctgtgctccaccgaacagatcgacgcggccttcgactggagcgagaacaacgagttcctgcagaaaaaggcggaaatcgtgctcgactactacgagggcgacaacccgtacaagcgcaaggtggcctccaccctgctcgaatcgttcctcttctactccggcttctatctgccgatgtacttctccgcgcacgccaagctgacgaacaccgccgacgtgattcgtctgattatccgcgatgaggccgtccacggctactacatcggctacaagtaccagaagggcatcgcccagctgagcgatgccgagcgcctggatctgcaggactacacgtacgacctgctcaacgagctgtacgacaacgaggtggagtacacccagtcgctgtacgatcgcgtgggcctgaccgatgacgtcgagaagttcctgcgctacaacggcaacaaggcgctgatgaacctcggttacccggctttgttcccggctgagatttgcgatgtgaaccccgcgatcctggccgccctgagcccgaacgccgacgaaaaccacgacttcttctccggctccggctcctcctacgtgatgggcaaagccgaagaaaccgatgacgacgactgggacttctaagggtttcgcggtccgcgaacccgcagcgccgccgcgttcgcacggcggcgctacgctggagatatggaacaggagccgttggtcagcatcatcatcccggtatataaggtcgagaaattccttgatgaatgcgtgaagtctgtggttgcgcagacctatcgcaacctcgagattctgctggtcgacgacggctcgcccgacaattgcccggccatgtgcgacgcctgggccgcccgcgacccgcgtatacgcgtgattcacaagcccaacggcggcctgtccgacgcccgcaacgccggtatcgctgaggctatcggcgcgtacatatacttcgccgattccgacgacaccgtggcacccacgttggtggaggactgtctgaacgccatgcgcgagtatgacgccgacctcgtgatgttccagttcgacaccatctccgagaacaacaagccgctgctgtccaactatcgccacaacgacttcaccgaggtgcaggtcctgaccccggtcgaggccatcaaaaagcaagtcaaggctgagattgacggctatttctgggccttcctggcacctgcctccacctatcagggcaccggattctccttcccggtgggtcgcaaaatcgaggatctctcccgtatctgcaacgtgatcggcgaggccacgcgcgtggtccgtctgcccaaggcgctgtaccactaccgcatgcgcgaggggtcgattaccgccagctgggatccgcagctcacccgcgactggacccgcgccgccgacgaccgcgaggaatacatcgtccaccgattccccgagctcaagggcttcatgacgctgcaacagctgaatttttttgccaacctcgattacgagaccatgcgccagtcgctgatcgccgggctcaagatcgatcccgaggacgccgacgcgcttcgtcgccgcatcgagggcctgaccaagtccgccgatgagggcgatgagcccgtaccggaaacgttgcgtgagttgctcggactgctcaagctgggcatcgccaaggtggccgatggcacgttcggtaaggccgatggcagcagtactgatggcgatgccgagaacgatgacgtaacgctggccgaccgtttccgcgacatgcgcgaggactggcgccagctgcgcatccagcgcatcgaagacgccgaggagcgcaaggccgagcgcaaagccgcccgcaacggcgtcaccttccagtctgtgtcgcattagtcggcgactgatggaatccatcagtccgggaagagcagacctgctctacgtcgggcgtgccggttcgcacgttcgagaaacaggcgtgtcatgggccgaaccacacaacacccccagaaacgcccataaagttaactacatttcagacacgccacttgccttggtccacggtccgtgtatagtagttctcggctcaacgaagagaaccttcactgaaccggaaaaaagtaaacgctgaagcttgcagtttccgaaagcaaagttgtacgtcggtggcgagggcggaagcacagtaaagaacaaatccctttacaacggatcgtgaggcacgtacctgcctctgaaaggattagtaattatggcagaagtcgttttcgaccacgtcactcgtatctacccgggcaacgataagccctccgtggatgatctgaatcttgatatcaaggatggcgagttcctcgtcctcgtcggcccttctggctgtggtaagtctacgacccttcgtatgctcgccggcctggaagaggtcaacaagggccgcatcctcatcggtggcaaggatgtcaccacgatgcagccgaaggaccgcgacatcgcaatggtgttccagaactacgctctgtacccgcacatgaccgttgccgacaacatgggcttcgccctgaagatcgccggcactccgaaggacgagattcgcaagcgcgtcgagaaggccgctgagattctcgacctgaccgagtacctcgaccgcaagccgaaggctctgtccggtggtcagcgtcagcgtgtggccatgggtcgtgcaatcgtccgtgagccgaaggtcttcctcatggatgagccgctgtccaacctcgacgccaagctccgtgtccagacccgtacccagatcgctgctctgcagcgccagctgggtgtcaccaccctgtacgtgacccacgatcagaccgaggccctgacgatgggcgatcgcatcgccgtcatcaagctcggtatcctgcagcaggtcggcgccccgaccgagctgtacgatcgcccggccaacgtcttcgtcgccggcttcatcggctccccgtcgatgaacctgaacacccacccggtggtcaacggcaaggcgaagatcggtgaggacaccgtggacctgccggctgaggccgtcaacaagctcaccgccgaagacaacggccagatcgtggtcggcttccgtcctgaggacgctggcctggccccggctgacgacccgaacgccttctccctgaaggttgtgaacgtcgaggatctgggctccgatggctacatctacggcaacatcatcaccgatggctccgccgctgaggcttcccaggtcatgtccgaccagaacaagctcaccacgattcgtgtgaatccgcgtgcgctgccgaaggttggcgcgaccgtcaagatcaagatcgacccggccaagatgcacctgttcgctccgtcgactgagctgcgtctgaactaatagatacttggcgaggtctaatcgcttcgtcaaccattaaacgaggttattctcttcctctcttatgacctcgttggaaaagccctgcatagctgcggggcttttctttttgccttctagacggtctgagggagagaccaaacggtgttttcccgtaaacataacgcgccgaagtcgtggccaaggagcgcacttcccaagcaccacgtaaaatcgaacacatggagttgaacgaattgccccagatggatccgcgtgcgctgaaggccacgtctgtcaaagccgaagacgaacacgccaattcagccgaaccgcaagcactgaaaatcaccgccgccagctcgaacccgaagatgttcacgctgccctggcacaagcccttggccacctggcctgaggacttgctggccaacctgccgcgaggcatctcccgccacgtcgtgcgattcgtgcacgtgggcgacgaggtgtacgccatgaaggagatcacgcgccaggtggccgagcgagagtacgagatcctgcgtcgactgcagaagctcgaactgccaactgtgaccccgatcgccgtggtcatcggccgtcatacccgtgaaggggagccgctggaggcgattctggtcacccggcacttgaagttctcgctgccgtaccgtgcgttgttcgcccgcaacctgcgcccggacaccgccgaacgactgattgacgccctcgccgtgctgctggtgcgcctgcacctggccggcttctactggggcgatgtgtccctgtcgaacgtcctgttcctgcgcgacgccgacgctttctccgccttcctggtggacgccgagaccggtgacctgcaagcccagctcaccgacggccagcgcgaatacgatatcgacttggcccgcaccaacatcatcggcgaacttatggatttggcgtccggcaagctactgcccggcgacgtggatgagatcgaggtgggcaaccgcctggttgatcgctaccactcgctgtggagcgccctgaccgacaccgacaagttcaacccggacgaaatgtggaagatcgagcagcgcgtcaacaagctcaacgagctgggcttcgacgtggacgagctggaaatgaagaccgccgaggacggcaagcgtgtgctggtccgcccgcgcgtggtggacgccggctatgccaaccgcaagctgctgcgcctcaccggccttgacgtgcaggagaaccaggcccgtcgtctgctcaacgaccttgacgcctaccgtgcctccacgtggcgtgagggcgaggatctggaaatcgtggccaccgactggatgcgtgaggtgttcgagccgaccgtgcgtatgattccgcgcgaatatcgctcccagatcgagcctgctcagttcttccatgaggtgcttgaccatcgctggttcctggcggagaaggctggccacgacgtgccgatgggcgaggccgtgaccagctacatcgacaacgctctgccgagctacagccttgactccaaggcactcgccgaacttaacgaagaggccgattccggcgtcattgacgacgaatccacctacagcgacccggacgacgacggctacaaccccgatgacgatccggatgcggcagtgtggagtcattaagcggacaatccggtggactgtctgtaggtgagcccatcacacaaagaagcccctcaaatagaggggcttccgtgtatgtacaacctattacggcctcaagcgacaatcactccgccgcagccttgcgccgtgcgttggacaccgcgtacaggctgatacccgccgccactgaagcgttcagcgactcaacagacgagctgatcgggatgccggcaagcgcgtcgcaggtttcgcgcaccagtcggcccaaaccgctgccttccgaaccgagcactacaacgagcggatcggattcaaagccagtctcgccgacgagcttatcgccgccaccgtcaaggccgacaacgtagtatccacgctccttcaagccctcaagtgccttagtcaggttcaccacgcgcgccaccggcatatgcgcggccgcaccggcagacaccttccaagcggcggcgttcactgaagcggaacggcgttccggcagaatcacaccattggcaccgaatgcggccgccgaacgaatcacggcacccaggttctgcggatcggtcacgccgtccaatgcgataaacagcggtcgcgcagcaatacgggcggccgccgaattcgcggcctccattgccttggccttcttctcagcacgatcggccagctcgttcagcgaggagtactggaacggatcgaccttcagaatcacgccctgatggttgccagagcgggcgatacgatccatctccagacgatcggcctccagcatgtgcaggccgttcataccagcgattttcacgatttcgcgagtacgatcgtcatgttcaatacgagacatgatgtacagcgtggaagaaggtacgcctacgcgcagtgcttccagcacggaattacggccgtacaccagatccgaagtatccgccgaagcgaacttgtccactcgacggcgggctgccagacgcgggtcggccatctgccgacgttcggccgctttcttggccttgtacgctttgtgatagacgcggtcctcggccttgggagtggggccgtagcccttcagtttgttgcgatgcttgccacccgaccccttggtcggtccttttttgatagccataggtgctattgtcccagcaccccgcgccaaaacgcggctattccgccgtcggtagccggtaaggtattgagagtgaagaagcagcgtatgatattcggactgtccctgctgtattggggattatggttggcgattctgattctgtggatgggtcgcttcgtgacctcattcttgtcgatatatttggtttccgcgctgcgcctcgatgagggtgtggtgggcacagtcgtggccatgtacggcttcggcgcaatcatcggctgcctgttcggcggtaccttgtccgacagattcggccgccaatccatgattatcatcggcgaaatcggcgcagcggctgccctgctggtcgtttccgtactcactgatcctgtgtctttaggcgcggctctgttcgtctatggtgcgttcgcctcgctgcccagcccggccatcgccgcgtatatcgcggatgtggtgcctgccgaacgtcagcaacgtgcatacgtactgcaatcgtgggcgattaattttgggtacgcgattggaccgattgtggccaaccagctggtcaagatctcgtattcgctgatgttctacgttgaagcggcggtgatgatagccgtcacgatattgctgattgcgttcttccgcgaggtgcggcatttggggattactgtatcggtgccaagtgcggtgcgccatgaagacgaatgcagtgttacccatgcggaattcgccggcattgagaggccgaatcactcggatgccgcaccggctgccagtgtcaagggcgccatgtctcgcaattggcggcgcgtgctcaccgatactccattcctcggcttctccctgctgatgttcggctacttccttgtgtacttccaaagcacctccggcctgcccattgccatgacggaccttggtctagggctgggcgagtattcggtgctgctcaccatcaatggcggtatgttgtgcctgctacagattcccgcgatgaaactgttcgcgcgcatgggcaattcacgcgtgctggtgatgggcctcgccgtaaccgtcatcggctatgcggtgcaggccgcggcccattcttggggcggattcgcgcttgccgtagtgctgtggacgctgggtgagctgggcacattccctatcgccaccactacggttgccgccatggcacccgcgtcggcgcgcggcacgtatcagggcgtctacaacgtagtgtggtcggtgtcggttgcgctggcgccgctgattggtggctggactatcagcaacttcggcggtcgaacgctgtggatcgcctgcactgttgtgttgattgccgtgaccctcggtctcaagctcaccaaaggctcgcgcgaccgcgccatggcccgcagtcttcacgattcgctgtaagcgttattcggtttggagatacgggcaagaccgcatatggcgagtggttcttatcgagaactattctctgcgcgtatgatgtatggcatgcaatacattcaacaaaccatcgttggcattgatggcagcgaggcgcgattctttggctatgtggccgacaacagcgaggagatggaaccggaccgtatacgcccggccatcctgattttgcctggcggcggctacgccatgacttctgaccgcgaagccgagccagtggccctgcaattcctggccaaaggcttcgccgtattcgtgctgcgctattcggtgcagcccagccgctatccggtggctttgctggaggctgccgaggcaatgcgcctgattcgcgccaatgcggatcagtggcatgtaaaccccgcgcaagtggccgtactcggcttttccgcaggcgggcatctggccgccaacctcgccacctcggtcggcgacgaagacatccgcgaacagggcggcatagacccggacgccgtgcgcccgaacgcgctgatgctctcgtacccagtaatcaccgccggcaagtacgcccatcgcggcagcttccaatgcctgctaggggaccaagctcacaatcaggctttgctggacaagttctccatcgaaaagcacatcgatgccaaaacgccacccgtcttcgtctggcataccatgaccgacgacgccgtgcccgtggagaacacgctaatgctcatccaggcctgccgggccgccggcgtgagcattgaggcgcacctgttccctgaaggcagccacggcctgtccttggccaatgcggaaactgccggtaacggcttctatgcgcacatcgtcgaatgcgtgcagtgttggcctgatttggctgaggcctggttgcgtcgcctgttctaggcaaaacgctattacgctgtgcgccaagcgcgccacgcggttatggaataatggcaatcgtatgcatcggcagcagttgcgccggtgtccataaccgcgcagtcctgtgcgtccagccgggagagaaaacccggcagcggccgcaaggctgactactccgcggcaataccaaggagaacattatggatgatctcaaagatcaatccgcagtgtccacgaccgcaacgaacggggtcgtggaatcggaagaggtgcgcgcacaggaagcgctattgggggatactgatccaagtctgaccagcgccgacgacgtggccaaagccctgaacgtcgacccatcccacggcctgagcgaggaagaagccaagcgtcgactggccaaattcggcccgaatgagctcgccaccgccccgcccgtaccgaaatggaagaaattcctggcccagttccaggacccgctggtctacctgctgatcgcggccaccatcatctcggtgatcgcatggttcatcgaaaaggccaatgcgcagcccggcgcggaaggcggtgaagtgctgccgttcgacgccatcgtgatcattttgattctgatcgtcaatgccgtgctcggctacatgcaggaggccaaggcggaggccgcggtcgaggcgctcgcccaaatgacggccccgcagacctcggtgctgcgcggcggcaaagtcatgcgcatcaacaccgccgacgtggtccccggcgacatcatcgtccttgcggaaggcgattcggtctccgccgatggccgactggtcaacgcggccagcctgcgcatcgccgaggcctccctgaccggcgaatccgtgccggtcggtaagaagccggacacactcaccgaagccaaggcgctgggcgaccgtgccaacatgatcttcaacggcacttccgtgacgcaaggcaccggccgcgcaatcgtgaccggcaccggtatgaacacgcaggtcggcaagatcgccgacatgctctccgccaccgaagatgagaaaaccccgctgcaaaaggagatggattacgtctccaagatcctcggcattgcggtgtgcgtcatcgctgtcgtggtgctggtggcgctcgccgtgctggaaggcttcgacgacgtccatgacgtgattgattccttgctgttggccgtctcgcttgccgtggccgccgtgccggaaggcttggccgccatcctgaccgtggtgctggcgcttggtgtgcagcgtatggccgcgcacaacgccatcgtcaagaaactgcattcggtggagaccttgggctccgcttccgtgatctgctcggataagaccggtacgctgacccgcaacgagatgaccgtggagcgcgtggtcaccccgtccggcgcagtgcagatcaccggcactggttacgcgccggaaggccgcatggttatgaccggtggcgtcagtcctgaatccgagcaggcccagattgtggccgatgaagtcgtcgccacgcttgtggccggcacgctcgcgaacgacggcgaactacgcgaggagaacggccgttgggagattgtgggcgaccccaccgaagtctcgctgatcgtggccgcacgcaaggtcaaggccgatcgcaagatcacgcgatacacgcgcgttggcgagattccgttcacctccgaacgcaagcgcatgtccatcatcgccaaggacagcaccgattcagacaagctcaccgtgttcgccaagggcgcgcccgacgtgctgttgagctactgcacgcgcatccgcgtgggtggtcaggtccgtaagctcaccgaaggcgatcgccagtcgattctcgccaccgtcgaacgtctctcctccgaggcctaccgtacgcttggcgaggcctgccgtccgctggaaaccagttctttggctgatgtgcccggtgtaagcgtcaacgccgcaggccaggtgtccgacatcgccgatcaggccgaagccatcgaaaccgatctcatctggaatggcatggtcggcattatcgatccgccgcgtactgaggtgcgcgactccgtgaccgaggcccatcgtgccggcatccgcacggtgatgatcaccggcgaccacccgctgaccgccgcccgcatcgcctccgaccttggcatcatcgccaaggacggcaaggccctgaccggcgaccagctcgaccagctgcccgatgaggccgcactcgacaaggccacgtccgaagtgtccgtgtacgcgcgcgtggcccccgagcacaagctcaagatcgtcgaatccttgcagcgtcaaggcaacatcgtggccatgaccggcgacggtgtgaacgacgccccggcagtcaagtccgcggacatcggcgtggccatgggcatcaccggcaccgaagtgaccaagcagagcgccaagatgattctggcggacgacaacttctccaccattgtggccgccgtacgcgagggtcgcgtgatcttcgacaacatccgcaagttcctgcgctacctgctgagttccaatgtgggtgaggtgttcaccgtgttcctcggtgtggtgtttgctggcttcctcggcatccgccagccggaaaccgtgggcgtcaccgtgccgctgctcgccacacagttgctgtggatcaacctgctgaccgatgccgcgccggcgttggctatgggcgtggacccgcagaccgacgatgtgatgggtcgtaaaccgcgtaaggtgacggaccgcgtgattgacgcctccatgtggggcgacatcatcttcgtcggcgtcattatggccatcgtcacgctgattggtatggacatgcacctatccggcggcttgttcaccgaccgctcggtggatgccatcggccatgaagcgcagatgaccgaggcccgtacgatgggcttcacgattctggtgtttgcccagctattcaacgcgctgtcctcccgttcgcatctgcagtccgcattcgtgggtctgttctccaacaagtggctatggggtgcgattggtttgtccgtggcgctgcagctcgtggtgatttacgtgccgttcctcaacggtccgttcggcaccgtggcattgagcccgatggcttgggtggaatgcatctgcctggccgcaatcgtgctgattgcctccgaactgcgcaagattgtgctacgcgcgatggccaagcgttaagccatcgcaatagccctgattgtgggcatatagcagtgggccgggctctggtattcagagcccggcccactgctatatccaaacggctcctcatggggcggtaactatcccatggggcggtgatttcctcatggggcggtcgctgaaaacggcattattccgcgaaaaaggaaaatgtgctaaccgccccatggggaagttaccgccccatgggaaacaggagaacgctgcagacctcagttgttgctgccgtcggtgccgtcagtagaggtggagttgtcgccgccgttattgttggactcgtcttgagacttctgctgtgcctcttggtcggccttctgctgagcctcttcctgagcttgcttggcggcatctgcctgctgcttggcctgcatcgaggcggtgacgtcggactcggccttctgcagtttagaaatcgcattgttgacgtcggattcggacggactggtcccgttcatcaccgtattggcctcggtgatggcgttttgcagcgcggtgcgggtgttttcatcggccacactgcccgcggaattatccagcgtgccctgcgcctgcgaaatagccgagctcaggttcgatttcagtgtgttggtatcggccgtcgcctttgaagtattaacggccttgatcgcgttgttgatggcatccgtcttgtcagccatgtcgctggcatcattctgcagctctttagtgtgagacttcaactcagtggcgttgaggttggaatcgcacttggcggtgtcagccggattgccggcgtcttgcaacgcctgattcagcgtggtgagcgtattggcatcggccacatcgctggtggatgtttgcgcgctggtttggccattggatatggcggtggtgagcttcttctgagcattcgtgtactgcttggccgctaccttgcactcggccaatgccacggcttggctcgccttgctgctgttggaatgccaccagagcaggccggcgacaaccagcgctatcacggcgactactgctacggcaatgctgatgatcttgcgggtgttctttttgccgctaccgccgtgacgaggctcggcgccatcggaatcgtcctcatcggagacctgatccaacggaatggagggaggcatcacagcaggctgagcctgtgccgaagcggccagggcggccggttggaacacctgtgtggctgcagcatcatcggcagacgctacttgcgttgccggcatggtaacggtctcaccggatacggtggatgatgcgccgtatgcctgtgtggccgcagctgaatcaggctggaatgcctgtgtggccgcggtttcggcattcggcatggcctgagcttcgaaaggctgtgttgccatgacctgatcaggctggaacgcttgtgttgcctcggcatctaccgcaggctgctcggcctgattgggttggaacgcctgtgtcgcggcgtttgaagctaccgaaacaggcgatgtcgccggtgccgctggtgcggctggtgctgctggcgtcactggcgctgtcggttccaccgggcggaagctttgcgtcgtctgatcccaaacgtattgctgctggccgggcgcagcggcgattggtgtttcggatactactggctgcgtggctgccgccggctgtggtgcttgtgcggcaaccgcagccgggaattgcggcgagaacggttgcgtcatggccggatcgatgggctgcgtcggctgagcggcttgtacgggcggcacagcttgcgtgggttgtgaggcatacgctacttgcgcgggctgcacaaactgtgtgggctgtgtgggctgcgcagactgcacagactgcgggaactgcagagccggtgtggcttgtgccgtgggttctgtgctatatgctgccgtctcttgcccgggaatcggaggaaccgttggcctgaccggcttttcgggctgctggaagtcgaactggaacccgccatcgctgttggtcatgacatctccttgggattaagcaaatggccggcatccgccggccgaatggtacgtcgcaacgctcagtcgtcgatgtgcgcgcggtagaaattctcgtaggaacggctcggcgtcggaccccgctggccctgataatgcgagccggtgcccttggagccataagggtgctcagcgggcgagctcagctggaagaagcacatctggccgattttcatgccaggccatagtttgaccggcaacgtcgacacattagacagctcaagcgtaatatgcccctcgaaaccggggtcaatgaagcccgcagtcgaatgggtgagaatccccaatcggcccagtgagctcttgccttccagacgggcggcaatggacgggtccaacttgacgtattcccacgtggaacccagtgcgaactcgccggggtgcaaaatccacggttcgtcgggagccacctcgaactgttcggtgagcgcgccttggttttccgccggatcgacataggtgtaggcgtggttattgaacaaacggaagtaccgatccaatcgcacgtcgatggaagcgggctgcaccatttcgggggtccacggatcaagtgagatatgacctgcggactgtgcggcgagaatgtcgcggtcggacagcagcatgtgaaaaactccttgggcaaataaatactgccttcaagtctagcgccttgggcggaaacgtgagaggctcctcacgcttccgcggtccatcaatcgcaagtattctcaggtttttctcagagaaacttagaggtagacccagaaagcagtggttatataaaagatgtcagcggaaagctgatcaggagccgcagcagttcccgacaattgaaccccctttcttcttctctctcctttctctccccggcgggcaaccgccggggttctttttgtgccctgaatcattcccccgaatgaccgccattcccaagccatagcggtacactagctgtgtaatcggcaggaaggggggcaccgatggcccgcaacgatgaggactacgatttcttcggcgatggtcagtatgacgattcgcgcagctcacgtcgtgcacagaatcgacgcccatccaggcgggatgccggccggcgattcgccgctacaaaagccagcagcccaacgtcgatattgtgccgcagacttgccgttgtcagcggactgctagccgtcgtggtatcggccacctcggcggttcatgagatcgcgccttacgccatttcctttatgacggcagtgccaggacgatacattgcgttgatggcggcggtgcttatcggcatcaccctgattctggtcatcgctgcgcgagtcaccatgcctcggtacgccactcacgggggagtgggcgcgggcggcatcatcgcactggtgtgcgccatagtttgcttggttatcggcgtggccgtgggcgtattgttcccggaaggactgattcagcagtcgaacgacaaggcacccgtcgaagataccgcacagatggagcaaggcatcgaacaagctgccggcgcgtgcaaagaaggatggcaggggcttgatacgggcggtttgccgggcatcaccaccgtacagatgtgcactgatccgagagtggccttcgtatcctttgaatcggaatcgtccgcagccatcagccgggcacctatcgaaagcaagatttccgaactgctgagccaatacgctgataatgagcaaacgaaaggtgattggcgattgctgaacggcaaacgctggatggtgttcggcgaggccagcaagatgaccgcactgcagcagcagtggggcggcgaacttgagacaatcaccgcagccgcagataccgcagacagcggtaacgcctgacagattgccggtatcccttgaaaagtcccaaggcgattcggcgcggattacccaatgtgattgaaatcatggtccatcgttttccgcacagcgcgcaagacctctatattggaatggtatgagcaaagaagcgaatgccagccagcctctgatcggccgcgaatccaccactgtgcccggacgttttggcgagccactcaccgtggagcacagcgtcacctcgcgcggcggcttcgaccagcatgccgcgcatccgctgttcctgtgcctgcacggatggggatccagcgaagaagacatggcggacatcatgcgcctcatcgctccatataacgatttcgtggcattgcgcgggccgctgacactcgcgccggcccgtgagggcagtctcgaccccggcaactacgcgtggttccacgatgccctgcctatcggcgatgatcgtgactacgacgcgtatgccgccgccacagcagtcgaccgatgggtggccgacaacattcccgccgaccgtgacgtggtgccgcttgggttttcgcaaggtgggttggtcgccgtgcatttgttgcgtatcaatcccgagcggtaccgggccgtcgtctccctgtccggcttcaacgcacccggtcaggtgcccggcacggcccccgccgactctcgcctggccgattatgatatccccgtgttctatacgtacggcaagaacgatggcgtaatcccaaaatacgaactgttcgccaccgccgcttggctggaagagcatacgtggctgaaaaccaagagctaccacggtctggatcacaatgtgagtcttgaggagttcgccgatttgcgccagtggctacttgacaacgacattacctctggcgtgctgtagtcagccgccatcactggaattggcgcggccgtcgcagcaatcggacatcgagggcgcttgtggctgactcggtcatagactgttctcccatgagcgaagtgagcactgcgagcactactgcacatactgaagagaatcatgtggacgagtccccgcgcggcatcgcggttatggttgtggtgggcgtgctggtcgggctgttgtccggactgttcggcattggcggcggcaccatcatcgtgcccgcgctggtctggctcggcctgacccagcggcatgcggccgccacttcgatgttggcgattgtgcccacctcggtgtccggcgttctggcctatgcggttgaaggcaatgtggattggattgctgcgctgctgatgttcctgggcatgttcatcggcggtcagattggttcgctgctgttgtcccggctgccggaagtcgtgctgcgctgggcgttcgtggtgtttatggcgtttatcatcgtgagccagcttatttttataccttcgcgtgattcgtcaatcgaatttaatctggttactgtcttgctgatgattgttttcggcgtgctcgccggtattttggctggcttgctgggtgtgggcggtggcgcgatttgcgtgccggctttgtcgatcctgtttggcgcgtccgatttgatcgcgcgtggtgcttcgctgttgtccatgttcccgaatgccatgaccaccaccgtggccaatgtgcgccgcaaaatggtgcatgccaaagccggtctgattatcggcattgtggcggcactgaccgcaccgctgggcacttggattgccggggccatgagcccgcgtgccggcggaatactcttcgcaacctatctgacggttctgctgattcgcagcatctgggtagccctcaaagtcacacgggaatagcaatccccaacttggctcccctcagagaagggagccagggaaactagatgccggaatcagcgtccacttgcataacgtagatgttgcgcctcagggagcgggcttgggctcggttgatgtcgccggcttcgtacatgtcctgaatcataccgagttcgataccgtagctctcgcgctttacgtcctcgacctgcgtgatggtttccgtagtgccgctcatggtcggacgtgcctgcaatgaagcctcggcacgacgataatccagcaacagtgccgaacaatgctcggtgttgtacgtatcctggcccatctcgtcaataagccggccgataacatgatgaatcgcctcgacctgcagttcgcgggtgcgcgcgaaaatctggtcctcgctcaccaatggtgtggtgtggcgaatcttggacaccgtgcgtttggcgtaattgctcatctgccgctggaacatgcgtacacgaccgcgaatctgcgataccgcgtgccccgaagtcggatcagtggaagtgtgacgcaacgtattcataatctggtcaagcatgcgctcgcaggtttcgacgttcagctcttgcgtggccgtatccgccgccggatgtgctttggtgtcggcaagccggtcgcgcacgaattccttttcccaatgcagcgcttcgatctgcaattgctcgaatccctggggatcggtatcgccgatgcgctgctgcaatcgcccgatgcgcttggtgtactggtcgattaccatcagaatcgcacgacgattctctggcgtgatgcgtccggtcaattcctccaccgtggcgcgtaacacatcgatggtcaccggaattatttccgcgctgggatccttgccacggttcggagccaatagcggtaacaggaagttggccagcagcaaggtcacgataatcacgcctgacgcaatgaaaatcagctcgtcacgcatcgggaacggcgcaccgccggcaatgtaatacgggatggtgaacatcaatgacagcgtgatggttcccttggggccgccaaaggtcatcactgcggccgagcgccagcgttcgggtgtcattttgcggcgctggccggagattgtatctcgcgcaacgcgcagcatggccgcaatccagaagaatcgaagcgcgattaccaccagagtgaccagcagaataatgccgatcagcgcgatattgctgatatacgggtcagaccagctggccatcatggcgcgcggcagctgcatgcccagaagaatgaacaccgcaccgttgagcgagaaactcagcacaccccatactgaagtggaaacgatattcgtgcgtgccacattcggccccacgccggtgcggtcgaatcggatgaacaggccagcggccaccaccgacagaatgccggacacattgaattcctccgcgcccaaatacagcaggaagggcaggaacagttccatcagaatacgtgtggtagtggtttcccagccgagggatcgcacggtctcgaatagccagttggccgctgctgctatcaccaggccaaataaggtgccgccaaagaaggagatcacgaattcgccggcggcctgccccacggcgaattctccagtgaaggcggcggccagagcgaactggaagccgacgatgccggaagcgtcattgaagagtgattcgcctttcagcacgctgcgctgacgctgcgtcagcgaggcttctttaccgagggagctgacggccaccgcatcggtcgggccgagtgccgcgccgagtgctaaggctgaggctaaggtgatggacggccagacggcatgcaaagtgaatccgaccgccgccatcgtgacgatagccagtccgatagccagcgataggctcagatccagcgttttcagcaacgccgacttatcgatttcgtgggcttccaaatacagcaatggcgcgataaacagcaccatgaacagttccgggtcgagcgttgcatccgggaaaaacggcagatacgtaaccagcacgcccagcacaatctggaccagcggcgtggagactttgggcacgaagcgactgacaaacgagctcaccaccaccgccgcaatgatgcataggatgagctcaaataccgccatgttgccgccttctcccttaaatttttctccaccaaaaagtatatgggaaccatgaagaaaacgttaagcttgcggccgattatgcacatcatgagacgatatgagaaaaggcatacactcgttggtatggaatatgacgaggcgatgcgctgcgcactggaactggccggtcaggccgcagccgctggtgacgtaccggttggtgcggtggtgctggatgcggccggccagattgtcgggcgcggatacaacacgcgtgaggctgatggcgacccgcttgcccacgccgaaatcatcgccatgcgtcaggcggcccaagccttgggcgcttggaatctcgccgattgcacgctggccgtcacacttgagccgtgcccgatgtgcgcgggtgcctgcatccagacccatatcggcaccatcgcgttcggtgcctgggatcccaagctcggtgcatgcggttcgatttgggatattccgcgcgatccgcatatcggccatagtcctgaagtgcacggcggcgtgctggaaggcgagtgtcagtccatcctgactgatttcttcgcccagcggcgatagacacggacgcattacttacctcacgcaaccaacacgcggcaccaaggcaacatattccatttcttctaccatcgaaaccagtagtgcaatgcaaatccacacacgtcgaaggagacaatatggccgagaacacctccactttcaccggcgccgccgctgacggcaccgcactcaccgccgtctacctgacccagcccgccgccaatgtggcgatcggtctggtgtttgccggcagcgacctgccgcacatcgtccactggggccgcccgctggccaagcccgacaccctgctggccgcctatgacgccctgaagccgcagcgcgtgtccggcgcgctcgacgacaccgcctggccgtccatcctgcccacccaggccgaaagctggatcggcgagcagcgcgtggtgctgcgccgcgccggcgtcgagctcttccccaagttcaccgtgaccaatatcgaggccggcggcgtgctggaagccaccctcgatgccgtgtccggcgaaagctacaccgatgtggccggccatgcccgtgccaccggtccggtccgcgtgcccggcgtcatagtcaccgcgcgcgatgaggagcagggcgtggaagtcgaatggcacctcgaactgctccccggcggcctggtccgtcagaaggccaccgtaaccaacctgttcggtgcagacgccggagccccgctcgagatcggcaagatcgagctcggcttcccgctgcccgaatccgccggcgaaatcctcaccaccaccggtcaccatctacgtgaacgcagtccgcagcgccagccgctgaccgtcggccgtttcgaaaagccgcagctcgccggccgccctgacttcgacgcatccctgctcctgaccgccggcgtgcccggtttcggcttcgagcatggcgacgcctattcggtgcacgtgggctggagcggcaactccgtactgtccgccgaacgtctgccctacacgaccggcgtaatcggcggtggcgaactcctgttcggcggcgaagtgacgctcgccggccccggcgaaggccagaactcctacgacaccccgtggctgttcggctcctatggcgatggcctcaatgagatcgccgcccgcttccactcctacgtgcgctccctgcatccgcgcctgttctcgcacggccgtccggtgatcctcaacacatgggaagccgtgtacttcgaccacaacttcgatacgctgaaggcgctcgccgacagggccgccgactccggcgtggaacgattcgtggtggacgacggctggttcggctcccgccgcgacgacacctccggcctcggtgactggcagattgcgcaggacgtctggcccgatggtccgaagtccctgaaggcgctcgccgactacgtgcacgccaagggtatggaattcggcttgtggttcgagccggaaatggtcaaccccgattccgacgtggcccgcaaccaccccgattggattctttcgcccaccaccggccgactgccgctgcagggccgcactcagcaggtgctcgatctgaccaatccggatgcgttcgactacatctacggctgcatggaccagcttgtcggcgagcttggtatcgactacatcaagtgggaccacaacaagctcgtcaccgagcccggttcccgccgctccggccgcccggccgtgcacgcgcagacccttgccgtctacaacatcttcaagggcctcaagaccgcacatccgggccttgagatcgaaagctgctcctctggtggcggccgcgtggatcttggcatcctggagcacgccgatcgtatctgggtctccgactgcgtggacccggtcgagcgcgcggacatccagcgctacacctcgctgctggtgccgccggcgatgatgggcgagcacgtgggcgccagccccgcacactccacccagcgcgccaccagccaggaactgcgcatggccatggcgttcttcggtcacatgggcatcgaatggaacctgttgaaggagccggacgaggcgctcgccaagctggccgtgtgggtggccgaattcaagaagcaccgcgactggttcgccatcgacacctgcgtgcacgccgactccaacgatccggccgtgcgtctggacggtatggtgatgccgaaccgtgacgccgccatctaccgcttcacccagctgaccaccagccagacctatccggccgcgcccgtgcatctgcccggacttgaccccgagcgcacctaccgtgtcagcccgcttgacccgagcttggatttgaccggtctgaccaacggccagagcactctcggctggtggaacgaggaaggcgtagtcctgaccggcgaagccctgcagcgctacggcattcgtcccccgtccctccacccccagcaggcagtattgctcaaggctgtggcgttaagctgacagcctagtaggctgtcagtagccacggcctgagcgaagcgacagctgagcgaaggtgggattgagccttgccgataggcaagtccgtaattgctggtcgtggcggagtaactgtggcgaagcaacgttcttggctcccctctctgaggggagccaagaacggcctacccaatatgcttcacaatcacgcgactggcggcggctttggcccagagctgccagtcgtggttcataatcgtgaacttgaccggctgggtctggctgtgacggtagaaacgaatgccgtcacgtagcgaatcggtgccgagcttggccaaaaacgcggactccccggcaatcatcacatgcccgggcatcgcgatattcgccaccgtagccaccagcgatcccaaccggaaacacgtccggttcaccaactgcgtggcctgcggcacgcgttccttggcatcgcgcgcaaagtcctcaaaactgaccgcgcgacccacaatcgcagagtactgttcggcgattgaatcgtcagtcaagcattgtgaacagccgatatgtccgctggtgcagcgcggcccctccggatcgataagcacgtggcccaccagaccatagctcttatccgggtactgcactggcttgccgttcacggccagcgaataaccaacacccacgccgatggtcaccacggcgaacatatccacgccgacacccggcccgaaccaggaggcatccaccagcagagaatcgatatcattgaacaccccgcacggcaggccggtcgcctctgtgaccatcgtccccaagtccgtggccccgtcccaatgcaggaacggcgcgaacgtcacaatcgaatcgtcgaccacatgcccacctaccgcaacgcccaccgcagtgggggagggtagtccggaagaggcgatatcggcggaacattcgcgcaccagccgcgtgatggccgacaccacatactcagccgattgatccgccccgatcggcacctcgtgccggccggacaccacctcgccatgcgcgttcaccgcagcggccacaatcgacatcccatgaaccttgacaccaatgaaggtgcgtgcgttcgaacacaacaccagcgaagtctgcgggcgtccgcgacgatccgaactttcccttggcgtgaatcgctcgggcagcttgcctgacgggccggcctcggccggaagctcctcgatcaccccggcgtagatcagatcgctggtgatgcgggacaaggccccttggctcagtcccagcatctgtgccaacgtagtgcgggctatcggcccgtattgggcaattgccgccgccacgcgatgcgtatgctcggatccggaaaaccactgtggaatcgcgttggcatcagacatgcaagccccccctcgctgtatttattgcgttaatcacaaaataccgcgctttttgttgcttgcgcaagtgggctcgctggcgctgggaatgaaatggccgaaccgttatcttagaaagtggaagaaccgccggcatcgaagccggaggaaaagaaagataaaggagtcaacaattatgctgtccgattccccacatgcaacgcctagactgaagcgtctggccgtgcgcaccgccgccgtggtgtgcgcgattgccgtcggcttcggcctggcaggctgcggctccagcaccgcaggcaccgtcacgctggatttcttccagttcaagtccgaggccgccgaccagttcaagtccatggtcgccgattttgaaaagcagaacccgaccatcaaggtcaatatcaacaattccgccaacgctcagaccgatctgcgcacccgtttcgtcaagaatcgtgtgccggacgtgatcaccttcaatggtgacatcagctttggcaacttcgccgcctccggtgtgttctacgatttcaccgacgaacccatcgtggacaccctcaaccccggcatggtcgagatcgccaagaatctggtgcagaccaccgattcctccaagaagcgcctgtacggcctgccctttgccggcaacgcctccggctacatctacaacaaggctctgttccgcaaggttggccttgacccggagaacccgccgaccacctggagcgagttcaccgatatgctcaacaccttcaaggacgccggcatcaacccgctgcagggttccgtggccgacgcctggaccacccaggcaccgctcgcctccctggccggcacgctggttcccgaatcgaagtacaccgagctcaagcaaggcaagaccacgttccaggaactgtggaagacctcagtcgagaaggaatccgagctcttcacctactccactgcggacaccggcgtcacctaccagcagggcacgcagaacttcgcccaaggcaaggccgcgatcatcccgctcggcacctacgccatcccgcagatcctgctgatcaaccccgatatcgaacttggtttcgcccagatgccggccaccgatgacgccagcgagcagatcctcaccgccggcgacgacgtgatgctcaccatcggtgcggacaccaagtaccccaaggaagcgatgaagctcgtcgaattcctcatgcagaaggatcagcttgacgcctacgccgacgcccagtccgccatcacgccgctgaaggacacctacttcggcaacgatgcgctggaaaccgtgcgcccgttcttcgaggaaaaccgactggccgacttctgcgaccactacattccttcgtccatcaacatcggcggctacctgcagaccatggtgacctccggcaacaccgaccgtttcctgaaccagatgcagaccgaatgggacaaggtccaagccaggaccttcgagtgatcggtaggagaggagaacatcatgtcacacgcaaccgcaaccaagaccgctgccaagaaacccgccaagaagaaggtctccgccttctccacccgcaaggtggaccccgcttactactggatggtggttccggcggccattatcttcgccttcttcctgtacctgccatttcttgatggcgtaaagtattccttcaccaactcgcagggctacggcgattacaagttcatcggactgaagaactacatcgccctcttccaggacaaccgcgtgggccacgcctacctgttcacgttcctcatcgccatccttatcacggtgctgatcaacgtgattgccctgttcctgtcggtgctgttgaactcgaagatcgccttcaagaatggcttccgagccatcttcttcatcccctacaccctttccgtgctggtcatcggctacgtgttcaagtacatcttcatgaaccctctgcccgagctcggcaaggcgctgggcatcaagtggctgtccacctcgctgttgaccaatgagcagcttagctggatcccgatcgtcttcctcgccgtctggcagggcatcgcctactcggtgctcatctacctcgccggcctgcagaccatcgacgacgaaatctacgaggccgccgccatcgacggcgtcaacgcctggcagaagttctggaagatcacattcccgctgattggaccgttcttcaccatcaacctcgtgctgtccatgaagaacgcgctcagcaccttcgatcaggtcgtcgccttgaccgagggcggcccgaactcctccaccgaaaccgtcacctacctcatttggaagggtggcctgaccggtggcgagtactcctaccagaccgcaaacgccgtgctcttcttcatcgtgctggcgatcatcgccttcgtgcagctgcgcatctcccgcagccaggaacagatttgatttaggggaggataagaaatgactactgcaacagttaccccgtccaagtccggcaagcccgccaagttccgcagggaccacaagatcaactggtggctgaccgccgccgtggccgtgctgagcctgaccattctgatcccgctctacttcaccatcgtcaccgcgctgaagactccggccgaggccggcaccttcgccctgcccacctcgtggcagtggcacaacttcgccgacgcctccgccaaggtcaactacccgaaggccgcgctcaactccgcgattatcacggtggccgccgtggtgctcaccttgctgaccaacaccttcgtggcctacgctgttgcccgcaacatggacaagcgcttcttccgcttcctgtactacttcttcatcgccgccatgttcgtgccgttcccggtcgtcatgctgccgattgcgaagcagatgggctccctgcatctggacaaccaggtcggcctgatcatcctgtacacggtgcttggtttgggcacgaacctgttcatcgccaccggcttcatccgctcgattccggtttcgctggaagaggcggcccgcatcgatggtgcatccacgtggcgcatcttctggaccatcatcttcccgctgatgagcccgatcaacgccactatcgccatcctgaccgcgctgtgggcctggaacgacttccttctaccgttgatcatcctgaccgaccagtcgaaccagaccatcccgctcgcccagtacgtcttcagctcgcagttcgccaccaactatccgatggccttctccagctacctgatggccatggccccgatcctcgtcgtctacatcttcgcccagaagtgggtcatcggtggtgtgatgaggggggcggtcaagtaaaacagcgcaggcgctgctttacttcaccgcgtcgagcgagacgagccgattaaggaaacagccccgtgggctgtttcccggcccgggcggccggataggtcgcgtactcgcgaggtcatgttgggtctggccgtaggccagtcctgaattgcaggactctgtgaagtaaaggtccgcttccacccaagcctcctccggctctcaccggaggaggctcttctgtcctgttgccatactggaaaccgccacaataaaggcgacggtcggttgatgtggcggtggcgcacaaaggtcatgtggttttgctcgttgtgcgaatgaaaaagtgacgaaaccgtacggcttacggtgcaattgaacgcatctgctgtgtcgccgtgccactggcttgtcccggtccacatatcaaccgtttgacgcgcgaaccgggacagaatccgctgtcccggttcgcggtttcgggcgattttcacgaaccgggacaattttcattgtcccggtatgaatgtcaatcgttttatgtgaaaaccgggacaacatgttgattccgggatcggctctattccgccgattttgtattacggagcatatgaactgcggagattggcttgtccctgtttgtaaaaaaaggacaaaaatcgcgaaccgggacagcggattctgtcccggttcagacggcaatcgattgacatacgaaccgggccaacgccgaagtccggagcggttcccgaggcggggtttgcttgaaatccggtgtgccagcgaaatccccaccagattcccgcaggcgtgtcaactaaatcatctatccccgcaccagtgggttcaagcagacaatccaagcgcgcccgaagttgctcttgcgcgtcgcaatcagaagaaccgttaatatgtgagctgccgcaggtcaggtagattatggtggcgaagtggcggcggaacaagcgggcgagctccttcataggttcgagcctcgagtgcatcatccacgagcacaggcgatatagccacacccacgcctcgaacaggagcatgaaccctctgccgggctcgaagccgatcgtgatgtgcggctcccgcccgtcgccgtcggcgtcacggaagtccgcagacccgaccctccaaggcgaccgcagccgaagcgcggcggtgaacaggtgagaggcatccatgcctccaacctacccgaccaacatcaccccacggcacagtcacccaccacaaacagcgaaagggcccatatgttgctaaatagcatgtgcagcttatgagaattgagccgtagcagtgccttccggctctttgcagtttttgtttccggcacaccaacgcagttccccaatggaaatgtaattcagcgctttttagactatgagcaacaggcaatgtagaccataaataatggaggagccaacgatgaccacttcacaacgcacagtaattccagattccatccgcaccaacggtgccaccccaaatccgtggtggtccaatgcggtcgtttaccagatttacccgcgttccttccaagacaccaacggcgacggcctcggcgatctcaagggcattacgtcacggctcgactatctggccgacctcggcgtggatgtgctgtggctatccccggtatacaagtctccgcaagacgataatggctacgatatttccgactatcaggacattgatcctctgttcggcacactcgacgacatggatgagctgctggccgaggcccacaagcgcgggctcaagatcgtgatggatcttgttgtcaatcacacttccgatgaacacgcctggtttgaagcgtccaaaaacaaggatgatgagcacgccgactggtattggtggcgtcccgcccgtcccggcaccactgccggcgagcccggtgccgagcccaaccagtggggctcctactttggcggttctgcatgggagtattgccctgagcgtggcgaatactacctgcatcagttctcgaagaagcagccggacctcaactgggaaaatccggctgtgcgccgcgcggtatacgacatgatgaactggtggcttgaccgcggcgttgacggcttccgcatggatgtgattacgctgatttccaagcgcacggacctgtctggcaagctgcccggcgagtacggttccgagctggacgatctgcccgtgggtgaggaaggctattccaacccgaatccgttctgcgcggacggccctcgccaagacgaattcctggccgaaatgcgccgtgaagtgttcgaaggccgtgagggcttcctcaccgtgggcgaggctcccggcgttaccgcacagcgcaacgaatacatcaccgaccccgccaacggcgagctggacatgctcttcctattcgagcacgttgattttgactgcgaaggcgtcaaatggaagccactgccacttgacctgccgaagctcaagagcattatggccggttatcaagcggccgtgaagaatgcaggctgggcaagcctgtttactggtaaccacgaccagcctcgcgtcgtttctcgttggggtgatgactcctcggaggaatctcgtgtgcgttcggccaaggcacttggcctgatgctgcacatgcatcgcggcaccccgtacatatatcagggcgaagagctaggcatgaccgacgcccacttcacgcgcctagaccagtaccgtgacctcgagtccctgaacgcttaccgtcaaagggttgaggaagccaaagtgcagtcgcccgaatcgatgttggcgggtatcgccgcgcgcggtcgtgataattcgcgtaccccgatgcaatgggacggctctgtctatgccggtttcactgcgccggatgccgctaaggagccatggatctccgtcaatcccaaccatgcggcgatcaacgcggccggcgaattcgacgatccggattcggtatatgccttctacaagcagctcatcgcgctgcgccacgacatgcctgtcgtggcggccggcgactggcatctgctcgatgcggatgacgcgcatgtctacgccttcacccgcaccctcggcgatgagaagctgctggtcgtggtcaacatgtccggccgaaccgttgatctaccgcgcgaaaccgccgaactggccgccgccggaatcaccgagtcgaacgtggtaatcagcacgtatgatgccccgcacgccgtggcctccctcgccaaccgtgagctcgatccttgggaggccgccgtcattcagctgtagcgattggagcgattgtagcggattgagtacctttctccgttcacagagatacttcagggctattgcgaaatgctatccgccttgaaagaggtaccgtaacgtcaaaaccccgagtataagcgttgaaaaatcaaggcttatacccggggttttcgatgctcggtacccctgtgaaaagcagatagctgtctgcaagaggccgaatgtacctctgtgaagcgagatagccggtgtctctcggcattgtggtgcttacaatggaaagctatggaacaaaaggatgttttgaaggcgctgcagcgtgatcatgcagccgaactgaagctggccgccaaacgtctcaaagggactgcccgtcatacggaaattatcccttcgccggtattgagcgagatgaccggtcatgagattctcctgaagccggaaaacctgcaggtcaccggttccttcaagattcgcggcgcgtacaacaagatcgcatcgctcaccgaagagcagatcgcccgtggcatcgtcaccgcatccgcaggcaaccatgcccagggcgtggcctatgcggcccgtgagcgtggtgcgaaggccaccatctgcatgccgcagatcaccccgccgctgaaggtcgatgccaccaaggcctacggtgccgacgtggtgctgtacggcgatgtgttcgatgaatccgccgcccacgctgctgagctcgccgacaaggaaggcatgatttacgtgccgccattcgacgattacgaagtcatctgcggccaaggcaccatcggtctggagatccttgaagacgtgccgaacgtcactgacgtggtcgtgccgctcggtggtggtggcctgggtgccggcgtggcgctcgccatcaagacattcaagcctgaagtgcgcgtaatcggtgcgattccggagggctcaccggcctggaaggactcgctggccgcgggtcgtgtgtctccggctgaccatgtggttacctccgccgaaggtgttgcggtcaagcaccccggcgacctgcccttcgctctgattaacgagttcctggacgatctggtcaccgtcaccgagcgcgacatcaacgaaatgattctgctcatgctcgagaagcataagctggtggtcgaggcggccggcgccgtttcgctggctgcgctggaacacctgaacctgcgttcgcgcaagttcgccgccgccaccggcccgcacgtggtggttccgattatgtccggcggcaatatcgacaccgtgaccatgggtgcggtgattcagaaaggtatgatcgcccgcggccgcatcatgaacttcgaggtcgagctgccggatactccgggccagctcgtcaaggtggccaccctgcttgccgagcagcgcgccaacgtcattcagcttgatcacgaccagttcaaggcatccggccactacaccaacgcggtgtctctcggcgtcacggtcgagaccaacggccccgagcacatcgaccgcatcctcgcggcactcagggaagccggattccagcccaagcgcatctactgattccaataccgctggcgggaagccgcgcagaagtgtgctccaatacctcccgctggcgggaggtggcgcaaaagcgccggtgggtggttaaccgacaatcatcagttgcttaacccacccaccggcgctttcgttatgctgagggctacttgttctccgcaatcgtctcgtccaccaacttcggcagggcaacggcgatatcctcatgaatcaagcggctcgcaagatggtcatattgcgtgtgacccatattcataatggtgatgggcacgcccgcctgcgcggccaccggcacaatgctcgccgccgggtacacctcaagggtcgatccgattacccatagttcgtcggctttggtggccagactgtacgacttctccatcgcgccgtccggcaacgcctcaccgaaatacaccacatcggttttgataatgccattgcacggcatatcgccacgatacttcagtttgcgatggcaatgtgggtcgggctcttcatccaaacgggccatgatgtccgccgtggcatattcctgatggcacttcatgcaatgcgaggtgccgatagtgccgtgcaggttcacgatgacgttgtcgctgttgccggccttctcatgcagcgcatcgaagttctgcgtggccagcagcgtcagcatgccggcttgttccagcttgaccagcgccttatgcgcagtgccgggctgcgcattccatactggcgattccttttgccagcgccaggagtactcgcggtcctctttgttgcgcaggaacagatcgatgtcgtaaacgctcatttggtcaggatgcttggtccacacaccgtccggaccgcggaaatcagggatgccggcggacgtggaaatgcccgccccggttaatacagcaatcttcttggtcataactacaggtatacccgcgattcatgaacgaaatccgatgacggagcgctgtcatgcgccgattgtgcgccggcagtgtggttgccgagagatgaacgcagggccgacaagctgaaaactctcgcgacacgccagccgaatagtggatttgatgcttttcagaaacatttgaggggttaacctagcctcatcagagcaaagtgggctctgtgcgacacgccgagggaaccgcgctgttatgccgattcctggggtttttgtgcgccttgatttgcgtgaatccggacatgcgtgtaagttattcacctgttgccgctcagcgcggcgggttccttcctctggttggtttcccgtctggctggtgtggtggtggtttgagaactcaagagcgtgtttgtactacttctttatagtcaatgattgccagttcattcctcgcctgattgcctgtcgtggtggttgggtacccgggagggtttgatgaggggtgagcaacgactccgacaactacacaccctcaaataacccggaacgttaagccgggaaaccacatgggacacggccagccaccaagaccccgaaccgttccccggcttaacaacaaacccggcttaatccgagtggatgatcggcgtctcgccgggcctgagcgtggcgcacgcggactcgagcatcccgttggccaatgcggcgttggggctcgtgccgatcgtccaggcgaccggcatgccgtcgtagcagtcgatgaccggcgacaggtacaccttgcccgccgggatcctgaactcggtgatgtccgtgacccacagctcgttcgggttcgcggcgtggaagtcccggttcacgagattggccggcgcgccgccgatctcgcctttgtaggaactgtagcgcttcgcgctctcggacacgggcacgagcccatgggccgtcatcaggcgcatgacgcgtttcgcggagacgacgatgcccgcgcttctgagctcgaggtgcacgcgcttgtacccgtagcggcgtttgctgttctcgaacgtctcgcggatctggattggctacaatgtattggactggttcatgcgggacatgacaacgaaggagttgatcatcatggccggtccgaatcgtccccgtcattgcgaggaggagttcaagaggcagatcgtgcggctgtacgagaacggcaagccgtcgtcgcagatcagggcggagtgcggcatcccgcgttccacgctgcagcgttgggtgtaggggatacgtaacagcggctccacgaaagcggccgacaaccgcactcccgaggagaacgagctgatcgaattgcggaaacgcgacaggcagctggagatggaggtcgacgtttcagaacaagcggcgccggtattcgcacgaaagtaggcgtgatacggtccgacgccggccgttgcccggtatcggcgcagtgcgggatcctgggcgttgccaagtcgacctgctactgggtgctcgaacaccccgaggccgagcgcgccgacccttacgagaaggatgtggagcgcgtgtggagggacagcggcaaggtgtacggggccaggaagatcaggcacgccctggggcacgagggcgtgacgctgtcccgccgccgcgtcaaccggatcatgaagaggaacggcatggccagctcctattccaaggccgcctataggccacgcccggccaggccggacgacgacccggctcccaacatcctcgcccgcgagttcaatggctatgcgccgcgcacccatctggcctccgacccggcctacgtgagggtcggcagttcgtgggcgtacgtctgcctgcccggcgacctggccaaccggcagatcgccggccattcggtcggcgtcgggcacgacgccgatctcgtgttggccgcgttcgccgcgctgcgcttcccgctggatgagatcgaggtgttccacacggaccgcggcggcgagttcaccggggaacgcatcgaacgcatgctcgacgtgttcggcatcagacgttccctttccagacccggcaacccatacgacaacgcggtggtcgaatccaccaaccggctcgtcaagaaggaactcatccacaggaacgtctacacgaacgtggagcaactacgctcggacgtcaaccggtacgtgtggtggtacaaccaccgacggctccactcgaccctcggatacctgagccccgtggagttcacacaacaaggaaaaaccctctagaaacagtccaacaccctgttgccaatccattcaaatatgagatcgttcagttgtacggaaatagcaaggacaccaacggcccaatagcaacccgtaccaaaaacagcaatagctccaaattaattttcccaataccagttttcaaattcttcgcgcgtacgttctaccgaagtatcaaattcttctatagaacggcgcttcttatagaactcatcggtagagcatatgacgcgggcaggagcacctcctacaacacagccttcaggaacatcctttgttacgacggatccaccagcaacaatggagttagagcctattacaacacctggcatgataaaacaccccccccccgatacaaacatcatccataatttctatggtatcgaaatgagttttcagcggaacaaagtctttgtgattgcaatatcgaggattgacgttaagaaagttcgagaaaatatcatgattaatgaaggttacaccacaggcaatagatactcgatcatgtattgacacaagccacgagtccgacggaagagatgtaggttcaaaatggcattgctttcccatgtgatgaaaaatatgatgtctgcgaatataatctgcacgccatacgccatcctttcgacgaaaaaacgtcttcagcaaaagtgaatgaagagaaaccattctccgttcctttgaaaacgttctacttttacccataattcctccgactgttaatactattttctacgactaatatattctttagccgtgctgactaggtagttaaagttttcgtttttgcagatgacgttgaccagaacgtaaacaaatccaccgacaataagctgaagcaatagcaaaagtattttgttgatctgcagatagccaatgccaaacaccgcagcgcccatgaccaatgcctgaagtacattggaagcaaaatcccaatataaatccttcagcttgtaaccaatcgtcttattgcaacctatgctgtagagtatcaccccaaggatgcctaccagaacctcggaaaatgcgatataaattgttccaaagcgaactgtgacaatcagggaggcaagaccaaaaatcctgattgggatatccattttaagcacgaggtcacttcttccaattgctttaatcgcttgcagagatgcagtttgagcaggacggaaaagcaaattgatgcaaataatttgcaagaaaggcacaatgggcaaccacttatctgtaagtaatacggatacaaaagtagtgccacaggcagcaaagccaacgagcagtgggctcatgatgtacgaagacatcttgatggcgcgtctagtaatcgctctaacacgctcaacgctggcttgctcgtgagacatagccgggaaaagcgcgctactcattgcggcgtctacattaacgacaatcagattcggatagtagctgccacggtcgtaataggcgagatccttagcggaatagaccttgccaattaccaggcttctcaggttgccataaatagtcaccataagactctgaatgaggagtttccacccgaaacggaagagacctctaagtctttcaaaagaaaattcaagctttggacgccattcgatgatagttcgaagggtgaaggtattaataatggtattggacagatattgagctaccaaagcccacacgcccataccaaaatacgccattcctatacctatgatcgccgagatcaaggttcctatagtcgtagagtagaagaacttcttaaagatcatattcctagacacataggcctgctgcaccgaattaacggcagcaacgggaagctgcaacgccagcacacgtagcacaggaacaagaattggcatcttatagaaggatgcaaccaaaggtgcgataccaaagaaaatcacaagataaaggaacgttgaaaaagctatgccgaaataaaagaccgaagagaaatcaagtccatcagcatctttcttttgaatcagcgcaaccccaaaaccatcattaacaaaaacattagcaatggtgataaaaatagttaccagagtaacagttccataatcggatggcatgagcaaacgagctagaataattgtaacgataacagaaactagctgcgaactcattcgctcggcaaatttccaaaacaaaccactgataacagagtatttcatctgtttattagagtcattcattcctgtaccaacacttttctatgcgaatcacttctatcggaaataggcgtcagattacggacgaaataagaccgagagacttctcacgctccgcattaatatagctattgatgaaggtatagtcccattcataattcagcatgtcgcgagcgtcacgtgtattgtccgataggagttcatacattccaagtcgcttcaagaagttatccgccttcgccaagatgaaatcagaagcacagaaagccatcttcttattaaaaattagcgagaatgtcaagccgtggaatgtgctcgtcgcgatagcagaggagtaacggaagaggccaatccattcaaaaggtgtcaaatcggattgatggatgaggacatcacaccaatcatattggtcatcattgcaatcaaggcaaatgatttgaagactgttatctttagcatatgaacaaatctgctgaataaactcatcagagaaatcctgaccataaacaatcagataatcctcatactgcggtttaactatattctcgtcagtagtgaaatcccataaccaagttggatccaagacaacctctggacgagttccggtaatgtcttcgacgatatcggcggagtttttatcacgaaccgtgatgaagtcaagggaacgcactccgtcgaccacatactgaggatattcagaaccgcgtttaatggtgccaaaagtagcagcataagcgactttcttgtcggcctgaatccccacaccaaacagtttggggtcatggttgaaaatttcgaacgaatagtcccagactatatcgctgccaaacacgacggtattaaatgtcgtacttgcaaaatcggcggagctcattctctcggtatgaggaatggagagatagtatccagggaacgtttgcttgcgatgattgtagtttgaattcgggttaagaacatctactaaatttttgtagaaaacgggtttgaagaaattatgtccgatctccttcttgtagtagctgttgtaatgcttctcatcaagatatgcaatctgtttaatgtctcgaccagcacaacgcttatcgagaacacgttgcagtgcatatgcttgggcaaaagtaccgtagtttggcacatcccagaaggtcaaaatacccatatcataagtggacataattcactcctttaccgtttgatcagaaagaacgtaataagacaaaggaaaaataaggaacatcacagggaatgtgaaaacttccgttgtacacataatcaaataagccgatacggcatacaccgcgatctgcgctacctttttcggccaatattccagcgactttttgattatgagagcgatgataacaagcaacagtgcaagtgccactaatccaccttggaaagccacctgaagaatttgatcgtgacaatgcgttgcaccgacccacactccactcgacgatgaacccaaatagccaaccattgcatcattggtgagcacaccgtaccccaatatgggattagcggttatcacacgtagggcattgtcccaaatgttgagtcgtccggtaaatgtcatgtctttgcccaaagtcgacaccaaaggagcaaaaatgctatctgccctgaaaacaacaatcaaaagccatacgatgacggagataacgacacttcggattggagtaaatactagtttgacctttggaataatcatcagcagagagaacagaacgatacccacaatgccagttgccgagccgtgaataaattcagttacaacaactgcagccgttaatacgtatcctctagttttgctccgagtaagagcaatatacgcccaagcaacaaccagggcgggaaacagccactgcacaaaataattgtctacgcctaggaaccattcttgggaaactgcataaccggaaaccgatctgctgtatagtccgttaggcgcaactaatacagacagaagattcacatagacgcaaatctcacaatgcaatattaggacgcgaaccagcgtatatacatcgtttcgatataggtcgaagataaggcacactatcatgattcgcagcaatgacaaaattgcattatccatcaagccatgagagattgccgttgccaagaggatccacgcatacatgcatgccgaaataacggttacaattgaaagagctttgcgtgaaaaaacaagacgacaaagaagatatgcgtctacgacataagttagtaacctgttcaaatgaagcgacgtcgtaaagtaatctaccgatatcggcatgaataccggaatcagcaataagaataggatgactttcctttttgtgatatgcaccgacattgcgttcaccctagagagcaggacgtaattgtttgattactttcgcgggaataccagccgcgaccgcataggccggcacatcatgagtgaccaccgcatttgcgcctatgattgcgccatccccgatgttcacaccggaaaggatacacacattacggccaatccagacgttcttaccaatacacaccggacccttactcactatttctcgatcattgggtgcaatatccaattcggctgcaatatttgcaccatgagagttatcagtaataaaggcgttaattcctagtagacagccatcacctatggaaacatgatgagcgcaggaaacgtaggaataatccgccatcacgacattagacccgatcagcaatgcaggatccgaataccgttccgttggccatacttgcagcgatatggacttaccagcggagaaattcttaccaatatggataaatccttcaccgtgaattgagaagtcaggtccaacatgactgttagtccccaaatcagcgattcgagaagaagataagagccagcgcatcctgctaaatagtctatgaagcttcggcatttcaattccccaaacatttctcgtctataagattcattaattcaagagattccggaatagctacttttctacagaacaacgcattactgtgaacgatgtcttggtattctgaagcttccagagtcaatggcaattgttttgcagggcgtttgggataccattcaacaaaacgcagtgaattcctggtttctatgttcagctgttcacgcacaggcctgaggactgtagaataaacaatctcatccgtgcagaaggtatatttaaacctatcgagataatccttatgagactgaagataatccaataagtaattaattgatttacgactaagagagaaccagttccaccctccatatatcctatccataaacttcaatggacgatgaatcggccataacagcagcttgagaataccgggaacatgtagtttacgcgcgataggaccgttgaatacgtccatgaaataccagtgctcaagtctctcaatataaggcccgacccttctttccaaggcttcagactccgtatcgcaaagcatatagcttttgtcgccgttctcaaacacactgtcaaattcaccgtttgagacacacggataatcctgaccggaaatagagtggaaataagcgaaattcaactcgtcctgataagaatccctcaactgggaaaccgtgcagtcaatttgagaaaagccaccgtgaattatatttcggtgtgtaacttgacgaataccgcttatttcgcttattgcgcttttaaactcatcctgattcttggccttgctgtcaatattgatgtaaaagaaatgattgctactctctagcctttttagtattcttctcagtaattccggatacctatgagcttgaataaggaatacatggttcttcatctaattaccttcgacgatcatacggtaggttgaatcagcacatgactcattactttggtagccccaatacagcttctgaggaactgccggctttcgtcttaagtattcttcatgtcccttgagattcagcagacttactaattcgaacatatttcccggaacattttgtattttggaaatagcggaattatctattccttctaacttgcagagcataaataaggcatcaataaagaagtagatggggtaaccgccgtatttcaagtaataggattggaacacgtaatccattgcttgggttagtacgctattctttcgcgacgaaataaagaaaccggaccaattgcagtactcgcctttatattgcaaaaacttgttggaggtcgaaaaggccaatgattcgaatggcttttgtgcaagattgctcaacaaatttgatggttcggcgaaaaacagtgtcgcatcaacccatgctccaccattattcttcaatacattaaaacgaagaatatcggagaacgtttgcatgcttatcttttcgttactaagtccgtcaataatcctctcatctatatccgtaaagtcgcggaaattattctttgtcagttcgatgattttcacgtttggaaaaccagtttgaagtgactttcggcagcttttcactatttctggggcattctcgaatccatcccaccataatacaaacaccttttgcggaatagtttccgacacaatattggttgtctgacctctatatttttggagcattggatgaatttggtgctcaagtttaggcaattgctgatttaaatcagtaaaagcattattccgagtttttcgaaaccactgcctttttttagctctagcaagacctgacgagcgacaatccttaaagaattgcagaatatctttacacgagcgagcacacgaacgcaattgctgctttccgccgccatagatatatcgatataatttgcctctcaatgaatatcgttcgacccctatccgcaacctatctttagaggtcgaactcaatttattcatcagggacaatgcttgaacatagtctctatcttttctgacctttttatacgctgaatagaatgtcttcgcctcatcatcgcaaagtcgaattagcaaagattgaatctctctatacaacaaagcatatgcggatgattccggcatgccatcctctctcaggaagtcccgcaaacgcacaaaagctttttttgcttgagcaacatgagagtctgcagaggaattactcatcatcgaatgatgagcattccccactgtgtagtaataagaattcacaaggtcaaggcaacgtacggattttgccgcggaaagacacaagtaagtgaatatggaatcttccccaagagtaatatcggtacatcttctaaatcggggaagtatacgctctacacattccttgcggtacaacttattccaacgagggatggcacataaatcagacatccccgcactatcaggagaaataatatagtatttgcgcaaaaagtctagcttctcgtcttgataggttgtttgatttctcagggggaaagcggtcaaaacctgtccttcagagtaaaaatatccagcggatactacatctactccattatccattgctgcaatcagcgtggaaagatagtcgtatccaactgtatcgtcagggtccacaaaggcgataaagtccccacacgcactctcaatcccagtgattgtcgctgaaacgagtcccccgtttcccttatgcacaacagtaactcttggatcaagatcactatatttttccaatatctctggtgaatcatcggttgacccatcatctactgcaactatttggatatcttccaattcctgattcaacaaggcagggatggaacgatccaaatattgttcctgattgtaaacaggaaccacaaccgatactaaaggtttctcgtctggcatttttggcttcacctactcagcgatattttccggataggtcgggaactcatcattttcgataagtgccttacggattgcttccagattcccatagccaaagcgctcatctggctcgaggtacccgccttccgcccattcgttccacgcgtacataaaaataaagtccttgtggtaaacgtcttttgctcgcttgatctgtgctgagagatactttttaaatttctccggcgtatcacctacgaacgcttgccctttctctccctttcgtggggtgttatcccaagtgacaaatgctcctggaatgttcttttccgtttccggcttacgttccagtactttcttccatacttcgtcgtaatcgacttgcacacctttattgaagaatccagcaccataacgcattagatcgaatccgaatctgcgctcgacaataccggcaagcttacggcgcattgctttgagatgcgggtgagtgttcttcgtcatgtcatgttgcgcatacaacggctggaactcgatatcgtaatcaaaacgcgagtcgtccttgtctgtctgaaggtcgaaatcgatgttctggtatgcaacggtcagaccggggaaaccattttctttagcaagctcctgccaataatcaagcatctcattcaggcagccaatgacttctggacggtagatgaccaccagcggtttgctgtcttcagtaatgtaacgagaatccttaaagaacggcaataagtagttaaaatggtcggcccattcctttttctcaccgtaatgttgaggaatcaataccttagtctcacccacccaagccttggtccacggttcgtttgcccagcagatgcagaatggcatatcaacatccggattgtggagcatgttctccattggcttttctagcagcatcttaccatcaaaccagtagtggtaataacagaagccatacacgccatattctcgagctatctttgcctgccatacttgagtttccggagacaacaggttgtagtagtttttgcccaaaggcacacgaggctgttcatgccccttaaacagcggcttagccttttttacattcacccattcggtaaatcctttgccccaccactcatcattctcgggaatctcatggaattggggaagataaaaagcaataatcttcatttaataagctccttgaattttgatttcacgacgactaatgaacattccactattaatgacgaacgctatttatattcgattaatttcctcatattgcgctatgatccctattcataactgtggtatagatatcaatcatcttttttgtataaaattggcctaggcatctctttgagatgtattcggcacaagcattctgcattatcttgtatgcatctttatccgtagcagctgcttgacgtagtatgtgccccaatccaaccgaatctgtacttccgaattggaagcccgtcttcccctccaccacaagttcggggattcctccgatattggcgccaatcactggagtttgagcggctaaagactccaatccagaatagggcatgttctcacgccattcggagcacaatacgctgaacctagcgttgccgacttcgcgttggagttcttctccggtcttataacctaacattttgatgcggttttctgcctctgcaccggaccgagcgatgagctgttctatggtctcgcgttcaggaccgtcacctacaatatgcaacgtccagtcatgcgataattcaggcaaagtttgaaggaacgccctcaccaatgtaaggatgcccttttctttggagagtcgtccaaagaaaaggaaatacggttcgaccgtatcgaacttgttcgtgttgacaaccttgcgggccatatccgtctggctatcggtcaagaagttctgcattgcaatagtacggccggcataaccaccagcatcgagtttgctcttcatgaattcgctcggcgcaatgattttgtcgattttgtcgtacgaatgatgatatttcaggaattccgcttccaagaacgccaaaccgctcttagctttcgatcctttaacacaagtcttctttaccgcgtggaagaaccgacggtcaaggcagtcatcacagactttgccgtaaccatccaccatcgtgtatgccgggcacaacaggatgtaatcgtgcgcagtataaaccactggcacatggtgattttttaaataaggagcgtccaaaatcgacaacgtaagctgtcgatgcacattattcatatgaatgacatccggcttgaaatcttcaagcaatgcttcgaatttgcgcttcgcctcgaaggagtacacaagggtggcggcttcctttaccttttgaaatgccgaaatcttgcccacatagtctttttctgaaacgaagtatttactccaatagctcggttcgttgttcggatgctgcatggaaaagaaggcaacctcatgtccaagcgcgcgcaatccctccgcaagcgcgaagaaatatgtttcagcaccgcctttgcggtagaaatatttgttgaccagtaaaatcctcatttatctgctcctcggtagagcttgagggtcgcttgaacaaccttgtcccagctatagcggccagtgatatagccggccgcgccggtcttgatttttcgtaccttacccacgtctacgagcaactcaccgagtttgtcggtcaaatcgttcacatcgccatgtcggaacgtgactccatgcatcattccggactcatcacacagcacatcagcgcattcagcaatattggaggtcaggcagcagcagccgtaagccaatgcctccaataggctcattggcataccttccaaatcactgggcaatacatatatgtatgcgttgctatacagttcttcgagttcacgtccttcaataaacccggtcagaataatgcgctgatctccggtagcggcctgcttaatcgactcgtagtattcggcggaatccgatgcgccgcccgcgatcacaagcttcttgtcagtgtctaatcgcttgaacgcttcgatgaggtaatgcacgcccttttccggtacgatgcgtcccaagaacagaatgtaggaatccttctccagactccacttgtcagcaatcacgtcaggagaaacggattctaccggcgcaatgccattgggaacgaaacgcgtctcccgcccgtatgtgtctttgaaatactgctgcacaccacggctcagcacgattacctcgtccgcacatttcgcggcagtgcgttcaccaagcttcagatacatggaggcgaacctgccccacttcgcacgctgccaatccagaccgtgaatcgtggcgaccgtacggatgccggcccaatgcgccagacgcaacggcacacatggtccctccgcgtggtaatgaatcacatccggacgggccttgatcgccttcaacgtggcgaagaaagaggacgtgagggcggccagtcccttggcgtcgatggtcgtgacgggaatgaccttcactccctggtacatatacggcttgtcactggtgctcgactggttgtcgaactcctcaccggccacattgtggcctttgcggttataaaccacgacctgctccccgcgtgcagccatacgtgtagccagttcgtccacaacaatctcgatgccaccttcgcgagacggaatgcgtttgtggccgatgaacgcgattctcatggcctcagtccttcttcgttttttcgctctttttgtgctggatttggcgcttcctgccgttgtcgtcagactcgtcgccgtaatagtaatagccacccttctggggcttctccgtctcgccgtaattcatggccaagcccacgggatcgatgctcagtgtgctcagttcgcgcccggtctgcttcagcagtttcttttccgtcactcccaagccggccaccagcagcagttctggcccttccttggcgaatacggcggcatcattggccacctgcatgggggcggtatcgataatcacatagtcataggctccggaaacctgctcaaccagtgccttcatagcgcgggaattcagcagaatgctggggttcatggtttgttttccagcaggaagcacgtggaagttcggcttccagtagcgttgaatcgcatcatgcgatgatacacggttggtaatcagatgggtcaagcccactgcgccctcaatgccgagagccttgctcaccgaggggttgcgcacatcggcgtcgatcagcagtaccttgctgccgttttcggcgaatgcagtcgccaggttcacgctcagcgtggtcttgccttcggacggtccggtggaagtcaccacaatcacattggacatcggctcatcgggcagcacgaacatcacattggtgcgcaggcgtcgaatctcttctgcctcgcgggaggccgggcgggagataatcaccggcgacgtaccggcataagcctcattgcggctcagcgaccccagtacgggagcgtcgataacagtagtaacatccgaatcgcggcgaacacgggtgtccagcaaatccttgataaaggcaaccacgatgccgagaatgacaccgatcccaagacctgccgccagattgagcttgacgttgggtgagctgggggaagtcggagcgtacgcctgctgcaccacagttagattgacgggagagatgatcttatcgccctcatcgctgtaaatcgtggaagtaacctgttttctcaggttttcggcaaccgaattggcaatgctggacgcctgcttcgggtctggatcattaaccgaaatatccaccagcatggtgccatccgggttggaagcggtaacgctcgcagccaatccctttactgtggtgtcaagacccagatcgtcaataaccggctgcaatacagactcggtttttatcaattgcggatacgtttgaatctggctattgatgtaattggcgccagagctcagctcgactgcattgctggatgcgcccgacgcagccgctgaactgcgataagtggccaagagttcggaagtcgcggtgtattgcggagtgcgggtaaaggtgtacgcgcagattgccaccatcacaataaccagcgtgaccactgcggtaatcacatgctttcttaccgcattgaataaatcgagaatggtgactccattaccatcctgcatctgttcagcttcatccacagctatgctccgttcttccttattcacggttccaccttaatgtataggggttgcccctttaatcaaccaagggggtctgtctcaaaatcatttcattttcattggccgcgggactggccagcacatgcaccatggtctcgaaactttcccccggccgcaatgtcacggttttcacacccaccgtcagtccatcgtgcacagcgaactgatcgaaatcctgggtccaatccacaatgcgcccttcatcgggggcgtagacgtacagcaccgtttcgatctcccctgtacgggggttgccgttatggtcatagccgcgcaacagatccggagcggcattcacctcggcggcatcggccgtattcgtcagtttgatgtgaacggtgtattgcttggcgccactgggataggttttgtcatatgtactggtcacttcacgcttcaggtaccagtccatcttgcccatggtggcatcgttgaagtacacacccgtaaccgaatgagccggtttcgactgcaattcgccggcgatggtcgtacccgagatacgccgctgctcatcctcatgaacactccatacatacagatggccgtcggatacggactcctggaacgtttgcaccagctgctgattcttgccgtccacattcttgagcacatgcgtgaagatctcactggccgccatcgtgaagaagtcggtttgctccgcctgcgtatcggtatcaatataaatctggttcagaatccgctgctcggcattgtcgccgctcatcaccgtgccgtcggagagcgtcacggggccggcaaccttcaataaccgctgcaggaacaccgggtccacgctgatgacgccatccacaccgtcatgaccggctcgatgccagatctgacgcgcgatatcagcaacgcgcgggaaatcgggagtgaaattgatgtccggatagtctgtggccatcttggtggagaagagattgcgttcttccgccgtcagtacgctcgcggcttcatcctggctgaacagaccattccgaggcggatcgccgaacgtactcatgctgattttgcctgcatcgatggtgagcgtggcccacgcagttggaatgcctcccgtggcacgcagctcagcattgttctgtgccagcactaggtaggttcgcgggccactgctactgccctcgctgctatccaagtcgaacatcttgggcagcacatccgccagccgactggccgtatccgtcaggctggcaagctccttgaacttgctacgcccctgctgcaccgcctcggtaatctgcggaatatgtgtatcgccaatcttgcccatgtctacgctggcatccgccactactccattggcggcggaaagatcctgtgccacgctggccatatcccccagctgaatcgtgccgtctttgataccgatgctgttgaaatccaaggcctgtgccgccttggcaagcttcggcaatgcgttgttcgacacgtcttccaaaatgtgcaccatgtctcgcgcggccttcacgtcagaaccgtaatagggcaccaatgtggccagtttccataccggctgcttggtctgcgcatacgtggcgtcgatatgctgggagaatgcttcaatgctggcttgcgctttgtcggtgtcgccggcttgaacttgtgattggatgcggcttgcggcctgaatcgctgcttccacttcatttttcgctttgagcgcggaaaggccgagccacgccgcgagcgctgcaataatcaacagcagtgcgccgattacaatcagcaccatccgaatgcgctttttgcgcttgatccgcctgatatgttcatggctcatacgccggcggtgcttacgccgttctgccgctcggacgtcttcagcaagtacctcggggtcaacatacggctgtatcacttggcgatcatccgcgtttttcgaccgctcggagggtgccggcggctgaggtatttctggtatgttcgaatcagtcatagatatatcgacttatctttctgtaatcacgttcaagggcggtgcggcaagggcgcggcaaaactgtgacagcgaaacgggaaggaatcagtacgctcccttatggctcagcactgcacccaccgtgcggaacagcagcacgatgtctcccataatcgaccagttctgcacgtaagccacatcaagggcctcgctctcttcggcagacaaatcggagcgaccggacacttgccacggaccggtgatgccgggcttgaccagcatgcgggtagcgtacagacggttgtaacgggcatattcctcaggcagcggcgggcgcggccccactacggacatatcccccatccatacgttgaggaactggggcaactcgtcaatggagaagcggcgaatgaaatgccccactttggtgatgcgtgggtcgttcttcatcttgaagatgaagcggtcggtctggccggtttcttttgcgagctccttcttgagcgcgtcggcgttcactaccatcgagcggaacttgtacatctggaacggcttgccgcgcaggcccatacgggtctgcttgtagaacaccggtccaccgtccgtgcctttgatggcgatcgccaccgggatggtgataatcagcgaacagatgatcgccagtgaagaaatcaccaaatcaaacaagcgtttggtcaaacggcgggctggcgtgtattgcgcaagacgttgcgtgataatcgtggtgccttggatagatcgaacctgaatctcatggttagaagtgtcagcggcggaagccagcatggcaatctccagaccgaacgattccatgcgcacggagaagatatcgtaattatccgaatagcgacgcagctcgtcagccaccataacggtctgcgcgttcatgtcaataatctgttcagcaagattatgatcgctgtactcgagtacgggcagctggcagcccccgttcttttgcatctcctcacggagtgtctcatggtcggtgctctgttcaatcaatccggtatcgggattgagatgaatcgggcatactgccaccgggcggtagttgagttgccgacgctgaccgaggaattgtagcgtacgaccaatgccgtgcggggaaccgatgatcaccgtgccataagcgtaggcgcccttgcgacgactacgcgtaatgaatgcacggctgacaatgcgttccaccatggtgagcaaccatccggcaatcaccaccaagcagagcgacgtgagggtcagacccagattgaagaagtagttgaacgcgcactgcaccacccagcacacgaccatgcctttgaccagcatcacattgagctggtaaccgtcacccataacatggcggtgataaatgccggcaacatagagcgaccacacccagaagcaggccacaataataaggtaaacggtggagtcaatcgtgaaattgaatctgctcgaatagagcggcgttgcctcatggcgcagattgagcaccgtagctccggcgatgatgtacatggcggcgtcgataagcatgagggcgagattgacgaagaatcgccagtacagcacgtggctgagctgcttttggcggatatctctgagctgagcggtggttcggtcaccgctattggcctgtctgctgcgtgtagacggctgaccgttactgctcagagatgacatctcaaacaccaattcttccttttcaaccgtatacctcaggtctcgcggctctcacttctctggattcccctgtgtacgggtgtatacggggttaccccttcaacatggtacagacatcacacccctaaccgctagggggggggtgttggaaaaccaacatagcgaacgtgatcggatagtaactacgttcattttgacgtctcgaataacgggactaatttgctctgcaaccgggcggccagtcatctcggcattgcatctcgacggactacccctgggtgtagcgtgttggggttgctttgagagactgcctgatgcgttgttgcggtcgatcagcgagagtggagtatgcacgtgagtggaatgaacggagctcagggaatcaaaaatcgtcgcggcgaactgcagcgggtgctgagccgcgaggaatcatatgtagacggcaaactcagccgggcggcgttcatctccatcgcgatattgacctttattaccttcgtgggcaacttcacgcagttgcagctgagttccgcgctgccgattatcgtttccgaattccacatctccgtaaccaccgggcagtggctcacctccgtgttccagctggtcatgggcgtgatggtgccgctgaccgcgtttctgacccgacgcttctccacccgccagatcgtcatctgctcgatggcggtgttcacaatcggctccgtgctggcatggttggggccaaacttcgtatgggtgttggtcgggcgcgtgctcgaagctgccggcacaggcgtgatgtggccggtgctgcaaatcaccgtgttctccatctacccgctgtctcgccgcgggtttgccatgggcacggtgggcatggccatgagcgtggcgccagccatcggccccaccttgggcggctggcagaccgatgccaacggctggcgctcgatcttcctgaccatgaccatcattggcgtaatctcgctgctggcggccatgttcggactgcataatttcggttcacacgacccttcggcccgcgcggacttcttctcggcatgcctgtcggtgatcggctttggcgggctgatgttcggcttcaccaattcggagacctatggattcgcggcaccggtcacgtgggggccgatggttgtgggactggtcggcattgtctggttcgtgctgcgtaacctgcgcgccggcaagcgctatcgcgaggccgtagccaaggacgagtcggcactcccccagccgccgctgctggatcttgaagtactgaagaatcgttcgttcaccgtcggcaccatcacggcatctctggcgttctttgcattcagttcgattctggtcatcatgccgctctacatccagaccgaccgtgggtattctgccacgatgagtggtctgatcatgttgccgggcgctatcggccagtgcgtctcccagttcttcggcggccgcgcgatggatcggttcggcgcacgacccgtggctttgttcggttcgattgtgttgacccttggcaccttgggcatgtcgctggtggcgatggatacgtggatctggtgggtatcgatctgccagttcatccgtcagatcggcatgggtttcctgctgatgccgattaccacgtggtccctgaattgcctgaacgggccgagcgaagtgtccgccggatcatcggtgacgaataccgcgcgtcagattgcgggcgctgtgggcgcacccgtgttggtgattctgatggaaacgtttgccgctttgcataagcagggcggcgcctccgccgtcgccgcttcgattttcggcattcaatgggcgctgcgcatctccgcaatgatctgcctggcaatggtgttgatggtgttcttcggcgtcaagggcgacggtgccggtcgcacgcgagacattatttccctgcgttcgctgcgcgaacggcgtgcgcggcgtatggctgcgaactgacggcagatccaaccattctcaacataataagaaaccccggtttccaacaccggggcttcttattatgttgtgctatcgcaggatttcagctggagtctattacgccctgcccatcagcgtcaggacaatcagcagcacgttgagcgccacaatcagtgccaccacaatcataaaaatcacgtgcttgacggttccatcagcccacttgcccatgagttccttgtcatgcgtgtatcgcatcagcggaatcacggcgaacgggatgccgatggaaagcaccatctggccgatgaccagcgcctgagtcgggtccttggcgaaccacagcacaatcagtgccggcaccagcgtgaccacgcggcaggcccacatcggagcgttaacgtgcagcagaccgtgcatgatttccgagccggcatacgtgccgaccgatgtggagctcagcgacgaagccagcaggccgatggagaagatcgtgccgatcaccgggccaagcacctgcgcgatcgcccgctgtgcgccgtcgatggaatccgtgccagacatgccgtgcagcgagttggcggcgagcaccagcatcgccagattcacggtgccggccagcaacagcgcccagaccacatcgattttcgagcctttcagctgcgttttgatcgacggcttttcgccgcctgcgtaatggtcgttcaccagcgtggagtgcaggtagatggcgtgcggcatcacggtggcgcccagaatcgaggcggccatcagcaccgagtcggtgccctggaagcgtggaatcatgcccttgaccacttcgccggggctcggcgggtccacgaacaggcctgcgatgaagccgaatgtgataatcagcagcatcacgatgatgatgcgctcgaacgtggtttgcgtcttgccaccttggaaccacagcatcaccgtggagattgcgccgatcaccagaccgccgatgaacagcggcaatccgaacagcaggttcagggcgatggcaccgccgatcacctcggccagatcggtggcgatggcgatgacctcggcctgcataaagaacatgaagcggccggcatcgctcatacgttcacccagcagttccggcagggatttgttggtcacgatgccgagttttgcggactgatactggatgagcacgctcatggcgttggcgagcaccagcacccacaccaacaggtagccgtatcgcgcgccggaggtgatgttggccgccacgttgccaggatcgacgtaggccacggccgccacgaacgcggggccgaggatgctggccagcgcatggtcatgcggctttttcttgccgtttgccacggttccagctccggctccgactccggcaagctggcgttccttctcgatttccggtgtttcctgttcgatgtctgccacggcgttcgtcatagtggttgccgcaatggcatctgctgcggtgtgtgttactgccatatcgtctgttcctattcccttctcccttcataccgggctcagttatagcgcgggcatgtttcccgcgtcaacagacggacaatctgcggacgattgatggatgactggcggactggcagctggcattccccgccatctcgctcatgaaatgtgacaaaccgccgaaaactcgctcatgaaatgaggaaattactagaaaactcgctcatgaaatgtgccagacggtagaaaactcgctcatgaaagtgtaaaatcattgatatagcagtaattcggaaaggggctcctcatgtatctcaaacgcaaagccgatgcctatctcaatgcatggaaatccgacccgaatcgctccccgctaatcatcaagggccctcgtcaagtaggcaagacagagactatcgattactttgccgcacacaactaccgttcggtagtggaaatcaacttcgttgaggaaccgaaatatcgtgcaatcactgcggacggttatggcgcggataccatcgtccgcaatatttccctgatcgacccagctaaaaagttcattccgggcgatacgctcatctttttcgacgaaatccaggcccatcctgatatcgccactgcactgaagttctttaaaatcgacggcaaatatgatgtgatttgcagcggttcaatgctgggcatcagctataagcaaatcgaaagcaatagcgtgggatataagaccgactacgaaatgcgatcgttggacttcgaggaatttctgtgggctcgcggatacgatgaggccgtcatcgaaagcatgttcacccacctgtgtgacgctacgccattctctgaagtggaaatgaacgtcttctccacggcatttatggattactgcgtgcttggcggcatgcctgcggttgtcgcctcccatatacgcactggcacgttcgagggaacactgcaattgcagcgccagcttattttggactaccaggaggatatccgcaaatacgcgcaaggactcgatcaggcacgaattctcaacgtgttcaaccatattcccgtgcaactcgccaaggaaaacaagaagttccaaatcagcaaagtcgccagcggagcgcgtttcaaagactatcgaggatgcgtggaatggcttgagacctcgggaatggtgaatatctgccgatgtatgtcctatcctgaactgccgttgaaaggcaattatgacgaaaacaagttcaagatatatttcggcgataccggtctgttcgtagcgatgcttgacgacgaggccagtgatgatctgcgggccaatcgtaatcttggtgtctataagggggctatgtacgagagcatcgtctctgaagcgctacggaaatccggctatgacctgtactactacaaaaaagaggattccacactggaacaggatttcttcgtccgcacgcgcgaatggctggtgccggtggaggtgaaatcgaaaaaaggcaccgccaaatccatgcggacgctaatcgcttcggattcttatccggaaattcagttcggcgtgaaactatccgccggcaatatcggtagtagcgaacacgtgttcaccgcaccatacttcaccacatttttgctccgacggctcctgcgcgcttatgacgaggggcaggcacctatgctcaacaatcctgagcggtagcccctattcgtctgcgggcacggcctggcccgggcaggtgtggaggacggcgagcatggcgtccttttcttgggaggtgacggtgagctggtacttgtctttgacgccaatctggcgggccacgtagtcgcaacggtagtcggcgttggtgggtagccagtaggcggcggaagccgaacccttctcctgattggccgggccgtcgacggccagcaggttgtaggggtcattgccgaattcatggcgtttggcagtggaccagtcgtgcgcaccggattgccaagcgttttcaagggccaccacatggtcgatctgcactttggcgctggtggcgcggccacgtacaaaatggatgatctgagcggtgtacggatcggccagtgtgccggactcgaccacacaggaaccggcgtatttgtaggtgatgtccgtgagatcacgggcgagcacgtcgtcgcgtacgtcgcagccattgccgtcgacgtcggtggtgcggaaaccgaaggaatcgcggtcgtagccggaggagctttggttgtcgtctacggcgagcgcgttcaaagtgtcggcggctgaaccggtggcagtgtagccacctgtgattttggccgcgtcggagctgacctgcggcagtagcaggccgatggtcacgccgattgctgcggcgagaacgatgagaatcagcacgcgctccagcggaccagaagcgttgaaacgacggcggaagtgggcgttacgacgtgccatcaatcacgcataggtgaaggtgagggggtcgtggccggcgcgggtggggccgtcgagggcgtcgatggcagcgtgttcatcggcggtcagggcgaagccgaacaggttgagattctccttctggcggtcagcatgcacggacttggggatgataattgtgccgttttcgatgtgccaacgcagaatcacctgggccgggctgacctcatgggcggcggcgatcttctcgatggtgccgtcgccggcgttgaggtcggcgccacgcgccatcggcgagtaggcctccacggcgatgccgtgctccttgcagaacgccaccacttcgcgctgctgccacgtggggtgcagctcaatctgattgacggccggccatgtgccggtctcctcgtgcagacgcttcagatcggcgggcatgaagttgcatacgccgagcgtgcgggccatgccttcgtcgcgcagcttgacgaacgccttccaggtgtcggtgctgcgccagtcgaacggcgtgggccaatggatcatgtacatgtccacgtaatcgagctggaggagtttcagggagttgtcgaatgccttgagcgcggagtcgtagccctgctcggagtcgcgcagcttggtggtgacccacagggtctcgcgcttggcaccggtgttgtatccggaggcggcgagcgcgcggcccacgccggcctcgttgttgtagccggccgcaccgtcgatatggcggtagccggcttccaacgcggattcgacgacggggaccacgccctcgtcgtcgatacgtagcacgccgagaccgacttgcggaatggaatgaccgtctttcaaggcgatgtccggcacgttggcggggttgatgtgtccgttggtcatgatgtgcgatgctcctttattgctgcgactacacgccactgtacacggttatgtgggtgatgtgcggccggtgtgcagggagcgtgcgggtaaacggcatgattatgaccggccttccatgtgggaaagccggtcataatcatgacaacatcacgctctactcctgcgaccggggcctcgtcccattgttcccggacgcgaatttgcctccaaccacaatgatgcccagcgccattgcggagcccctcttcccctcctctgggcacgaatttgtcccggtgaaaacgtcaatcgattgacgtttctaccgggacagaaatcgttgtcccggtacgcaatttcggcccatttttgagaaccgggacaaaccaattttcaaagtccacataccccgacaagcagaatcggcggaataccgccaatcccgagatcgacatgttgtcccggttcgcacataaaacgattgacgctcgtatcggggcaacgagaattgtcccggtacgcgaaaaaacgcccgttttttcaaaccgggacaatgatttctgtcccggtattaacatcaatcgattgatgcgcgaaccgggacagaatcgcatcgctacgccgagacagccgcatctggcagacgacagccgacagccagcaactggcaaccgcatcacaatgccgcatcagtctctatcaggagcgcttacgacgcaaagcaaacaaggccccgccggctgcaccgagaacgacgaccgcaagacccacggcagtcaccgcgctaccggtattgctcagcacgccagtggccttgttgccattcgcaccgttggtcttatcgccatcgccatcattgtcgccgatattgttcacggcctcggcgaccgtgcgaatctcatcggcctggccttgcgggctgatgtcgtatttcttgaggttatcggcggttactttactgggcactgtgttggaatcgtcgtcgccatcatccaaggtgtatgccacgacgtttccgccatggaacaccggcaacaacgtgctcgcgtggcatggcgtgtactggcgacagtcaccacggcgaccccgccatggaacgtggcacaaccatgcgggggacgctctatgtgcattcagtcatgctgccgatgctctttaacttgcatatccacgagggcggcacgaggcaattcgtccgcctttacccgtacatccatggggcggcgaaaatcccatggggcggtaacttgcccatggggcggtcggtaaaattttaccttccgcagaataaagccattttcagccaccgccccatgaggaattcaccgccccatgggccaatcaccaccccatgaaacagctcattcgcacagcaacactatttgccgagcaacacccgcttggcgagttcgggaccgtattccgccaatgcggagtcttccgacgcgatgctggcgtggccaccattatgctcaccattgtcaccaacaccaacaccaacaccaacaccatcgtcgttaccaccaccatcgccagccgtcgcaagattctcagtgagcttggcgaccagacgcgcatgggccttttcgtcgatcttcacgaaaatcgcgaacacaatcaggccaagcacaatgcacaccagcggaatcatgaaggcgaaggtcttgaagatggtgatgtccttggccgtcatgtcggcggcggtggcggaaccgatcatgccggcggccacggccacgaagccgacgaagccgttggagaatgcgccggcgatcttgtcgagcatcggacgcacggacagcgtcacggcttcgttgcgtttgcctgttttcagctggccgtattcaatggagtcctcaaggcacacgatcacggtcatctgaatctgggtctgcggcaggtagaacagcactagtgccaccagcagcagcggtatattcgtggaggcgacaatcagcagcaggtaggccacgaccatcacggacatgccgatgaggaacagataacggcggggcacccacctagtgatgaccgggaacagtaccgacataatcagaccgcacacaatagggatgacgccggtgaccgggaaaaggtccatgcgaccaatcacgtatttgaacaggtagaccatcacgccaccggtggccacgttggcgacggcgtagaacacataagacaaagcggtccacatgagctggtcgttgtgaatcagggcgcggaacgcttcaatcgggttaccgttctcctgggccttggtgcgcagcgtgctctgtttttccttgacaccgaacactacactcagagccgtgagagcgccgagcagggccacgatgatgatgaacgcggtccaaccattctggttctgctgaccggcatcgaagctgaagaaggtgacgatgggcatcacggcgatagtcagaccgttgtacccgagcgatccggtgaaggtgccggctgcggtgtagatgccgcgctgatgggagtcggaagagatggaggggatcattccccagtaggagatatcgcgcagggagtagaacacatcgagtaccacgaacaccaccacgaacaggacgatgaacagcgtggtgttgacgttgaccaagccgaacaggccagtgtagaccatgacgatcagcacggcggacaccagaccgccgatgagctgccaagggcggaatcgcccgagtttggtggtggtgttatccaccaggttgcccagcagcgggtccacgaagatttccgcgatacgaatgatcacgatcagcgaggtgatgatgccgatgagcttgcccgccacggccttgtccactccggagaacagcgagttggtcacatagaccacgaagtaggtgcttagcgcgttgtagaacgccgactggccgaagttgccgagcgcgtaggccacaagtcgcgcgggagcaatggcctctttctcatcatgatgggattgcgtagacgattcagttgatgccgtcatcagatacattcctccagattccatgtacgcatatcagcgatgttgcggcaattcacacatcgtgcgtgcgatacaccggtaaaccaaaaataatgtacaccagaccgtagagaaaacacacataaagttgctacttaagcacagaaattaacaaaaagtcactaaacgattgaacggcgtctcttatcgtggggggggagatgcacgaactcggagcggagtgaacggctacctccgatgacacatggggccactcaaacgagtgacaattacgagttacgacgggagatgacaatgttccgcaaggctcccctcagtcaccttcggtgacagctcccctcagggaggggagccagattagcgtcagcgcgtggaggcgcgggcgatgacctgggattcggtggtgagcagttcgggcttggtgatgctgccgtcgatgcgtccgaggatgcgattcactgccgtgggagccgtccagtcaaggcgggaatccatggtggtcagcggaatctgcaggtagggggcctcctcgttgttgtcgaagccgatgacctgcacctgcgcgggcacctcataaccagcggtgcgcagagcggtcaatgcgccgatggccaactgatcgttcagggcgatcacaccgtcgaatggcacgccggaatcaatgagccgctggatcacacgggcaccggctccgatggtccaatcctgaccggtgttgccaatcagctgcggatccagctcaagcccacggcggcgcgtttcttcaatgacaccacgcaaacgcagttgtgcgttgccttccacagcctgcaacaaagcggccgcgtcatagtcgtctcgtgcgcccactacagcgaggcgagaagaacctcgatcgtataggtagcctgccgctgttgctgcggcggcaacatcgtccggagtcacgtggtcggcaacaccccatgtggttcgggcaccgacaataaccagcgggaaatcgaccttcaggtcttcgggcgaaatatcctccacctcgctcatggagagaatcatgccgtctgacacggtggagttgaagttcttgagcaggtcgcgcgctcctttggccgagccctctgcatacgtggtgacgtatacggagtagtcgcgctgacgggcggcgtcaatggtgcgattggccaactcggccagatatggcggaatcagcgaaggcacggcaagggtgatgaaaccggtgtgatcgcggttgaggttgcgggcggccacgttgactcggtagtcgaggtccttaatgaccgactcgaccttggcacgggtctcatcggtcatacgcccagagccattgatcacgttcgacgcagttttgagcgatacaccggcggcctgagcgacatcgcgtaacgtcactcgacgcttggctgttttctcgtcgctcatgccgcactcctctatctggacaacattgccattctagcgcggtctagcaggacgctttagcaataagaatggcattgcgattcagcgtatagccggtggtgtcggcctcgcaacggtaggcgatgattggttctccctcaatgccgttgacggcaacgggctggtttgagcggttgaggtagaaatcgaagcgagtggagccatctgcggatcggcggatggtgtgcaggatgcggggatctgtggtgggataggttggagtttgaccaccctcagtcggctgcgccgacagctcccgccagcaggagccgaactccttaagcaggcgggcaatgtcgtggcggccaaggtcgcaccccacgtagatggcggtaccgttgccataggtgcggctggtgatggcggggacgccgtcgagctcccaatcagcagcggctgtacccacgtacgtggcaagcacgcaagtgtctggagcgaccgaggtcacgtcattctgccacagacgggtcgtgagtccattcgacaaaccgatttcggccggttcgtcttcggcttcttctccgaggatgttgaattcttcggagcggatgccgagcatgtcgcgcagaagtccgttgccggcgccggggtatccgccgaaaccgatgtggaagtgttcgtcgatcaggccggtggcatagccgacgatgaccgtaccgccgttttcggcgaagtccgcgatgcgacgggtatcctcgtcggacagggcgatcacggtgggcagcacgatagtctggtagccgctccaatcgtaggcgagcgggaccacgtccgcgcgcgctccggcatcgagatatccgcgataccagtcgcgtacgtcatgccagtgattgagtttcatgctgggcagggtctcggagcgagtggcccattcggattccgcactgaacagaatcgccgtgtccgcgcgcttcagttccgtgtcttgcacacccgcgtcggacagcgtcttcagcgcggcgccgagttcgcacacacctcgaaacagtttcgtatcggagcccgcgtggggcaccatcgcggagtggaacgcctcggcacccgatgcggattgcctccattggaagaagttgatggcgtcggcacccatggccacgtgggccaaggagtcgcgcatgagctcgccggcgcgcttgcgcgtgttaaggggcttccactgcacggctgaggtggagtgctccatcacgtaccacggcttgccgagcgcgagcgagtccatgagcgcgtccgagcaggcgagttcgtccagatgggattcgccttcatggaagtagtgatcgttggacacgaagtccacttcgtttgcccattgcgcgtagtccatggtgcattggtcggtggagaccatgaagttcgtggtgaacggcttgccggggcagatttcttcgattgcgtcgcgttcggccttgtagaagtcgagcagcatgtcgttgccgaaccgctcgtaatccaactgctggggcgggttgaccatgctgtcgccgcccatgtggcgaggcagcaacacctcgtcgaagctgttcacgtgctgggaccagaaggccgtgccccacgcttcgttcaacgcgtcgacggtcccgtatttggcctcgcaccacgtgcggaacgcggccaaggcgttgtcggagtagtcgtagcggttgttccagccgtattcgttgcccatgtgccaggccgtcacgtatggattgtccttgtagtgttcggcaagtttgcggcacaggcgcagcgcgtattccttgagcaccgggcttgtgggctgccacgactggcgtgagcccgcattgaccacatggccgtaccgatcgattggcagcacctcaggatgacgctcgtacagccacaacggggccgtggcagtggccgatgccaggtccacggcgatgcccgccgcgccgagcttgtcgatcacgtggtcaagccactcgaacgtgaactcgccctcgcgcggttcgatcttgtcccagctgaagatcgcaagggccacggtgttcacgcccgcccgggtcatcagacggatgtcctcgtccagtgtctcctccggccactgatccggattataatcgcctccgaacgcgatgccacggccggattcagtcagcagggacggccacctgaacgttctatgagtagtcatatcaatcaagtcctttattgtatcggctcgtggccgatgctgtgttgctggcggctgccgttgccgcgatgaccttcttggtgttgcgcatgttatctcctcctgggccgttgggattggtcgtggcttcgggactttggcttactgccttgggcctgggttcctcgcctgcgatgtgctccgctgactgtctttctttgaggtgttttctttggtacatccgtgtaccaatatctatgatgatatacccgtgtaccaatttgtcaaaatcaagcgacacgcctgatttccagcgccagacggagccagttcggctagtatgaacaggcacccccatagctgtattgagaggaagagcacatggcgggactgtttcggactgcttccaagcagcccaatcctttagggacagccatacacacccgcggatcaggaaaatatacattcggactggctttgagtgcgggtcttgccggattactgtacggctacgacaccgtctccatctccggtgccatcgaattcctgcgcgccagatacgggctcagtactctcatggagggcctcgtcatctcctccatcatgctcggtgccgtcatcggagcggccaccgccggattcctttccgaccgattcggcagaaaacgtatccttattatcggcggcgcgttcttcctcgttgcggctgtatggagtgcgctgacgataggtcccatagcgcttatcgtggcgcgcgtggccggcggctacggcatcggcctgaccgccgcgctggccgtcacatacatcaccgaatcggctccggccaacatccgtggtctgctcgccttctcttatcagctgcttgcggtttgcggtatcttcctgaccaacgtcatcaactacatcatcgcctcctacggatcaaacgactggaatatcgccattggatggcgctggatgctgggattgggcgcgattccggccgccgccttcctgctggctatgcggagggcaccggaaagcccgcgattcctcattcaggtaggcagaaccgatgaaggtttcgcggtgctcgagcacatcctcggcaccgaacgcgcacgcctgcgcaccgatgacatccaagcctcggtcaaactggaaaccgagatgtcgcacgaattccatgatttgttccgtccaggcctgcgacgggcactcgtcatcggcatctttctcgccgtgttcaaccagttcatcggcatgaacgccatttcctactatgggccggtgatgttctcggatctcgggttcgccggggacactcagttcctcgcggccgccagcgtaggcggcgtggagctggtggccaccgtggtaggcatgtacctgatcgacacgttcggccgtaaacgtcttatggaaataggcaccggcatgatgtgcgtgttcgcgctatgcatttcgggctcgtatttcatgggcaattcgctgctgacgcttatattcgtcatggcgttcaccatatcgttcgccttttcgatgggaccgattccctggattgtgattcccgagctcttccccacgtatctgcgcggtcgcgccaccggattatgtgtgatgtgtctgctgttcgccaactggatcatcgcacaattcacgccgatgatgatcgatggattgggcgacggcatatcgttcgcgattttcgcggttctggatctgatttgcctgttcggcatcgtggcgttggtgccggagacaatgggacgcacgctggaggaaatcgagcatctatggcagccgaaaaccgatttggcctacgcaaaatacgcgctgagcacggctgatgcgaatatccgccacgcggaagccacgctgcgtcgtattgaaaacgaacgtcagcaggcattgggcattatggatgcggctgagcgggctcgcgctgcggcacagcagaagattttcgctatagagaccgccaaaagggccgaggcagaacggctggcggcgcagcgcgctgccgaggaagccgccaaggcagcggcgaatatggctgcagaagaagacacggcagcgaccgtctcggaagttacgacggatgagaacgtgccgtcgcttatgcggcgtacgaggggcgctgttctggttggtaagtcatccagtagacggcacgacggtgagtatacggacggctctgcgaacggccctgcggatggctctgtggatggctccgtgactgactctgcggatggtgcgatgctggacggcgcggcggccgaggcagcggccagcgcagcagtcgcggccttggccgattcactgcccgacgatccattcacgctggcgaatcggccgactacgcgcagtggtgcggatgatacagatagcgttgatgccgcagatgccgttgattccgcgaatgacgcgaatcgaaaccgcaagcagacaaatgccgtgcagccggcacatatggcctctattgagcacgcgcacagtgccgatacgcctcgcggagtgttgttgcccagtgccgacgaggattcctacagcgagcattccttcgccgagacggatgacgaccgcgaggctcaggccatcgacgcggccctcgactctctgaatgcccttatcagaggctgatatataaggaaatcctgtattgcagagtattgcggcctgtgactgtgcgactttacagattcagcaccgcatcggcaacgcgcatggcggattcacggtgagagaccagcaccacagccacgtcttgccccttatccgcgttctgctcgctcttggacagctcatgaatggaacgcagaatgatggcttcattcaaggcatccagacgactggtcggctcgtcgaagagaaccaagtcggcattgcgcaggaatacacgggccaagccgatgcgctggcgttcgccttcagacagtcggtcgcccagctcgcccacctgggtgtcgagcccatccggcagggaatcgatcaggtcgagcacggatgccttggcgagggcttcgcggagtcgggcgtcaagaacaccggccgctcccccattgcgaatctccgattcaggcaaggcgataagcagattctctcgaatcgtgccgtcgaacaggtgggtctcctgactcatcatggcctgaatacggcggcgggcatgcacatcgatttgcggtagcggcgtgccggacagcgtcacttggccgcgctgcggatcccaatagcgcatcagcagcttcagcatagtggacttgccccggccggacgggccttggataccgaggatgccgtgctgcggcacatcgagcgagaagtcggcgagaatcgcctcgctctcctcccccgggtacgcgaagatgacgcggtcaaggcgcatgccctcataatccgagttcgcagtgccagtttccaccacggccggcgcttcgtccatcagaccgaacagacgacgggcggaggcgaaggtctgggtgaggttcgcgggcagggcggcgagcgccagcgtcggcccgaacgagctggcgagcagcgcgaaggcggcgaccagcgccgggatatcgtagaggttcacgccggcaagattgatggcgatgccggcagccgccgaggtaagcaatgcaaccagcaatccgccgacaccggcgaaccggccgttgacacggctgagtttggcatggtcacgccatagcgcgcacgtgcggtcttcgatggcctgcgcacgatcttcaccccgaccgaatcggatgatctcgtcgagaccgcgcatgtcgtcgagcatcacgttgtcgagttcgccggccgcgccacggatggcggggcccagattgcgcacgccggtggcgaagaagcgcggcacaatgatgccgatgatcagatgggagacgatcagcgccaacgccatccaggggctcagcgtggccgccacgatgacgtagacgatggtggtggtcacggctatggccacggggctgatggtatgcgcgaagaagatttcgagcagttccacgtcggtggtgagcatggcgatgaggtcgcccttgcccttgccggcgagcttggccggagcgaggcggcgaagggcggcgaaagccttggagcggaagagcgcgagcaggtggaaggccacgttgtggttcagatattgctcaacgtagcgcgtcaggccgcgcaacaccgcgcaaacaatcatggcggtgattgcaccggccgcactcatgccccacacggggttgccggcgagcgcgaatccggcgatgatgccgaacaccggtaggaaggttgcggcaaggtgaccgatggtgccggccgtggaagccgcgaccataagcccggccagtggcttggcctccccgagtagtcgcttgatgacctggaacgtgctcatctcggccggagctgcagccggagctgcgcccacagccgccccgctcccgctggcggaagctgtcagcgaagctggctgagggtggtcagccccaaagttctcgatatccgcctgagtagtgaacaacttggcgtacacgccgccggccgccatgagttcggcatgcgtgccggtttccaccgacttgccgtgttcgagcaccaccacttggtcggcgtgctcggcgttggccatgcgatgggtgatcatgatcaccgtcttgctgcgggattgcaccagttcgcggatggtcgcgagaatcagttcctcggattccacatccacactgctggtggcctcgtcgaatacgaataccggcgaatcatgcagaagcgcacgggcgatggcgatacgctggcgctggccaccggacaggttggcggcgtcgggctcaatcgtcatgtcaaggccgtccggctgcgaacgcacgaagtcggcgatacgggcctgttcgagcgcgtcccagagacgggaatccacggcgtcggacgcggcttcaccgttctggccgtcatcgggcaaagccatcagaaggttctcacgcagagtaccggcaaacagatggctactggcaccgatcagggtgatggttcgggcgagcgtctctccggacaggtcggataccttgacgccgttcagcgtaagcgagccttggtatccggtcagcgtaccggcaagcagcgcggcagccgtggatttgccggaaccggagatgccgacgatggcggtgagttgaccggggtaggcagtgaaggtgaggtcggtgagcgcaggtgccggcgcggaattcgtttgttgaacggcggcaccggaatcggcgctgtcataggaatagccgacgtggtcgaagctgacggtgattccgccatcggccttggtaccggccttggtaccggcatcagtcccggcatcggtaccagcggtggccggcagcgtggcagtgccgtgggcgggctcgggggtgtccagcagggcgaagatgcgcttggtggaggtcatgccgttcatcgccacgtggaagtaggagccgagctggcgcatggggatgaagaattcagcggacagcagcacgatcagcaacagtccggcgagggtgagcgggaagcccgcaccgaacggcatcaggtattgcaggccgtaggccaggtaggcgaacgcaccgggcaggtgggcggcgagcataatcggagaccagccggcggcgctggctcctgcggcggccgcggcggtatgcgcatactgccatagagccacaccaatgccggccgccgcaccgccgtaggccacgatatccatggcggtcagcgagcgcagctggatctgcagcacgcgcatggtcatgacgcggaagccttcggccttcttgtccatttcggcggcggcacggtcgtcggcgtcgaagttcttcagggtttcgaggccttgcaggttgtcgaggaatgcggcacccatgtcggtgtatcggccccagtattttttgaaggcgcgggcggcggtcatggatacgatgccggtgacaataataatgagcggcgcgcagacgagcatggtcacggcggccggcatgttgatcggcgcaatcacggcgaacagggtgatcggcgcaagaatcgcatagaagagctgcggcaggaacagttcgaagaagctttgaatctgctcgacgccttcgccggcggactggaccacatccgaggtcttgacgcgcgacctgtaggacgggccgagggccaccattttgcggtacagcttggaacgcaaagcgagcttgacctgttcggcggcttcggtgccgaggcgtgtggcgtgtgtggtggccaggtagcgaaccagcatgcagacgatcgccaaggccacgtaaaccatgaggtcgccggccatcggggcgacggtggtgcccggaacgccgaacagattggcggggcactcggaggccgaggcggcgttacaggagaaagtgtgtgggtcggctgcggcgagcagtccttgcagcagcatgaccagcgaaagcatgaagccgatattggcaagcagcccaacccacatcagagccactttgccggctatgagcttgccgagacctggtgccaattggaacagtcgtttgtcgaacatggttcgcttccccttgccgtgttgttgcggtgttggttgccgtggtactgcagtaggtctcgtcatgcatcagtcgcgggtgccaccaatcgcatacctgcacataccgatggcgtgcactgcgcaatcctatttaccttaggcgaaagcgcacatacacgccagaccttcagctgagacgactgtcacgctgagcttcgttcccaaataagaagccacagactccccaatgccgacgccgccgatgatgctggagctgatgaccggaccctgcagggccgggctcagcacgtacttgtcctgcaggaagtcgatggctcccgaaatggacacggtcataaccgtagagcaaaccggttagacacggcgttgtatacaatccacaaaaccagacagacaacttctccattgcccacaacgcgcgcaaccttacgccagcgtaacctaacttgtcagaatggctcgattttgtcaacagccatcacgcaacgcacgtaaggacacggcccgcttatgcttgaccactacaccacgcctggcgaatccatcgaaatccgcgacaaccagaccatctactccctacttaccgatcgccttgcccgcaccggcgcggacacggtaatcgccgccaagaaaatcggccccggccgctggcagaacgtcaccaccggcgaattccacgagcgcgtggtctcggccgccaagggcctgatcgcgctcggcatcgccaagggcgacgcggtgaccatcttttcctccacccgtctcgaatggggcattctcgatttcgcactggccgcagtgggcgcggtaagcgtgccgatctacgacaccgactccgccccgcaagcccagcgcatcatgaacgattcggcggtcaagctggcctttgccgacaaccgcgagcgcttcgaccggctcgactcggtcaaggaccactgtcctgccttgaagcagattctcatgatcgagggcaacgcgctgggcgcgctcgaaggtctgggcgtggctgtttcggacgaggaactgaacgagcgcgtggccaccgtgcgcgccgacgatctggccaccatcgtctacacttcgggctccaccggcaacccgaagggtgccgaactgacccacaagaacttcgtgtccatcaccatctccgcctcgcaggcgttgcatgaagtggtgcttgacgaccatccgcgcctgctgctcttcctgccgctggcccactgcttcgcgcgattcatccagtacgcctccatcgcctccgatgacggcgtggtcggttatctgccggacaccaaaaccctgctgccggacctgcgttcgtttgaaccgacctacctgctgggcgtgccgcgcgtgttcgagaaggtatacaacgccgcctcgcacaaggccggtgccggctggaagggccgcctgtttgtcaaggccgccgaggccgcgcgcgtctggagccgcaaggagcaggccggcgagcagcacacgtttgccgaaatcgccgagcgcgccaagtacgaaacgctcgtctaccgcacggtgcgcggtgctctgggcccgaagatcaagtacgtggcctgcggcggcgcaccactgtcgctcgatctggcgcatttctacaacggcatcggactgccgatgattcagggttatggcatgaccgaaaccgccgccccgttcgccgccacgcgcgtgaccgacaatgtgatcggcaccgtaggccagcccgcgcccggctcctcgattcgcatttccgacgaaggcgaactgcaggtcaagggcccgaacgtgttccgcggctaccacaatctgccggagaagacggccgaggcattcaccgccgacggctggctcaggaccggcgacttggccgagatcgatgatgagggccgcatcatcatcaccggtcgaatcaaggacattattattaccgccggcggcaagaacgtctcccccattccgctggaggaagagatcgccaagtgcccgatcgtggagcactgcgtggtggtgggcgaccagcgcccgttcatcggcgcgctggtgacgctcgatccggagtcgctggcattgtggctgcccgcgcatggactgtccacggagacgccggtggaccggctcgccacgaacgcggcggtgcgcgaggagattcagcagtacgtggacaaggcgaatgcgacggtctcgcgcgccgaatccgtacgcaagttcgccgtgctggacacgcagttcacgcaggagaacaagtgcctgacaccgtcgctgaaagtggtgcgcccggccgtcaatcgcgtgttcgccgatgtgatcgacaacgagatctacaacggcaagcggtgagacgcgcggttcgtaatccgacacaaaaaagggccttttgaaccgcaccccgattgttggactggagtaatccagattcgatgatcggaggtgcggtttctcatgtccagggatcgcaggcgtcattatgacgatgattccatgcgggtcgtcgccggggtgccgcccggcccaggtgggtcatgcccgggtcagtttcttgctcctgagacgcagcacgacatcggcggagttggcgacgcgcttggaatgcgtcaccacgatcacgcatttgccgagctgatgggcggcgtgctgcagcagatgaatcacctcgtcggtcatctccgggtcgaggctgcccgtcggctcgtccgcgaggatcgcgcggcccggggcgaccagcgcgcggccgaccgccacccgttgacgctggccgcccgacaggtgcatgatgttgcgcttggattcctcacggctcaaacccagttcctcgaggatcttcatatcggccttggcgctgaccagccgcaggttctcttcgggggtgaggtagtcgatcaggttatggtcctggaacaccagggacacgtgctcccggcggtgcttcgcatagcccgatgcggcgatgtcctccccttcgaagcggaccactccccgggagggggcgtccaggccggccagcagcgacagcagcgtgctcttgccggcgccggacgggccggtgatcgcatacatcttcccggattcgaaatccgcgctgacatccgaaagaacacggatcttcgccgcgccgtaggcgtaatcgacatggtccagttgcagacagttagacatgattggtgactcctaacgcatagaggaaagaatggatttcggggatttggacagcacggcggcgcatgacacggcaagagccacggcgatgaccgcgcatccgagcagcaggatgagcatcgtctgctcaggcggcaaggcctccacgtgcaacgattccaacggcgcgacgcccgaatcgcgcaacagtcgggaagacacgtatcccgacagcatggcgccggtgcccagcgaacacagggcggcgaccgccgccatgagtccggtttcgatggcgagttgtgcgacgatccgcatcttgtcgatgccgagggccagaagcgtgcctatctcatggatgcgtgagcgaatccagaagaccagcgccatcgccagcaccagtacgtccgcgaggcagacggacagcagcaccatgcgcaccagattacgcaccgtctgcacggattgcaggacgccggagagccgggccgaatcgtcggtgacgtcgtacttgccgccggccatggtcttggcccgtccaatagccgcggacaggtcctgcggattatccgacaggcatcggatcatgtcgatccggtcgtttccggtcagagcggaagctactcgcctacccgaatagatgaggttctcggaagtgtccgagggcagggggctttgggcctgcacgttgccggagaagatcccggccacacgcaccgtggcgttgcgcccctcctgccggagacggaatgtcgagccgaccgataggccgttctgcatcgcgaagtcgcggtggaccagcacattgtcgccgtcgcccgagatatggcggccctgctccaggcggtacaggccgctctggaattcctcggacaatgaggaatcggtggtgcccagcacgctgacctgcatggccagatcggagtccaatcgggggccctgccggggcatgaccgggcgcgcgccatccacctgcgccaaggtcttcgtcgcataggcggtcttcgtcacaccggggatacgcgagaaccggctcgcctcctcggcgctaatgggattctcgccggcgctgacggtaaaccctatgcccatgcccgcgccgatgccgtcggacatggtacgcagggccgtcgagactccgacctgcgccaccaggctcgtgaagaccatcagcatcagcagaccgatgatgccgctacgtaccggcttgcgtacgatcgccaacgtggcacgcttccacacattcatgctcatcatcgaatctccgacaggtctcgcggcgatttgcgcagcatcggcatgcacgccaccgcgacgcacaccagcatcaccgccaacaatccgagcgccacgtacagcatggcggtcccgtcgaccgacaccgtgagcgaatccagggtgcgcaccgacatgctggattcaagatcgccgccgacctgccccatgctgctcagctccttcgccgcggaggcgttcacggaatggagcgccgtggcgccgagccattgggccattccctgcgcgcacagccagccgagggcgagggacggcagaccgatcagcaccatctcggtgaggtattgggcgaccagggagggcttgccgacgccaagggacaccagtatgcccatctcttgacggcggtcgttcatccacagcagcagcatgagactgagcacgagcacggccgagacggtcacgccgatcagggcgccgcgcatcatggagcgcacgccgcgggcggcatgcagcatgctcgatgaatactggtcgttgcgcgtgatctgatagttgttccaatccaccgggagtttcttcgcggcatccatggtcttctccacgtcaacgcccttggacagcacgaaggtggcgtcctggtatatttccttgccgtccttgtactggtacaggtcgcgtgtggtatccagatcggtgtagatggtgttggcggtgagttccgctcggctggatacctttctggcgctgtcgcccttgaatatgcccacgatggtggtcttgacggtcgccgtcgaatgtgattcgttgtcggcgtcataggcgttggccttgagcgtgagcgtgtctccgactttgagcccgttggctttggcgagatcctcatggatcatcgacgtgtacttgtcggaggccttcagatgtcgtccttcggccatgccgagcgtgcgcgacgtgaacacgttgagtttcgacgaatcattcgtgcccatgacgttggcggcgttgccaaactgctgctcctgggtcgcatcgtaatcatcgccgccggggaccttcgccacattcgcccccacgagatcggcggtggcgttctgacggaccatatacgaatcgaccccgggcagttgggcgatcctgcgcacgtcggcggggcgcaccatgccgcctccgcgaggcgtgagcatgctgccctgcatgttgctggacagcacgaatccaccgaccgcttccttctcgattcgtccggcggcctgttgagctgcccgagaaaccgcgatcgtggatagcatgctcgccgttatgatggtcagtattataaggagcactatggttcgcactcgttttctgagcacatagcgcaccgaccgtgcaacgaacgtcatcaatacctcctgtgggacttgggcttttcgcccaaaatgcgaaacatgccgcgtttcgccgattagttagccgcgacgatacatgatgcacctcaagatacgggagatatacgccttgagcgaaaaacggaacagcggcgaatgtcggttattctggattttggtccatctcgggccgcgtcgatgcgtcggcccgcgagaaatcaggctcgcgcctcaccttcgaggcggcgaacacaagaagcggcagagcggcgaacgcatagttctcgcattggatgtacaggtatgcgaccaggacgagccagcagatgacggtcttgtgccagacgccggattcgcccgaacccgcgccggcaacgccaccaccactattacccccggcaacatcagcaacgtcggcaacgtcggcgacacaaacaccgtgcgccagctcgtcggacgatgcgccatccgcaccgccacggcataccgtcctcccgcgcgtcatgcagaccatcgaggctccgaccagcatggccagcccgatcagcccgtattcggcgatgacgctggtatacgcgcacatcgtccacaccgtgtccgcgttcacgccggccgcgaatcccgtggccgcgccgccgttcataccaagaccgtccagcagccgtccggctttggccgcgccggcccacaccgcattgatgatgttgcccgcgccataaccggtgagcagcgtccacggatgggtgagcaatccgcatatcggatcgaggctttggtagatccgcgcgaagaacgatccgtctccctcggccccgttctccgcgatggcggagagtctggaatccgccagcacacccagcaggcccagtgcgcatgcgccgagaatctgcagcataccccggacgcggcgtgcgccgtcatgccaatcggtgcacgccacaagggcgatcagcaacgccacgacggaatcgatgacgattctggtgccggcttgcatgagcaccgcgccgacggcatacgtgacgatgaggtcacgcagccgtttggcgtagatgcggtcgcgcccgcgcatgagccacatgagcggaagcagtatgccgaacaggtgcatgccgatatagctgggctcggcgaacaggaactgcggacggccgccgccccacaccgagttgtcgctgatgtattgccggtacatgaggtgcgagaaatagtcggtcaacggtttggcgtgcagacggatggacagccattgcacgacgcccactccgaaggaaacccagtatgatgcgatgagaatccgcaatggcgtacgccacggaatgcgtttgatgtcgaacgcaagggcgatcgcacccaaagtggcgagcacgcccagcaatccggtgatgctcatgaacgcggcgttgaggtggatgccgaacttcagccatcccgggatggacaggattatacagaccaccggtaggaggaacattggcaggtaccggttggctgcgatgcgcagttgccgccaattgcataggcagtacacggcgaacagcgccggactgattggcgaccagaacggcgcgtacaggccaagcgtggtgccgtccaccggaagaaaagcaatggccagcaacagccaaatgacgttgcgttcctgcgatgtcagaaatcgcaggaacgaccggtattgcggtcggccatgatggttgcccgcgtcgatggtgtcgttgcgtacgcatgcctggttcatgtgattctccctccccgtcaaccttactcgttcatcatgatgcgcggacggggcatgctttccccgctgaaagtgcaatggcccgaacattgacaaggtcacaccgaatgcccccatcattggcacattgtgcgatctcgtcgcggctggctaacgaaataatgttggccgaccggttacattggttcggtacagtggcggcattatcggccactgaatcaagcgattcgcggcagaacgacgaaaacaacacctgggcgaaaagaggcaggcatgactacgaatcgaccgctcattgcggtgactccgctgatggattacgggcgcgatagtctgtggatgctgcccggatatatggaggcgataatgcgggccggcggtacgcccgtcatgttgccgctgaccgatgacaccgacattcttgcgcaatgcgccgaacggtttgacgcgtttctgtttacgggcgggccggatgtgggaccgatggttggtgcagcggcctccgccaccggccgtagcgaggtgctctctcctgagcgcgaccgaatggaatcgattctgctgccagctgtaatggcttgggacaagccgattctgggcatctgccgtggcattcagttcatcaacgcagcgctgcgcggcacgttgtggcaggatctgccaagccagcatccgagcgatatcgaacaccatatgaatccgccgtacgatgcgttcggacataacgtttccttggtgcccggcactcccctggcttcattgttcgcagggcagactgagattgcggtgaatagctatcaccatcaggcggttcgtgagcctgctgctggactcgaagtcatggccgttgcgcccgacggcgtgatcgaggccctgtaccggccggcaagccacttcctgtgggccgtgcagtggcatcccgagtttctctacaaggtagatccacgctcgcaagcaatttttgatgcgtttgtggggagttgccgataacagcaaaaggggctgctccggtttcccggaacagccccttttcagcggtagcagtcagcagactgatttagtcatcagtgctggcttgccagcgctgattggcgcgtgcggagaccgccgtccgaaggcgaaggcgtacgaaggtacgtcgaacctgaggaaaggcggtatacgctccgccaatcagtgctggttgttgagacggtggtacatctcggacagctccagttccttctcgaactggcgagcggtggtgttctcgtcgatgacggcgagctcaacaccggcgatgcgggcgaagtcttcccaagcctcacgaccaacggaggtggtcatgcaggtgtggtgagaaccaccggcggtgatccagcactcaacagcggtcttcaggctcggcttcggctcccagacggcgcgggcgcacggaagctccttgagggagccctgcggctcaacgacgtcgacgacgtccatgagcaggcggaagcgttcgcgaacgtcggacatggagaccacgacggcgtccttggcgggcttgccggagaagaccaggcggaccgggtcggccttgccgccgatgcccagcgggtggatctccagcttcggcttggcgatggtgccgatggacggggaaacctcgagcatgtgggagcccatgtcgagctcgtcaccctcggtgaagttgtaggagtagtcctccatgagggaggcgccaccctcaaggccgtagcccatgacggcaccgatgcgcacgaggacggcggtcttccagtcgccttcagcggagaagccccagccgtactcggacgggaagcgctgcgggccaacgcccggcagctgcggcagagcgccgaggtcctcgaagttgtcgacgccggcggtgcagccgttggcgcgcatcatgttgaccatcgcggcctcttccttggcggcgatgaacagggagtcgtacttggcgtccagcagagccgggtcgacgtcgtacttggccttgtagtcctcgatgatctccttgacctggtcgtccttgacggcgtcgtacgcagcgacgagctcgttgacggcccaagtgttgatggaggcgccgaacacgcgctcggcctcggtcttgtcgccctcggtgacggcgacgttacgcatgttgtcgccccagcgcatgaccttcatgttgttggaggcatcccagccggcgcaggcgcgggcccaggtaccgaccttctcgacgacctcaggatcggtgtagtggccgacgacaaccttgcgcttgatgccgaggcgggagacgatgtaaccgaactcacggtcgccgtgggcggcctggttcaggttcatgaagtccatgtcgatggtctcccacgggatttccttgtggtgctgggtggccagctgcagcagcggcttggtcagcacttcgaggccgcgaatccacatcttggccggggagaaggtgtggcaccaggtgatgacgccgatgacgttcgggttggcggaagcctcgaccatgaattccttgacaccgtcggaggacttcagggtgggcttgaggacgatcttggccggaatcttgccggtgttgttcaggtagtcgaccatttcagcggagtgaatggcgacctggcgcagggcttcttcgccgtacaggtcctgcgaaccaacgccgaaccagatttccttgccctcgaaggggttttccataaccatagggttacttcctttacttctttgtttatgggggtttgtttaagtttcattcgccgaccgaggctcccctcagtcagctatcgctgacagctcccctcagagaggggagccaagacaccaccgtgctggcggagtcagcgctgatttgatgtgtgtgtccgcaaggcgcggaaggcgaaggcgtacgaaggtacgtcgggccttccgtaacgcggcggacactccatcaaatcagtgctgaccgtagacgttctggtagcggtcgttgagcttatcgatgtcggcctggtcgatctcgatgatgtcaccgagctgacgggcggcccacatggtgtgagcgacttcctcggtcatggcagcggccttgacggcgccttcagcatccttgccgatggtgaaggggccatggttctgcatgaggacggccggggacttcgggtacttcttgagggtctcgacgacacccttgccgatcgcctcggagccgatcagacggaacgggccgaccggcaccgggccgccgaactcgtcacccatcatcgtcaggccgcacgggatgttctgaccagtggcagcccaagcggtggcgtaggtggagtgggtgtgcacgacaccgtagacgtcgggcatgttgcggtagatgtaggcgtgggaagcggtgtccgaggacggggcttcggtgccgtcgaccacgttgccgtcaaggtcgcacacgaccatggaggacggggtcaggtactcgtagcgcaggccggagggcttgatgacgaacaggtcggcggtgtgcagacgctgggaaacgttgcccgcggtccacacgaccaggttccacttgatcagctgctggtgcaggttggagacgacctcacgaacctgcttgacctcggcgcgaacctcggggccgtaatcagccaaagttgccattattggttttcctttccactgtgatggatggacgttttttcaaaatctcaaggacctccctcaatagagggaggtcagaaaggcttacttatcttcgaggttgatggtttcgatggcggcgtgctcgatgggcaggcccttggtgaagcgggcgaagaagtcctcgaaaccaaccacatcggaagccaccggcttctcagtggtggactgggcgtccttgaacacgcaaccgtcaaggaagtcagcgaggttgctgtgatcctcgttggtgttccacaggtagttggcgagcacggccatgccccaggcgccaccttcggcggcggtggacatgaccttgatcggggtgttgaaggcagcagcgagaatcttctgagccaccttcggagtggcgaagatgccgccgtggcccacgagagagtcgacctgcacgcgctcctgcttggtcatcacgtccatgccgatcttgaccggggagaacgcggagaacagctgggcgcgcatgaagttgccgagggtcatgttggcttcggggctgcgggcgaacagcgggcgaccttcaggcagaccggccaggaattcgccggaacggaacgggtagttcagcaggccgccgcagttggcgtccacgtcgtcggcgatggccgcgcggaacagggtgcggtacagcataccggcgtcaaccggctggccgatagccttggcgaactggccgaacaggccgacccaagcgttgaggtcggaggtgaagttgttggcgtggctcataccggccagatcgccggccggggtggtgaccaagtcaacctcagggtggagggccttgagcttgtgctccagaaccaccatggcgaagatggaggtgccggcggagacgttaccagtgcgtacgcgcacggagttggtggctaccatgccagtaccggcgtcgccctcaggcggggcgagcacgatgccgggcttcagggcaccggacggatcgagcagcttggcgccttcctcggtcagctcgccagccggagtgccggccacgagcggctcaggaagcaggttctccagcttccacggctgggctgcgacctcaggcagagcgtcgaacttctcaatgaatgcggtttcgtaagtgtgagtggtcgggtcaatcgggaacatgccggaggcatcgcccacgccgaggaccttcttaccggtgagcttccagtgcacgtaaccggcgagtgtggtgaagtaagccaccttggagacgtgctcttccttgttgagcacggcctggtacaggtgagcgatggaccaacgctcggggatgttgtactggaacagctcggagagcttcttgtgagcttcggaggtgttggtgttctgccaggtgcggaacggcaccagcagttcgccggcctcgtcgaatgcgaggtaaccgtgcatcatggcggagaagccgatgtggccgacgtgcgtgagcttctcgccataggcggtctcgacgtcgttggccatggaggcgtaagcggactgcaaaccgccccagatctcctcggtggtgtagctccacagaccatcctccaagtgggaggcccagctgtagtcgccggaggcgatggtctggaagttgtcgtcgatgaggacggccttgatgcgggtggagccgaattcgatgcccagcgtggtcttgccagcgcgaatcttctcggcgatgtgggcggcctgctcggccgcgttgtcggttgctgccatatctttcctttgccttggagcgccggcgttgttatccccttccttggggagggtgttagcgctcacaatttccaaaaaacattgtaccgacaacccgcattcgacacaacttatgccgtgtcacgcatcataacggtttgataacagcgccaatttaccgccgaggagccggccccaaggaccgccgggcacgcacctcggcgggaatcagccccatgccgtgctgggtggtcaggaaggtcggctcgccgccctcccccagcaagcgcagcgtctctcgcatggcggccacgccgagcccctcgaaatcgggatgcacggtggtcagcggtgggtacatgttatccacgccagacatgtcgtcgaatccgaccacgctgatgtcttgcggaatccgaagcccatgctcatgcaacgcgcgcatgatgccaacggcctgattgtcgttcgcggcgacgaccgcggtgggcaacgccgcgcctcgacgcccatactcatcaatgagatgattcatgtgcgcatatgcctcagaggcatcccacgtatggcagcgcacgatctgtgaatcgatggatcgggaggcggcgagcttgcgccacgcatccagtcgggtgtgggcgtcgcgccattcgttgggaccggcaaaatacagagccgatttgtgcccgtattcgcccagcaaggccaccactttggccattgcaccccactggtcgataccgaccagcgcagtgcgacgcttgttttcggtggagataaggcccaatccctcacgcacggtcatttggccgtgggtggcggtgacgatgacgcgcggctgagtgactcgtgcacggcaggcggcggcgaacatcacgtcggtcggggtcaggaagatgaaggcgtcgacgttctgctcgttgaaggtgtcgcacaggttgtcgaagtcggcctgcgcgcacaaggcctcgtggaccatcatcacgctcatgaacagaccgtgctcgcgggccatggattcgatggaggagatggaggaaatcgggccgaagaatttgaggcctccggcgatcagccctatggtgcgcgaacggcgggaagccagtgcgcgcgcggagttggaggggcggtagccgagttggtcaatggcggtctggactcgcgcacgggtggcgtcggaaacgtccggcgagtcattgatcacacgggagacggtttggtggctgactccggcgagcttggccacttcgaacatggacggacgtttgcttggcttgcggctggtcaccatattgcctaacctccccgctggcggccggcatccatgcacggccagtcttgtaccttaatcaatactgactttagcgcgtccacaacagttttgcgttagcgctcacactgtcgtgtcgcacgcggctcaggtcaggtgccatgagacacgatggagcggagtcggcccgtgctcggcgatggcggtacggtgtgcggcggaaccatagcccttgttatgagcccattcgtaggcggcgtaacgtggtttgctttgcgcgaggtcgaccatcagccggtctcgggtcactttggcgatgaccgccgcggtggcgacggtggcgcaatgctggtcgcctttgactttggtcgttatgtcggctggaatcggcacgtccggcgcgtcgaacgtgttgagcgccttggtgatgtaatcgctcggcccgtcgagaattccggcgactttgggcagagcgcgaacgcttccctcgcaatttccaatggattctcctacggagcctcccggacgaccttccacaatcttccccgcagactcccccgaagccttttttatcgtcgattcccctccaagtcgtaagccaagttcgcgttcgacttggctgagcgcgcgcagggcggccacgccaagcgcgtaggtgatgccccattcgtcgatctcggtgttgctggcctggcctacggcgtaggccgcgcaccagtcgcgcagttcgtcgaaaatcgcctcgcgcctatgttcggtgagcattttggagtcggccacgccgtccggtacgccgaggtaggtccgcccggacagttcggcggaatcatcgccgtcaagcggcgccaaatcacaggcccagatggcggcgcacccgaccatcaccggaccggcgagcgcgccgcggccgacttcatcgaatccagtaataaggtcatagccctgggccgcaaggctgcgttccaagtcaagtgtcggggtaatcatgcgcggctcccatcgtctcacaatggttaggattcatatggttcaggattcagacggcccggaactcaatcagttcaaagactcacacggttcaaaaaaactcaggaattcgagccggaagcgtcagacacgtccttgaagacttcgtggtggtcatcaatcgcaccaagccggtcaagcggccagtatttcgcgattccgactccgaccacatcggagatgggaaccaagccgcgatcgccgtcatcctgatgatagcgggagtcggcggaattggcgcgattgtcgcccatgacgaacacgtggccctcggtcacggtcaccgagaacgggaaagcgctcgggtccacgccggggcgaatgtaggaggtctcattgatggccacgccgttgatggtcaccggctggcccgcgcccttgcattcgaccacgtcaccgggcaggccgatcagtcgcttgatgaggtacccgccaccgggagcgctgctctgctcctcgttcaaccagttgttgggatctttgaataccacgacgtcgccgcgctgcagatcgaagatcttgggggtgagcttgctggtcaccacgcgatcgccgggcaccatggtgtccatcatcgagcgcgaaggaatctcgtaaaagccgacggcgaaaatgcgaatcagcagcacgataagcacgggaacgccgcaccacaggaaaaagtcgcgtagggtgaagtggtcatcatccatcgatgatgctgccgcggcattcgcgccagcggaagaagcggcgtacgccgggcgcgccggtgccgggggaaccggggacggggcgatgccgtggtcggcgacttggaacgtacgggaatcgcgggcatcggcctcgtcatcatacgaggtctgattgctctccggattgtcggaaatcgggaattcgccgttatcctgatcgtcctgcataccatctcctcgcgattcatgctgccggatatgaggggtgccggcgcccgtccatcatacgtggaaaatacgaaaacagcccgaaaccgaaacggttccgggctgaatttcacggtttattcgcgcacctgcatcatcaggctcacgattgcacccgcgaatcgactcacttagcggagttgtcgcggcgctcggcaatacgagcggccttaccgcgcagagcgcgcaggtagtacagcttggcgcggcgcacacggcccttacgcacgagcttgatggagtcgatggacggggagtgcaccgggaagcgacgctccacaccagtgccgaagctgatcttgcggaccacgaaggtctcacgcacgccagcgcccttacgagcgatcaccacgccggtgaaggtctggatacgggagttgttgccttcctggatcttcacgttcacgtcgacggtgtcgccgggacggaaggccgggatttcctcagccggcttcatgtgcttggcgtcaaaagcctcaacagcgttaaccattgttttccttcagtgctgccgcatatcagccacagatctggggccatccacgcgattgcgcatcacgtgcgttggcctgttctcgttatccctcgggtttgcccttgggaagcctgccgatccgccgaaagtcaggccttgcggccgttcggactggacccacggagacgcgggcttatgcggcggcccacttctcgacacagcaatcgattattgtacggattcttgcggacagaatggctgtcggatggcattccaacaccaaggcactgcgacgtagttgacagacctgcaggcgggctttatcttgggagcgtcggtaggcgaggctaccgcagggatatgggttgctgccgctaacagtggagacactgcacgcaggtcagcagttcttgtcggatcaaggcatgaactaacgcaattccaccgccctgcgatgctgaagcttgaacgatggcacgaatcggcggattcgaatactttccgcccctcctgctggtcgcatggataccgacgatggtattgatctggcgtttcagcgcacggcttgaaggaggtgagagtccgatggacggtgattattccagtagttccgccgccggcaacagtcatagttgcggtggtgatgaccatgttttcttatattccgttatccggaagtcgggctctcgcctgtagtgttccttggctccccggataacccttgcataattcgtctttcctatgcatagggaggtcttttcatgaccatgttttcattcaatcgcgtcggcgcgcgtccaaatgcgtcggcccgcaacccttccaccgccgcgtccgaccgccaaccattcgccgtgcgcctggcctccgacgtactggtcgcggccggtattctggcgctgttcggtctgatcgcttggattctgccggcgatcggcgaaccgatcggcccgaaaggagtgccgtcacaagtcagtacgaatctcgccgacctgccgtattacgcgctgcgctcggtgttccgtatgttcgtggcactgttcttctcactggtgttcacgttcatctacggcacggcggccgcgcgctgccgccgcctgagccgcgtgctgattcctctgttggatattctgcagtcggtaccgattctgggctttctttcggccaccatcaccatctggatggtgctgttccccggctcgatgctgggcgtggaggccgcgtcgattttcgcaatcttcaccagtcaggcctggaacatggcgttctcgttcacccggtccctgaccagcgaaccaactgaactcgacgaggcggcccgctcactacagctcacacgctggcaacgattctggacactggacgtgccgaacgcgatgattccgctgctgtggaactgcatgatgagcgtaggcggcggatggttcttcctgaccgcctccgagatgatctcggtgaacaatcgcacctatgcgttgcccggcatcggcagcttcgtggcacaggcggcggccgaggagaatctcgcggccatctgctgggccatcgtgacgatggtgctggtggtgctgcttatcgacgtactgctgtggaagccgctgaccgcgtgggcggagaagttccgcattacgcaaagcgagtcggcggtgcgcaagaccagtgtggtgctgaccatcattcgtcagtcacatatcgatgagatggtggcctggctgttcaggcctgtcgacgacctgttcgacacgctgacccgcccgttgggtcggaccggtggacgttgggcggcggacgtgaagtccgcacgcagccgcgcgcttgacgtggtattcacagtactggtgttggcagcgtgtgcgttcggactggtgcagcttatgctggtgattcatcgcgatgcgggattcggcgagctcgggcaggcgttcgtgttgggcatggtgacgttcctgcgcgtggcgctgctcacgctcgcctgctcggtgatttgggtgccgattggcgcgatgattggcatgaatccgcgcgtttcgcggtttatgcagccgattgtgcaggtgctggccagctccccctcgaacttcacgttcccgttcgtcacgctgtggttcgtggcgtgcagtgtggatatcaactggggcagtattctgctgatggcgttgggcacacagtggtacatcctgttcaatgtgatcgccggggccagccagattcccgacgatctgcgtgagatgacgcgcagcttccagctggggcgctggcagcggtggcgcgatttgattttgccggcggtattcggctcgtgggtcacgggcggcattacggcggccggtggggcgtggaatgcctcgattgtctcggaaatcgtaagttatggacggcatacgctgaccgcctccggcttgggcgcgtatatcgccgaggccaccgaaagcggcaacaccgtgaggaccatcatcggcgtgaccgtgatgagcgtgttcgtggtggccgtcaaccgcctgttctggaacccgctgcagcgcatggccgagcgccgtttcgcactgaactaaagacttaaggagaataatatgactgttgcaatggaaaccattcgttcgctgcgggcggtgaccccgcagaacaccatcatcgaagcccagcacgtcggccagcgcttcacggccgacaacggcaccgaactcaccgtgttcgacaacatctcgttcaacctgtacgagggcgagatcgtggccattctgggccgttcgggtgccggcaagtccacattcctgcgtgcgctggccggactggtcaagccgaccagcggcacggtcaagtatcgcggcaaggccctgaccggcccgaatcccggcatcgcactcgtgttccagaccttcgcgctgatgccgtggctcaccgtgcaagacaatgtggaactcggtctgaaggcgcgcggcgtaccacgtgcggaacgcaccaaactggctctggacgccatcgacatgatcggcctggacggcttcgaatcggcgtatccgaaggaactgtctggcggcatgaggcagcgcgtgggcattgcacgcgccttggtgctgcggccggacgcgctgttcatggatgagccgttctccgccctggacgtgctgaccgccgaaaacctgcgtcaggaagtgctcaagctgtggtcgagcgaacagcgcagcatcaagtcggtgcttatggtcacacataacatcgaggaagccgtggagatggccgaccgagtggtggtgttgggctcgcacccggggcatctgattgccgatgtgcgggttaatctgcagcgcccgcgcgaccgtcacagtgtcgaattcgaggcgatggtggaccgactgtacgcgattttgaccggacaggcctcgcagcctacgcaacaagccgaggctctatcgccatcggcatcgctcacgaacgcatctgtcacggacgcatctgtcacggacgcatcagaccttcagcccgccaagaccatcgagaaaatcaaggagcatccgctgcccaacgccacgccgggcgggcttgccggtctgctggatgtggttgccgagcatcctcacggcatcgacttggcagatttggcctcggctctttcgttcgaggtggacgacctgttcccgctggtggatgccggtacgatgctgcgcgtcatcgtggtacgcgacggccatgtgcaaatcaccgaggcgggcgactcctggcataaggcggacattctgcgcgccaagcaggtgttcgcctcactggcgatggaacacgcgccgctggtgcacaacattgagcatgcactgcggaagtctgcggaaggcaagctccgcggcgagctcatgctggacctgctgcgcgcccgttacgccaacgacgaggcgcatcagcagttcgccatcgccgtggagtggggccgttacggcgaactcttcgattacgatgccgatgacgatctgctgagcctggatgaggcgaataagggcgaataagcgaatcagccacgtgagttggctagatagtgcctttatgcctgcaaacagatgccgaagcggaatatgaccatgttcgactcatctgactgacagcaatccgtatatgcaaagtgcccggcatccgaagatgtcgggcactagtcgtgagagagactccctcagtcagctacactgacagctcctctcacccgagggggcaccagaggaacgaatcagaactcgcgacgtgggcagtcgccagactgcccaccagacagcacagccgcggtcgcgcgaatcacgaattctgaccgagcaaagcgaatcagaactcgcgccgtgggcagtcgccaggctgcccaccagacagcacagccgcggtcgcgcgaatcacgaattctgaccgagcaaagcgaatcagaactcgcggttcttgcggtagaacttgatcaggctctgggtggaggcgtcctgggcggcgagggcgtcgtcgtcctgggagatggccggggtgatctgcttggcaagctgcttgccgagctcgacgccccactgatcgtaggagtcgaggccccagacggtgccttcgacgaaggtgatgtgctcgtacagggcgatgagctcgccgactgcgaacggggtcagggccacgccgaagatggaggtggtcggacggttgccggtgaacacgcgggccgggacgatctcctccggggtgccttcggcgcgcacttcgtcggcggtcttaccgaacgccagggccttggtctgggcgaagtagttgcccaggaacagctcgtgcacgtcctggtcgccgtccttggtcgggttcggggtgttgacgaacgcgatgaagtcggccgggatgagctgggtgccctggtggatcagctggtagaaggcgtgctggccgttggtgcccggctcgccccagaagatctcgccggtctcggaggtgacgggggtgccgtcccaacgcacggacttgccgttggattccatggtcagctgctgcaggtaggccgggaagcggtgcaggtactggtcgtacggcagcacggcgtgggaggcgaccttgaagaagttgcggtaccagacgttcagcataccgagcagcaccacgacgttcttctcgaacggggtgttggcgaagtattcgtcgatctcgtggaagccgtgcaggaactcctcgaagcgggccgggccgaagacgacggccagagaggtgccgacggcggagtcgacggagtaacggccgccgacccagttccagaagccgaacgcgttgttcgggtcgatgccgaattcggcgaccttctccaggttggtggagacggcgacgaagtgcttcttgatggcttcggcgttcttctcgtcggagccgtcgatggcgcccttggccttgagctcttcgagcagccaggtgcgggcttcgcgagcgttggtcagggtctccagggtggtgaaggtcttggagacgatgatgaacagggtggtctccgggtcgaggcccttggtcttctcggccaggtcgttcgggtcgatgttggagatgtagcgggcggagatgccagcgtcagcgtacggcttcagagcttcgtacaccatgacggggcccaggtcggagccgccgatgccgatgttgaccacggtctcgatcttgcggccggtcacaccggtccacttgccggaacgcacgtcgtcagcgaaagcgtagatcttgtcgagtgtctcgcgcacgtccttgacggtgtcctgaccgtcaacgatgtacttgccctcgtcttcgaccgggcggcgcagcgcggtgtgcagcacggcgcggtcttcggtgttgttgatgtgcacgccggtgtacatagccttggtgcgctcatcgagcttgacggccttggcaaggttggcgaacagctggagggtttccggcttgatcaggttcttggacagatcgaagtgcaggtcgccggcgtcgaaggacagcttctcgacgcgctcggcgtcctcggcgaaccacttcttgaggctcacgccttcgacctgaagctcgtcatagtgcttctgcagggcagcccactcaggggtctgggtggcgtcaacgggcggattgatggccataggattccattcctttcatcagtgactggagcgcccttgcacacggctcggatgcgctccgtatcaccaaacagaatactcacaaattcggacatgaacagaacaaaatgagtcagcgatgtcggattgccatcgtttgcattatcgaacagttcgtggcgcggcgcaaccgtcatcttcgactgagcggtcgcgacacaaccgccaatccgccgattggacttttcgctgggatgtcttatacttaatttcttgtgcgcggctggcgaaatgccttccgcgaaccaagccactttagctcagtcggtagagcggctcactcgtaatgagcaggtcgtcagttcgattctgacaagtggctcggatgccctaggctggtcggtctgtaatggctgtccggcctagggttttgcatatctcccacacctgtggaaacgcggatatgcacgcgcgagtggcggaattggtagacgcgcaggatttaggttcctgtgtctttgacgtgtgggttcaagtcccatctcgcgcaccggcttgagcctcttggaagcattggattgccaacgcttccgggaggcttttcgtatatgcgcgcggcagctgcaagcccttgcggacacctctacatatggcaatgccaaggcggcaaatataatgggccacagcattgcgggtctgagcctgtgcgccatgagcctgtgtgagtcaaggagagaagtgtatgtccgccattcttacgccggttggtctgttgctgatcatcctcgccggctatctgttcaagcggttcggcctgttcgggcagaaggattatcgcgtgctgcaaaccgcggaattcaacatcgtgctgcccggtgccatcgtatactcgttcgccaccaatccgcatgacatctcgctgctgcttatttcggtattcgcattcctgtttgcttttatcccggtcgtgttcatctttctggccacccgcaagcgcaatgtgaccgaccgcgccttcctgatgctcaacggtgccggcttcaatctcggctgtttttctttcccggtcgtccagtcattctggggtgcgggcgcggtggtgccggctgcgatgttcgatatcggcaactgcgtgatggtggccgccggcaccaatgtgctcacccagcaactgctgcatattcagcccggcaaaacacttgccgaacaacacgccggttcggctcccaccctaccgtacgaaaagcccaaggatcgcgacgccaaacggcttgcccgccgcgcattgctgcgcaccatcggcaagagcttcttcggctcggtgccgttcgacacgtatctgctcatgatcgtgttgaccgtcgccaacgtgaagattcccgattggatcgcctctataacccagccattgagcggcgccaacgcgctggtgtcgatgctgatggtgggcatgctcatggacctgccccaatccaagcatgacgtgaaggaagtcatggccgtcatcgcttggcgtataccgttcagcgtcgccttcgcgttgatcgcgtggttcctgctgccgttctcggcttcgattcgcgccgtgatggtgatctgcgcgttggctccgatcgccattttctccacgctgttcaccgacaaagtactcggcaacgccaaactggccggcttctcgctggcaatcaccgcgatgatttcactggtgatgatggctgtggctcacgcgctgatgggcgtgtgagcaaatgcgcaagtaggcgcacggcgggcgcacggtcaggcgagacgcagcccacataggttcgtcccccggccgccagctgctaccggtgcagcagcttgtgcgccagattgctcacgccgaagcggaacttgtccaccggcaacgtgaatttgcctaccatctgctcgacgtagccgttgaagccctgcttgaattccagcacgccgcggccctcgtcgttcggatcgtcgaacacgccggaaatgccgtagaagttgtaacggctcacaccctgttccacacacaggtgcagcatcgcttcgtactgaatcagcgccgaggcgtagaacggcttgtactcctccaacgaaccggaatactgatagaccacctcattggggtgactgacgaacattgaagccgctgccggcagcacatcgcccttcttggcatatccctccacctcagccagacgcttgtcggcggccgcgagattgcgcgattcctcccccagctgacgttcgatgcgcgtggtcggacgttcatcgtatttcgtctgcagctgtgcgaccttggtctgcaaggcctcgcgcttggcggtcatatccgccacatattcggcgatgtggatttccgcgagcatgaaatgcgcatccgcgccatacgcctgcttgaactggcggaaatagtccgcgccacgcgtcgcgaacccacggcgttcaccggtccgccgttcgatatcggcgaacacgtcgaactcgtcggggccgatttcgcgaacgtgcacacccatcgactgcgcccgcttgacactccactgagcacgtttgccgaatgatgccagcagttccttgccgttggtgatgccggtgagatccttgacgtacatccactggcagaccacgtcataaccggtatggaatccgccatgcatccagccggcatcggtgaatccggtcagcagtgcatcgttcggctcgccgtcgggctgcccgtccgaggaatacagacggtaggcgacgttaggccagcatgccacggaaacagcatggtggcgacgggccgattcacgaatcgcctcggttatggcccgcagcagagccggatcatcgctaatgccgatggggccgaaatatacggagccatctgcaccgaaacgaccattgaggtacagaatcacgcagccggttaccagattgccggatgcgtcgcacacgccaacgcattcggcttcatgcccacgaatcttggcaagacggacctgcccggaccattgctggaagctgccctggcttgtggcttcggaaagccggtcgagctcttcgggcgtaatcacgccaaacgtatacgtcgtatctgttcgattcgcagtcgcgctcatctcgtcgtcacctgtgccttatttctgtgtccgtgctcgccactgtttgtcagcgatgcagcagcttgtgcgctgcttcggatacaccgaagcgcagtccgtccaccggcagcgtgaacttgcccggaagctcttccacgaatccgccgaagcgagtcttgaactgccagacgccgtaggaaggatcgttggcgtcgaaaataccggaaatgccgtagaagttgaagcgctccacgccacgggcgatgcagtcaagcatcgcctcgaagtggattagggaagacgggtagtaatccatgaaacgatcgtcctcgccgctggacaggcagacgacctcgttcggatgccagaagtagacaccggcttccaccggaatgaccgggccgtccgaagcgatgatgccattgacttcgccgatggtcttttccagcgccgtgatcttcttgtctgcggtggcgatgcgcttttccagcgttgccgggtcggaagcacccttcttggccgtgccttccggccgctgttgcgcgcgctggagcaggcgttcgaggttgcgcttgtctttggaggccgcattcagcttggattgcagggtgtccagatattcgtcgaaatgggtttcgaccaccttgaactcgatcaggtcgccgaaggtatcgaacagacgctcatagtaggccagatcgcggctcttgaagccttgacgtgcggcgctcatatcgcacagcttgacgaaagtgctcagttcgccgcgttccagccggcgcacgcgcagaccggaatcctgggcgatgcggatgttcttacggcggtacttggagaacgaggccagcagttccttctcattatgaatgccgtcaagccccttgacgaagttccagcggttcaccacggattcgtagcccacggtgaaaccgccatgtttccaaccgaagcgggccatgttgtccatcatcgtggtgtccgggtcgctggtcggcttgccgtccagatcatgcagacggtagactgcggccggccagcaggatacgctgatggcgtgatgggccttggccgaacgacgcagggcttcggtcatcgcctcaaccacctgtggattgtcataatcgcacagcggtccgcaccagaccgagccttccaaaccgaaacgggaccgcgtgtacaccacgtagcaggcggcaatcagcttgtcaccgcgcttgacacccacatagtccaccggaccgttgaacgcacccatggcggccatctgcgaggtctgctggaaactaccttgcacttgagctgcggagaacgcatccagctcggcaggagtgatcttggtaggggtgagtgaggcgacgcctgcatcggattgcgtcataatcgaaccttcttacttgtcgttactctgatcgttactctgggctctggaacggcctgtgtgctgcgtccgtttaccgcgacagcagcttgtgcgcaaattgcttcatggcataggcgaccggtttgaccggcagtacgaactcgcccggaagttcctcgacatatccgttgaagccctgcttgaactccagtacaccacgcccctcgtcatcgggatcatcaaagacgccgtcgatgccgtagaagttgtagcgagacagcccgtgttccacgcagaaatgcagcatcgcgtcatgctgaatcagcgcggaggcgtagaagggcttgtactgctcgacgctaccggagaacaggtagatgacctcgcgcggatgctccacgaatagtgatgccgcagccggcagcacatccccgtctttggcgaactcggccgcctcgttcaggcgcttttcggctgccgccagattgcgggtctcctcccccagctgacgttcggttttggtggtggggtgttcggcgtttttggcggtcaatgccgccaccttggccgaaagcgcttcacgcttggacgtcatgtctgctacgtattcgtcgatgtggatctcggcaaccataaaatgcgctttgctgccgaacgcttccttgaaacggtggaaatatgcttcgccacggtattcgaagctacggcgttcagcggtttgctgctcgattcgtgcgaatacccccagctcgtcgtccgacagctcacgcacgtgcacacccatcgattgggcacgcttcacgctccactgggtgcgcttgtcataggacttcagcagacttttctcatcggtaatgccggtcagatccttgaggtagcgccaacgcggaaccgccgtgtagcccacggtgaaaccgccatgagtgaagccgatcgcctcgagctgttctatcagcttattgtcgggagcgccattctggtcatccggcaaagaagctccattggtgtcgcgaagccgatacggggattcaggggtgatttccagctgtgaagcaccctttgccttggcatggcgtttcagcgcatccatgaagaaggtcaatgcttcggtgtcgtgatagtcgcacatcgggccatcatggatgaccgcaaatgtagagaatcgagagcggtgagtttcgaacagtgccgccgcgacgatcttctcgccctccttgagggccaaatattcgacgtcgatcccctgcgcggcgcgaaggcgtcccatcgccgaggtttgttggaaattgccttgtggatgcctggcggagaaatcatcgaactcctcgtctgtcaacttcaccagcacaaaatcacgcatgcttccctttgcctccgagtcaatcaggctcaccatgctagcatagcgcgcacacgacgaatggcggccgagcagatgaggtgtgcacatcgttcgcactattgccgccacgatggtccaaagaacaaatggcccaaagatgatgaatgtccggcttgcagtgaatcaaacgcagtgctatattctctacttggctcttgaagccacgccaccttagctcagtggtagagcatccccctcgttcgtgggaaggtcggtagttcgattctatcgggtggctcttgttcatcaagaaggccgacgcactaagcgccggccttctttcgtatcgcccttgctaggtcataggcgcttgctagacactcgcccgattcgggggctgagtgctgagccgcgactcaactgtggcttagtcgcggctcagtgcagctagacagcctagacgacttagtgcagcagggcctcgatggcggggaccaaggctttcagcgccttgcctcggtgggaaatcgcattcttctcggccggagtcatctcggcgctggtcagcggctcgccttcatggtcaggctcagtgctgacgcgaccggcaggctgatcgtccgggacgaacagcggatcgtaaccgaaaccgtgttcgccacgagcctcgcggatgatgcgacccggcatgtcgccgagctccactgtctccgacttgatggcgtatcgagcatgcaccggggcagggctcccagcggcagccgtggtgtgaacggtgatgccgtcggcagccactccaccggtcacgtcggcaccggtctcggtgtccgggaccaccagcgcggcggcgcaacggaagcgcgcggtacgcttgtcatccggaatatcttcgatttgggcgagcagcagcgcattattggccttgtcgtggccgtgagcacccgcccagcgagcagacagaatgcccggagcgttacccatcacatcgacgatgagacctgaatcatccgcgacagcgggcagaccggtacggatggccacagcgcgggccttgagtagcgcgttctcctggaaggtgacgccggtttccaccggatccggcaggtgaaggctgccagcggacaccagttcgatgttttcggcatccgcgccaagatcctcttcgagaatgcggcggatttccacaagcttgccttcgttatgggttgcgacgacgatttgcatgggttctcctttaagaaggctccccttgtcaggggagctggacattgcagaccgtacggcttccagccgacaacctcccctaaaggaaggggagctggcttagtctagggacaaagcggcacgctgggcggcttgcagttccttgttgcccttttcggccaagtcaagcagggtgccgagttcggcacggttgaacggacggtgttccgcggtgccctgaatctcgatgaaggtgccggaaccggtcatggccacgttcatgtcggtcatggcctgactgtcttcaatgtatggcaggtcaagcataggagtgccgttgatcacacccaccgatacggcggacacatagtccttaagcacgcggctggcggacttgatatggcggtgcttctccgcccaattgactgcgtcgaccaaagccacgtacgcaccggttacggaagccgtgcgagtgccgccatcggcctgaagcacatcgcagtcaagttgaatctgattttcgccgagtgccttcatatcgatgacgccacgcaggcagcggccaatcagtcggctgatttcgtgggtacggccaccgattttgccacgtacggattcacggtcggtgcgttcggcggtggcacgcggcagcatcgagtattcggcggtgacccagccgaggccggagtccttgcgccaacgcggcacaccgggggtaaaagtggcggtgcacatcacgcgcgtgttaccgcattcgatgagcacggagccttcgggggcgtcggtgaagtggcgggtgatgcgcacggggcgcagctcgtcgaccttgcggccgtcggcacgaattatttggtgattgccaagcatgtctttgatttcaaccatgcgccccagcatacgccatccgctctatgcctggatagcaactcgtcaaccatcatcaaaccccagcgcaatgtcattccctgcttacatatccattccatgacacttggctgcacgccactattttcttatgcaccactcgcttacagagtcaatgcctgcgtacctgatgaggattgggaaagatcgtccgctggaataagaatgccatattccatgaaatcttggttgaattgcttgcgctgcatagcgttgagttcgtaatcgattaacggcaaatatgtatagtccatgtcatgcaacggctcttcatatcgatgaagcacgtgcataattgccgcgctcggcagtggggaccaccatccatccaagccataccggtacggaggaaccaatgtcaagcgtctgttccttgggttgatatcccaacgcagaaaacggtataaaccagcgagaaacgcaatccagcacgcatcgttcacccgtgcaaccgctcggacgaacgatatacgttgatgttgaacattccgagcatgaatcagattgacgcagagcatcttcaacgtagaccaggtcgctccgctttctattgcatcgaaatcaggaggcctacgcagttgcgccaacaacatgtgcaattcgtcttccggaatcgtttgcgagggggccacggcttctaggtgaagaccaaaaccagcccgctcaagcccctcggccaaaacatcaaacaacatacctctttgcccacgcaatacgcgaccaattgcagaccgatccaaaccagtacgctgtgcaagctcataggcattccaaccagtctgcgacatcacttcattcagcacagccgcacacgaattaacagggcaaccagataccacaccgtgatgcacgacatcgcactgttctaacgctcgatgctctacagcgcgccgctctgatacgtcatcgttgcccgccgcgttctcatcattgagagtttcactcatcgaagtcaccttgcctcggccgatttcccggtcatttcatcaaaccgcaatcatcatatcccacaatcccatgacgatacgattcgtcatatcccacaattcagagacggtatgattcgtatcgcatcagttcacacgattcttcaacgattgctccgcaaacgattgctctgcacgcatcacggcattctatcggcacactattcctcccaatcagcccaacgcaacatcacacgcaacacccctcacgcaacacccctcacgcaacactgcgccatctctgtaacatcaccgacaacacggcaatcccacaacgtctcggtgcaatatcctctgaaatggtttggtttttcactccacctcgtcggcatcctgaccaggataggaatatgtgtcgttccgcaccatgtacaaaacgttgtcaactgacaacgctcttcaaatcaattggataagacaaatggccatttcccgccaattcatctgaatcaagacgttgtcaactgacaacaaaatgtacattgcaacagcatgcacatatacatatttccccggtgaacagtacccccccccaaaaaaaaaacaagggggggcgggttctagtgatcgttgcaacacctgacctaccgcaaggagggtcaggtgaccagaagccaccgaaacgaagaccgtggcggggaacaccgttggacgttcaacggcgtcgaatatccgacgaggaagctgatgtgcgaggcgagacgcgccgagtacgtgcgcctgctggacgaggaaggcatgaacttcacccaggccgcgcacgcggtcggcgtctcgaaacgcaccggcaaggcgtggcgcaacggcaggacgcgcgccacgggaaggaacgagaaacccctggtggactggtatcgttccaccatggacaaacccaagaccctccatccgcgctacctgagccaggaggagcgcatccagatcgcggaccgtctgcgtctgggcgattcgatccgcgccatcgcccgtctgctgggccgcgaccccggcacggtcagccgcgaggtcgagcgcaacaggaatcccgagtccggcggttacgagccttaccgcgcccagcagaaggccgcggaccggctcaaacgccccaaaccgcgcaaggcggccgagggcacgcgactgtgggacgagatcgccgccgggttgcgcaggcattggagcccggagcagatagcccgcgatgtctatttagaagtgcaacacccttgttggtcctgtaattctaacagttcgtcggcgaacgcctcggcgggcgtgcggtagccgagcacgcgcatggggcggttgttgatctcgtcgacgatcgctcttgagttctcaaaccaccaccacaccagccagacgggaaaccaaccagaggaaggaacccgccgcgctgagcggcaacaggtgaataacttacacgcatgtccggattcacgcaaatcaaggcacgcaaaaacccaaggaatcgttgcaatcacacggttccctcggcgtgtcgcaaacagcctatttgcgctgttctgatatcagaataatccgttttgcattgccgatgcgtaacaaattcatgtgttcaccggcgtgttgcaagaattcgattgcgtgaccatccaggttcaccttctcgcaaccggtcatcgcatatgcaaaaagggacttccctttacgggaagtccctttcagtagctattgaagctcgctagcctcaggccagggtgttcgggtcaaccggaacgcccgggttcatcgtggaggtgatggttgccttggtcaggtaacggcccttcacggtggacggcttcagacgcttgacttcgtcggccacagccttgaagttctcgtccagagcggactcatcgaagctcatcttgccgatgaggaagctcaggttgccgttcttgtcgacacggaactcgatcttgccgcccttgatgtccttgacagccttggtgacatccatggtcacggtgccggtcttggggttcggcatcaggccacgcggaccgagcacacggcccagacggccgaccttgcccatcatgtccggagtagcaaccacggcgtcgaagtcgaggaagccgccctgaacctttgcgatcaggtcgtcatcaccgacgatgtcggcgccagcctcggtagcctcggtggccttcgggccacgggcgaacacgaggaccttggcggtcttaccagtgccgtgaggcaggttgacggtgccacgcacgagctggtcggccttacgcgggtcaacgctcagacggaacacagcctcgacggtctggtcgaagttgtaggagggcatgctcttgagcagagcgatggcctcgttggcggtgtagaggttgttgcgatcgacgcgctcagcggcttcgcggtacttcttggaacgctttaccatctgtccttctccttatcagtccgtaaccgtgatgcccatcgagcgagcggtgccctcgatgatcttcatgccggcctcgatatcgcgagcagacagatcttccatcttgatctcggcgatttcgcgaacctgcgccttggtgacagagccgaccttgtgggtcagcgggttctcggtgcccttctcaacgccagcggccttcttcagcagagctgcagccggcggggtcttgagcacgaaggtgaaggaacgatcttcgtaaacggtgatctcgacagggatgacctgacccatcttgtcctgcgtctgggcattgtatgccttgcagaagtccatgatgttcacgccatgcgaacccagagccgggcccagcggcggggccgggttggccttgccagcctggatctggagcttgatcagcgccgagactttcttcttgggagccatattatggttcttctttctataacgcggttcgaatggtcgccgtcctcaggttcggctgtctgccatcatgctcggtcttgactcgttatttatccgtgcatgctgcaggcaatcggcctgtggtcggtctcctcccgcaacttatattgctgtgctgtgctagcgagtctcctctccagacacaagctttcctattatgcaaatccacccggacaacacaaaaagcccgaccacgatggtcgggctctgcaaagtttgggagttaatctagcttctgaacctggtggaagccaagctccaccggcgtatcacggccgaagatggacacgagcacggtgagcttctgagtggtgggctccacgtcggaaacaacggcggccatggtggcgaaaggcccatcggtgacggtgacctgatcgccaacggcgtaggagacttcgaccttgcgcttcttggcggcggcgggcttgtcgccggcggccttgagtgcctcggaagcaatcatcggagccatcatcgccacgacttccttgcgggagagcggcgccggatccttggtcgggccaacgaagccggtcacgccttcggtctcacgaacgatacggcgggcgttctcatccggccacatacgaatcagcacgtagccaggaacacgcacgcgggtgatgaccttcttgcccttctcggtgtgcttctcgacttcttccatcggcacctcgacctggaagatctggtcttccatgccgaaggaggcgacgcgggactcgatgttggtcttcacgcgcttctcgtagccggagtaggtgtgcagcacgtaccacttgccatcaagggaacgcagggacttggagaattcgtcaacggcctgctgaccggcatcggtctcctcggcctgctcggattcgttgacttcttcctcgtcctcatccagagaaacggtctcggtctgagtggaagcaacgggagcggattcagtcgccgccggagcgtcggactcaacatctgcattgtcgacggatgcgtcagattctgcggaaaggtcagcgaccggttcgaccggggcagctgcctcatcggcagcagcttcggaagcctcgacaacaggctcctcagccgggacggcgtcgaggttctcgagattcagttcatcactcatgcgttgttattcaccttaggttgtgcggatcagccgaacacccacagcgtggccttgcctagaccgaagtccatgccagtcacgagggccatcagcagcagcacgaagatgaatacggccagagaccagaagaacagttccttggcggtaggggtcacgaccttgcgaagctcgtcgatgatctgcttgatgaacagaccgatacgcatgaagacattcggcttgactgccttttcactcttgctcgtcttagccattccgtacctcgcgtcagctgcttgattattagaaacttggcagggaaggcgggactcgaacccacaacctacggttttggagaccgttgcgctaccaattgcgccacttccctaggtgaaaatccacctcggcgtgcgttccgtagagaacgcttcgccacggcgaaaccgccaagtcgttatagtaacggctccggtggattatcgcaaatcgcgtgtcgcgcgcgtagcacgcgactcttctcagttagcccattccttgaatcgacgcatgccttcggctaggtcttcgtcggccagtgcgtaggagaaacgcaggtaaccgggagcaccaaaggcctcgccggggacggcggccacgtgggcctcatccaacagtgcagcggcaaagtcagcggacgtatcggacactgtgcccttgggacccagcggcttgccaagcaaagcggtgatgtccgcaaaagcgtagaacgcgccggtcggagtcgggcagttgacgccctcgatatcgttcaaggcggtcacaatcgcacggcggcgcgcgtcgaaggccttacgcatctcgtgcacctcatccagcgggccggccacagcagccaaagcagcacgctgggagatgttggccacattggaggtcatatgaccctgcagcttggcggcggccttggccacctcaagcggagcgaccatccagccgacacgccagcccggcatcgcataggtcttggccacgccgttcagcaccagcaactgcccgcggcattccggcacggcggcaccgatgtaggtggtgtgcgcatcgtcatagttcaggtgctcgtagatctcgtcggagataacccaaatgtggtgctcgacggcccaacgaccgatcgcttccacggtttccggcttccagacggctccggtcgggttgttcggggagttgacgatgattgccttcgtatgctcggtacgggccgcttccagcgcctcaagcgagggctcgaagttcacgtcggcaccggcgaatacttcgaccggcacaccaccggcaagcttcacagcctcggggtagctggtccagtacggagcgggaatgatgacctcatcgccatcgttgagcaagatctggaaggattcatacacggcctgcttgccgccgttggtcaccacgacctgatcggcattgacctcatagccggaatcgcgcagcatcttagccgcaatcgcttcgcgcagctcgggcaggcccggcgtaggcgtgtacttgtaattcttcgggtcaaggcaggcatctgccgcagccttgaccacgtttgcgggggtcgggaaattcggttcacctgcgccgaagccgataacgtcaagtccggcggccttcatggccttggccttggaatcgacggcgagcgtagcgctcggtgccacagtgttgatacggtcggaaagagtctgccattgcgccatagtcatggctcccatgctaaacctacagcacgaaaaatcgccagagccgcactatggtgatggaatctgtcgtgtgacagattccatcagtcacacgagcacgagattgtcgcgatgaaccagtgggtgggcgtactgggggccgaggaaacgcttgagttgggcggtgttacgcccgagcatctgcggaatttcttcggaatcgaagccggcgaggcctcgggccaggtgttcaccgctttcggcatcgatccagaccggatcgccggcggaaaaatcgccatgtacttcgagcgcgccggccgccagcagcgaggcacgcccgccgcgaatcgcctggccggcacccgcatcgaccacaatcatgccgcgcgggtcggcggcgaagccgatccacagacggcgtgaggagccgcgggccttaaccggtgcgaacacggtgcccaccggatcgcccatcatcgcagggcccgcgttcgaggcgcaggtgagtaccgtggggatgcccgagacggccgccacgcgcgcggcctcgagtttggtgaccatgccgccggtgccgaccttggagccggagccggagacttggatgtcgcccagcgcatcaatcacgttgggcacatattccacacggcgggagccgggctgcgagggcggcgcagtgtacagcgcgtccacgtcggtcagtagcaccaaggcttcggcccgcaccaggttggccaccaacgcggagagtcgatcgttgtcgccgaagcgaatctcgttcgaggccaacgaatcgttttcgttgatgatcggcaccacgccgaggtcaagcagacggtccagcgtgcgttccacattgcggtactgggtggcacgaatcgtatcttcggcagtgatcagaatctggccgacgcgaataccgaatcgaccgaacgcagtctcgtagcgggccatcagtagcccttggccgacggctgcggtggcctgctgagtggccacgtccaccggccgcgagtcaaagcccagaggcccgaaaccggcggcgatagcaccggacgagaccagcaccacacgtccgcccatcaatcggacctgagccaaggccgcggccaacgcgtcgagcttgtccgggtcgaggtgaccgctcggctgggtcagcgagctggagccgactttcacgacaatggttccggctgcggcgatcatgcgccgcacctcggcctgactcggagtgctcatttattcctcggtttcaccatcttcgctggactcaccgtggccgaacaggctggtttcgtcatggcgatcgtcgtcaacggtcgggtcggcccagtggccggccttgcgttcggccatcatcgcgtcgcgcacggcggcacgggcgtccatcatctcgtggtattgggcacgacgttcggcgttggagcggcggtgcgtgcgcgggtccagctcttcgagacgcagatccttgcctcgggcaccgaggttggagccgtcgagcatttcggcaccagcggagatggtcggatcccaatcgaattcgaccatacgggcaccacgaccgatgcgcacttcgtcgccggggtgagcacccttgcggcgcagctcgtcctccacgcccagcttggccaagcggtcagccaggtagcccacggcctcgtcgttgtcgaagttggtctgcatgacccagcgctccggcttgacgccacgcacctcgaagaacacttcgccattgccgagttcgcggcgctcgaccgtgaactcaagcgcactgccgccctcgtcagcacgacgcggacggcggcccttggtctccaatggcttgatgaccacgcgagcctcctcttcggcctgctcgcggttggccacttcctcacgcatctcgtgcaccagcgcagacaacgcgaagttgagctcctttagaccctcgtgcgaggcagtggagatctcaaagaccttcagcccgagtttctcgaactccggacgcacgaactcagccaattccttggcctcgggcacatcgatcttgttcagaatcacgatgcgcgggcgttcgggaatcgggatggcacccaacggcagctcgagcttgtcggcgtagagcgccaactcgttttccagcgcgtggtagtcggacatcgggtcgcggtccggttcaagcgtggcgcaatcgatcacatgggcgatgatttcggtacgttcgatgtggcgcaggaactccagtcccaggcccttgccttcggaggcgcccggaatcaggcccggcacgtcggcgatggtgtatcgagagtcgccggcgataacgacgccgagattcggcaccagcgtggtgaacgggtagtcggcgatcttcggcttggcggaactcatcgccgcaatcagggacgactttccggccgaggggaaaccgaccaacgccacgtcggcgatggacttcaattccaaaatcacgtcgcgctcttcaccgagttcgccgagcagggcgaagccgggggcgcggcgggtcttgttagccagggcgatgttgccgaggccgccggcaccgccttgggcgacgacgcagcggtcgccctcgtggcgcaggtcggcgagctgtgcgccgggatgcttggctttgccctgttcgccgcgcgcctcaaagacgacggtgccgcagggcacgggcagaatcaggtcctcgcccttggagccgtccttattgtcgcccaaacccatggtgccgctgccggcgacacgatgcggcatgaaacgatagtcgagcaggctggtggcgttacggtcggccacgaacaccacggaaccaccgtcgccgccattgccgccgttcgggccggccaacggcttgtatttctcacgacggatgccggccgaaccgttgcccccatcgccgcccttgacatggacggttactcgatccacaaaatcactcatattgattaccttacaaaaaagccgcgtccttacgggcgcggcttgaaaaaagcttgacgctatatcgctcaggcgatgacgtcgacaaccttgcggtcgcgacgcacaccgaacttcacggaaccatcggtgagggcgaacagcgtgtgatccttgcccatgccgacgttgtggcccgggtggaagttggtgccacgctggcgaacgatgatgttgccggccacgacggcttcgccgccgaacttcttcacgccgaggtattgcgggttagaatcgcgaccgttgcgagagctggacgcacccttcttatgtgccatgattcatggtcctttctataactcaggcaatcgccgtgatcttgacgatagtcagcttctggcgatgacccttacggcgagcaacaccagtcttgttcttgtacttctggatgctaatcttcgggcccttggcttcgtcgttcacaacctcagccttgacggacaccttggccagatcggcggcggcaagggtgaccttgtcaccatcgacaacgagggagaccgggaattccacggtatcgcccttcttagcgtcgagacggttcacgaggatgacgtcgccaacctcgaccttttcctgatggccaccggccttcacaatcgcgtacattatcgttccttttatgttttggaaagctaccttgcctaacacgcaccgagcttgcggtcagacaccgaatttcgaatctacaccaccatgcggactaaatcaaatgatttttgcccgcgtgtcaagcacgacacacctgttactcttccgcttactcttccgccgtgttgttggcagcgacggcagcggcggcaatctgagccagtttggctttgacgtcggcgctggaaccagccggttcgggagcgggagcggtgccgcgaccgtgcttgttggttttgacgaacgggtcgccaccgcgaagcgcgtagggatcgtcgtagtcggccgaaacggtcggctgatcatgcaggatgaaaccacggcccttgcaggtcgggcattcctcggagaacgcctcgaccagaccctggccgatgcgcttgcgggtcatctgcaccaaaccaagcgaggtgacttcggccacctgatgcttggtgcggtcgcgtgccaagcattcgaccaagcggcgcagcaccagatcgcggttggcgggcatgaccatatccacatagtcgatcatcaccatgccaccgatatcgcgcaggcgcagctggcgggcgatctcttcagacgcctccaggttgcaacgcgtcaccgtctcttccaaggacttgcccttgccgataaagcggccggtgttcacgtcaatggtggtcatggcttcggtgcgatcgatgacaatcgagccgccggacggcaggtagacctgacgctccatgcccttacgcagctgggagtcgatggaccacttgtcgaacacgtccttgccttcatgctcggccgggtcccacttctccagcttgtccttcaagtcgggggccatggtgtcaaggtattcctcgatacggtcgtagaccttgtcaccttccacgatgagcttgctgaagtcgtcgttgaagatgtcgcgcaccacgcggatggccacgtcgggctcgccctgcaggagcttcgggcgcttgccgtgccagaattcctcgcgcttggcgttgatgcgctcccactggcggaccagtgattcgagatccttgacgatggcgtcttcggatgcgccctcggctgcggtacggataatcacgcccatgtctttcggggcgatcttggagacgatgttcttcagacggctgcgttcgcgctccgaaagcttgcggctcacgccggtcatgccgccggatggcacgagcaccaggaagcggccggcgagcgtgacctgagaggtcaggcgggcacccttgtggccgatcgggtccttagtgacctgcacgagcaccgggtcgccggacttgaacgccagctcgatgcggcgcggctggccttcgagacgagcggcatcccagttgacctcgccggcgtagagcacgccgttgcgggcctggccgatgtccacgaatgcggcctccatgctgggcagcacgttctgcacgcggccaaggtagatgttgccgacggtctgtacttcctggatgtcggagacgtaatgctcgaccagaacattgtcttccaccacggaaatctgggtgtgatgttccttctcacgcaccaccatcaggcggtccacgttctcgcggcgtgcgaggaagtcctgttccatgagctggctctggcggctgcgctcacggcggttgtcacggcggcgctgcttcttggcctcgagacgagtggagccctccacatcagtgatctcgtcgatgtactgctgcttgcgggagcggcggaccagcggctgttcgctgttctgactctggtcgtcggtgccctcgccgttcttgccgccacgacggcgacggcgacggcgagtaacggtctgctcctcatcgtcctcatcgcgatcacggtcatgatcatcgcgatcgtcacgacggcgggaacgcgtatcttcggcatcgttctcggcggtatcgtgctcgccgttggcaccggtttcgccgcgtgagccgcgacggcggcgacggcgcgaacgggtgcgggtggcgtcggattcttcgtcgccctcctcttcggcaatcggcgagtaggcgatatcgtccagctcgaggtcttcctcaatctgctcgacttcggcggctgcacggcgctcctgggcgttcaggcggcgggagcgacgggaacggcgagagtcggaagcgtcatcggaatcgaaatcatcatggtccgtgttggcgctggcattggcgtcaccggcggcagcgttgcgggaagcgtcacgagacgcatcacggtcggcggcattgcggccacgatcgtcacggtcgtcacggcggcggctgcgcggctgcgcgtcgtcatcatcgtggctgcgcgagcggcgggagcgacgcgacggacgttcgtcgtcgtcaacatcgtcatcacgagtgtcagcggtatcgtgcgcatccacagcggcgggcagtaccggttcctggaagagcagggacgtcatcggcttgccgcgacgcacggcctcgtggccagagggcagggattcgaccgcgtcgaacaggcgctcatccggggtgtcctcgtgcgtatccgcaactgcacggcgagaacgacggcgaaccggacggtcctcgtcatcatcatccatatccatagacgcacggcgagagcgggagcgaaccggccgatcctcgtagtcatcatcgtcggactggcgggagcgagagcggcggcgaaccgggcggtcctcgtcgtaatcgtcatcgtccacaaccgaacggcggcgggaacgtggggcgtcatcgtcatcgaaatcatcggcactgacagtgcggcgcgaacgacgaggacgatcatcctcgctatccgagtcggccactgcggaagcggcgcggcgcgaacggcggcgggttggacgttcggcggaatcctgggaatcgctggattcatcggaatcgctggaatcggctgacttggaatcggccgcagtgccggcatcgggaagcgcgggggcttcgaacagcggggcgcgttcctgcacttgcagttccagagaagcgccggcagcaccggtgccgcggaccacgcggcggccgccacgacgacggcgaacaggttcggcgggctgggaggcggcggcaggcgcagcgttcacggctgcagccgaatcggcattggatacggttgaattatcggttccgtcgttgacgaaaccttcacggttgtcagtgggcacaatgctcctcgcggcgcgctgcatcacgacgcctatttccaggcctatacgcttgtctcacaccacgctctcaccgtggccgcacgaaaacgcgccgcgtaaaggcaacttcgtctcaagtctgtcctgcgggtggcggacaccggcgcttgcgttgtctcattctcaagagccgcaaggggatcgacgccatctcgcacgctgatggttatgcagaaccaccatcctttagtatgccacatattttgtgcgggcgtggcccggcgaggctgacgttctctcggctcccctcccccgcggtgacagcgcccctcagggaggggagctagagaggtgtcagaccagccagtcggtaaggattgcggccatggcggtcaggtcggattcaggcacctgctcgtcgtgcttgtgagccagcagcggatcgccggcaccgaggttgacggccgggataccgagctgagagaagcgtgccacgtcggtccagccgagcttggccagcgggtcgcggccagtgcgctccttaaccagtcggaccagatcctgggcgagcggggcgttcaggcccgggcgcgcggaggggctttcgtccttcatttcgatgccgtagccctcgaacacgccgccggtagccacatgctcgccattgccgagttcggcaccggcgtccgcgcccatcatcagagccttggcctcggccaacgacttgtccggggcgaagcggtagttgacgtgtacgcggcattcatccggaatgacgttcgtgcctttgccgccggagatcagcgtggcgttgaggccctcgcgatagtcgagcccgtccacgttcacggtggccggctcgtaggcgttgagtcggttcagaatgtcggccgccttgtggatggcgttctcccccatccacgcgcgggcggagtgcgcggccacgccgtgggttacgacgtcgaagcgaatcgtaccgttgcaaccgccctcgatgccgctgttggtgggctcgccgatgatggcgaaatcgccggtgatccaatcgggatgggcctcgacgactttgcgtaggccgttcttttcggcgacgacttcctcatggtcgtagaagacgtaggtgaggtcgactttcggggtggtttccggcgtgcggccgtcgagcgtggcggcgaggtagagcatcaccgcgtcggaggccttcatatcggtggcaccgcggccccacagcacgcggtcttcgggatgagcgtgggcgatttcttcgcgaatcagcgaatcgccgggctccagccactttggtgggaaattgtcgatgaccggcacagtatcgaggtgcccggccaagatcacacggctcggcttgccgaagtcggtgctggccaccactgtgtcgccgtgacggcggacggtcaggtgctcttgctcgttaaggaaggcctcgacctcgtcggtgagggggccctcgtggtcggacacggagaagttctccatgatctgggtgagcaggctgttcagctgctcggcagtggatgcggtgcggttcaattcaagcgtcatgtgaacagcgtaccgcgtgggcggcgggcccagcacactcactacatgagattttgcggccgaatacatttttatgtgccacactggggtggcgaaagggaggattatgtcaggtctaatcagcgccatgcaaggcttctgcgttatcggcatcgtaatcgcggtgggatatgttgccgcacgaatgcgaatcggcgggccgtccgctcagatggtgctcaaccggttctccttcttcgtatcgagcccgtgcctgatgttcgcgattctctccaaggagccgattttcgacatcttccacccctcgattatcgtggcgttcttctccgccgtgctggtgggcgtggtgtttttggtgctcaaccgtatgttcttccacctgaatgccccggacgccaccatcggtgccctgaattcgctgtacctcaattccaataacatcggcctgccaatcgccacctacattctgggcaatccggctcttgtggcaccgattctggtcatgcagcaggccatcttcacaccggtgggcctgacagtgctggacgtgaccaccaagggcaaggtctccatcaaggaaatcgccaagcagccgctgcatcagccgctgcttatcggctcgctgctgggcattgtggtctctgcgatttccgctaaaagcggctggttcccagtgccgaaattcattttcgacccgatcgacatgatcggcgattcagcggtgccaatgatcctgatggcgttcggcatgtccctgcacggcaccaagccgctgcagcagaagggcgatcgaccggccatcttcacggtcgcggtcctcaagaacatcatcatgccgatcatcgcgttcctgctcgcctacttcgtgatgggcttccgcggctccgagctgtatgcctgcgtggtgctcgccgctctgcccaccggccagaacgtctacaactacgcggcccgctacaacgtgggcctcaccttcgcgcgcgacggcattctgatgagcaccatgaccagcccggtgtttatcgcgatcatcgcggcgctgctgtcgtgatgggtgcgcagagaagcgttctcaatagtatccgtgcgcgcaaatgcacagatatcgcacaaacgaacatttgctcatccacatatttacggtgatttcagcgttgctacgttcgatttgcgtatacgaaagtacgcacagttgttattgagaacgattcgctgcgcagctcggctcagtcatcagcccgataatcagtcagattcaagctggcggccacccgattggacgcgaacgcgccgatggaaaccagcgcatagcacagcacaagcccgccgaagaagctggccagcgtggccggttcggtcatcgaagcggcgaacagaggggccataagcagcatggaacagccgccggccacgatcaccacgatgttgagcggggtgagtacctcgatgaatcgcgcacggttcaaggtcttgacatcagtgccctccaacaccagcatgcgatattcgccggcctgatcgtacacgctgccggcctgcatcacaccggagctgaccgcggcaagcacagcggcgaacactagcgtcaggatgccgccggtgccgatgtcgcgaatgaacacggtggacgggtcgttggcgtcaccgaccacggcggccgagccaaagaatccgcagatcgaggtgatgccggcgatgaacacggccagtgcaatgccggacacattgcgccaggcgcgcttcggattgtcgagaatacggcgcatggcaatcatcgtggccgcatccttggggcgcttggccttggccttggcgcgagcggtgaccacccacgtgccgataagattcaccagtgcgaagcacagcagcatgaaaccgatgatcacggcgtccatcaccgcctggccggcctgaggcagcatggccgggttcttgaagacgatcacagccgccaccatgaccaccacgaacagcaccatacgggtgcccgagggcagtgcggtggcggtgcgcgaggtgacgcccaatggggtgatcgccacacgacgcaacgtgaccagcgacgaaatcagcgccaagatggccacgccggccaaggtgatcaccagagccaacggtcccacccacagctgttcgaaggtgaaccgctgctcctggaagggaatcagcatgactgccggcatcagggcgcaatagccggcaatgccgataagcgcgccgatcagcgcctgtccggcggcgtcaagcgcggtgagacgcaccacctgaccggtggtcgcgccggccaggcgcagggcggcgagacgggcgtcgcggcgggatgcggccagtcgtgcggcggaaccggcgagcgccacgaacggcacgacgagcagcatgcaggcgaataccgccaacgccacataggcggtggagaattgggccaggctcgtcgggtcgctgatctgccgtttccacgcggccaccgtatcgggccggcaggcaccgaagtcgaacgcgcaggcgacggtatgatcggccgaagcccgccagatgaaaccgtgtacgccgccgagcacggtgaggaagatggtggtggctgcggcgaaggcgatgattgccagcatcgaggtgtggccggcgctgccgcgcaagccggggcggtgaaacagccgccagagggcgaacgtgctcatcgcgcgcctcctgcggtggtttcgctcccgccggctggagctgccgagcgtagcgaggctgagggtggttcagcgccctcgggccacccccagtcagcctgcggctgacagcccccgccagcgggggcggagttggggttggcgtctgtctggtgcagacggccgtcctgcatcattacggtacggccgcagaacgaagcgacgttggggtcgtgggtgacgacgaccacggcggaaccgttgtcccgcgcggcggccatgagaatgcccatgacctcgcggccggtggcttggtcgagcgcgccggtcggctcgtcggcgaagaccacggcaggtttgacggcgagggcgcgggcgatggcgatgcgctgcatctgtccgccgctcatctcccccggccggtgcgtggcgagcgcgcgcaatcccatgcgttccagccacaggatcgccgtgtccgtggcggtgcggtagggcatgccgtcaagcatcatcggcagggcgatgttttcgaccgccggcagttcgggcagcagctggccggactggaagacgaagccgaaggcgttgcggcgcagtttggtgcgctcggcgtcgctcatgcggctcaggtcggcaccacggaagatgacggtgccggcggtcggcttaatgatgccggcgagcgcgtgcagcaaagtggatttgccggagccggacgggcccatcacggctaccgtctcgccctcccggagcgtgaagttcacgtggttcagagcgagcgtgtgcatggtcagcatggcgaagccgggctgggctggctgggatggctggccggcctgaatggcacccggtccggccgcagcggaattcgccgacgcataaccggctcccgtgccggctggcatcacaccggtgacgccgtgcccggcctgtgcgcgggccatgctggcggtgtagtccatgaccaggtcgtgggcctcgatgaccggagcccactgctgggtgtgcgatgccggttgctggaactgttggggttgctgagactgctgaggctgagccgccggtcccggcgccggctgaggctgctgcaattgcgatgctgctgtattcatactcccgagcgtacggagcgaacgcccagccgaccatcgggctgcggtatgaacctttctggattaccggcccgctcctcatccgcaaggattagagatacgcaaatgattaatgaccggcaaccactattcggtgccggtcattatgagcattgcattcaggcgctacgcgcattattgcgcggtagccaactcgtccaggcgggcggcgaagcggggccagtcggtcttcatagcggtgaggagcttgcggttgggcacgtcgtcaatcgggacccagcagatttccatgctttcgtcgtcgtttgccttgggctcgacggtgtggccgggcttttcaaaggcaaacacggtggtgtaggcccacgggccatggtcctcgcggtaggagccgaccacctcgatgtcttcgggggtgatgttggcttcctcgtagctttcgcgcagcgcgccttcgatggacgattcgccgtccgcagtggcaccgccggggataccccacgtgccaccttcggcgctccacgcggcacggtgctgcatgaccacgtgggtcaccttgccactcaccgggtcgcgacgagccagcagaatgccggacgcaccgttggtgccccaatgcttgcggccgcaggcgcagtccacccagccatcgccgggctgatgcacgttttcgaccggcggcagaatgccagcgtgctggttgcccgaggccttgctttccggctccagttcgccacggccgacattccacaggtcggtccacgtgatgcccagttcgccggccagatgccgggccagcggcaggctgaggccgatgataccgtgcggatcgccctcgatgctgtcgatgaacgcgccgccgaagccttccagcgtgaacgatccggcgacttccagcggctcgccggtgacgatgtaccgttcgatgtcgtcatcggtgaattcgccgaaatggactttggcatggcttgcgccgcgcacggtacgtccggtcgcgaaatcgatcaggcagtggccggtccagagttcaccggtcgcgccgctcatgcgcttcagtcgttcgcgggccacggcttcgctgtgcggcttgccgtaacattcgccgtccaggaggaacatcgaatcacagccgagaatcagcgggccgaccgtcgcctcggtcagtcccggctgtccggcaatagcggtggcgatgggttcggtgatggtcggcatgtcgatgccggagaagtcgcgcgtggtggcgacttccgccttggaatagtcgatgggctggccagcggcggctttgcgcaggtcttcgacgacggcttcgcgttccgaatccttgatttccttggccttgagcgggtaggcaatcacgcgatcgccggttgcggcggcggcagtattggccacatcgcgatacgcacggtgaacggcctcggccttggctgcggcaagaatcatcacacgctgcttgatgatcaaatcgtcgacggtgacaccttcctcacgggcggccgcttccagcgcagcaggctcatccacgtgcgagacgcgaattgtggggcagatacccgccgaatacagcacgtcacggcgaggcttggacttggaagcaagaattagcggaatggacatgacttaagtccttatgctcccgctggcgggagctgtcgaacgaagtgagactgagggtggtctctgccggtatggcggaccaccctcagaccgcctgcggcggccagctcccgccagcgggagccttctcctcgacttagcgacgctcgatttcgacgccggcggtgttgatgggcaggtgaagcacacgccaatggccggaagcaagctgctccgatgcgatctggtcgatggcttcgcgggcgttgccgtaatgcagcacgagcacgcaggggccggcaccggagactgcggcggcatagcccttggagcggaagagcgcaatgagctcggtggacggcggcatcagggcaccgcgatacggctggtgcagtttgtcctgcgtggcggtgaacagcagcgcgttggactgggcctgagcggccgcaagctcgtcggcgaacgccgattcacgggttccgccagagcaagcgcacgtatcggcatcctgagccggggcagcggcgacgccggacttgccctgctgggcggcctgagccagcaccacgggattcatcgcagcgggcagcagacccacgcgagacacgttgtagacggcgtccttgtatggcagttccctaggcagcgcctgacgggccttctcagtggacagctcatagtcgggcacgaacacggcggcggtgatggacgggtccaccgggtagttgacggcgtggaatccgccgtgcagcggttcaccaccaggaacggcgaccgagccgacgccttctgcggtttcgaagtcccaagagacggtcaggccaccgaacacagccggggccacattgtccgggtgtccttcaatctgggcggccatatcgaagacggccggacggttgaggtcaccggtctgggcgaaggccgcggcggcggcgatgccggccacaatggcctcggcggaagagcccatgccacgagcctgagggatgttgttggtcgcttccagcgtgaagccgagtcggccgaggccgaacgtggcacaggcacggcggaaggtggagaccacgaggtgggtttcgtcgcatgggagggcgtcggcaccctcgccgtggatgatcacgtgggcaatgccgtcgttcgggtcgtcgttgagcgtgaaagtgagctcgtcatggtagtcgagcgccagacccacggtatcgaagccggagccgaggttggcggacgtggcgggcacgcgcacgtgaacgctattgcagattggattcatggttgttccttaaaaaggagctccctcatcagagggagcttgggtattcagctttcaccgttcgaccgcctcatcagagggagcttaggtcttgtcagtccagcacgcgcaggatggacgggtcgccggtgacgaagtcgagcgcctgcacggccttgacggtgttgcgcagggtttcctcgtcggtcaggtgggtcacgacgcgcaactgctgaatctcgccgtcgtagccgggatcggtcatggtgggcttcaggtcctggttcacaccgttgatggagacaccgttcttggcgaactcagcggcgatggcggccagcacgcccggcttgtcgtgaatcaggaagcgcacggcgaatgcagccttggaggcggtaatcggagccttcggcagattcttgtacagcgggatggacgggccggtgcagccagcagcaatgtggcgggcttcggtcaccacgtcgcccacgacggcggaggcggtcggagcgccgccggcgccacggccgtagaacatgaggtcgtcggcggcctcggccttgacgaacacggcgttgaaggagccatgcacggaggccagcgggtggttctcatcgatcagggccgggtagacgcgggcggaaacgccggcctcgccgttctcgaccacggcgagcagcttgatgaccttgtgctcggcggtagctgcagcgatgtcgtcggcggtgatcttggtgatgccttcaacggacacatcgtcgatggtcacggaggtgtggaagccgagggtggccatgatggcggccttgttggcagcatcgtagccttcgatgtcgccggtcgggtcggcttcggcgtagcccttggcctgggcgtccttgagcacgtcgtcgaattggagacccttggtggtcatctcgtcgaggatgtagttggtggtgccgttgacgatgccgagcatgctggtcaccttgtcgccgaccagggactcgcgcagcgggcgcaggaacggaatcgcaccacccacagcggcctcgaagtagatgtcgacgcccttggcctcggcggcggagtagatctccgggccgtacttggccagcagcgccttgttggcggtgaccacggaagcaccggattcgatggcggcaagcacgaacttgcgggccacggtggtgccgccgatgagctcgatgacgatgtccgagttggtggccacgctcaaagtatcggtggtgacgatggactggtcgatccacgggaacttctcagtttccttcgggtcgaggcaggcgacgccggtcagttcgaccgggcggccgatacgagcggacagttcgtccttctgctcgacaatcaggcgggcggtctgggagccgacggtgccggcaccaagcaggcctacgcgaatcggggtttcgttgttgcgagccaattcagggtccttccaaaaagttttctatatcccaccgctattttacggattatttccgacagcagaccgaaagtactcatcaaagctgacggcccttttcgtattatgacggatttggccgcacattacagactgtcaggcgctcacctctgcacgtggatcactcgctgacgtcgaggttgagtaggtcgtctacggtctggcggcggagcatgacgtgcgcgccggactcgctgacagcaaccaccgccggaatcagcgcttggttgtagttgctggccatggtgcggccgtatgcgccggtaaccggcacggcgagaatgtcaccgcgcttcaaatcggcgggcaactgcacttcgtgaaccacgatgtcgccggattcgcagtgcataccgcacacacgggcaagcatcgtttcagcggaaccggtgcggttcgccagacgcgcggtgtagtcggcaccgtagagtgccgggcgaatgttgtcggacatgccgccatccacagacacatacacgcgctcggcaatcgggttgccgtcactgtctttggcatcggacaagtgcacgtgcttgatggtgcccacgcggtacagggttacgccggcgggtgccacgatgtagcggccgggctcgaagctgatggccggggcgggcatgccgagcgcacggttggtgctgttgaccgcatccgccaagcgagcgagttccacgtcaatgtccattgaatcttcgccatcggtgtaggccacggagtagccgccgccgaggtcgatttcgggcaggatgtaggcgtcggtggcccacagggtcttgcgcagcagcatcatgcgcttggccgcgtgaatgaaggcgtccgcatcgtggatgttggagccgatgtgcgagtgggctccgaccagttcgagtacgtcctggttggcgaggatggtcttgagcacggcgatggacggaccgtccgcaatggcttccatcgcggcggccagcgccttgtctgtgtcggagacttcctcgtggctcaggtcgtacgggtacttgacgtcgtagtgcagctcgcgctctgatttctcggtcttttccgcgccattttccggggaatgcgtcgcagagatacgcgcgttggcagcggcaggcgtcacgtctttgaggtcgttcagcacgtcgagcacagcggcgtcggccccggcggccagcagcggcacgccgaacttctggtcctcgtgagcagtggagatgtactcgtggccgccggcgtggacaccgacggtgacgcgcagcatcacacgggcgcgtttgccgagcttgcgggcgatggcagcaacgcgttccggctcgtcgggctcgtcgaccacgattttggcgaagccctgttcgatggccagcgcgatttcctcatcggacttgttgttgccgtgcagcaccagacgacgtccgggaacgccagcggcgagggcgatcttcatctcgcccatcgtgcaagtgtccacaaacatgccggcctcggtgaccaatcgcacgacttctttggacaagaacgccttaccggcaaagctcacgtgcgtagtggaggtgttgaatgcttcggcggcagcgcgcacgaagtgcctagcacgtgcgactacttcatcagtgtcgatgagatagagcggcgagccgaactcgtcaagcagcgattcggcggtacgaccatgaaattcgatggagccttcggcattcacagtcgtagcggccggccaaattggagaaataggcataatcacatcttttcgggggcggtgacgccgaggaggtcgaggccgttggcgatgacctgctggacggcgtcattgagcttcaggcgggcggcggcacgggccggctccgggttcttggcaatctccaaggccttgcgagcctcgtcgtcgccacgggtttccggatcggtcagggccatcggcaccacgcgctctacgttgtaccacttgtgataggtggcggccagttcttcgaggtaacgggccaccttgtgcggctggcggtcgtcggccgcagtggcgagcacgctcgggaattgggcgagggcggcgagcacttcgccgtcggcctcggtgtcgagcagggccaggtcggcaccctcgtagctgatgccggcggcggctgcgttgcggtccacgttcttggagcgggcgtgcgcgtactgcacgtagtacaccgggttgtcgttggtgtgcgaggcgagcagggccaagtcgatgtcgaagttctggttgtaatcggagcgggccagcgagtagcgggcggcgtccacgccgaccacggagaccaggtcgtcgatggtcacgacgttgccggcgcgcttggacatgcgcacgggcttgccgtccttcatcacgttgaccagctggccgatgagaatctgcatgttcttgccgggctcatcgccgaaggccgcgcacatggccatcatgcggccgatgtagccgtggtggtccgcgccaagcatgtagatggccacgtcggccgggttttcggcgcgatggcgcttgtcccagtagtaggcgatgtcggcggcgaagtaggcgaactcaccattggacttgatgatcacacggtccttgtcgtcgccgtgcttggtggattcaaaccaagtggcgccgtccttgtcgaagatgtcgccgcgggacttgagctcttcgatggcggcgtcgaccttgccatcggcgtacaggctgttttcatggaaccagacgtcgaagttcacgcggaagtccttcatggacttctgaatctcgtcgaacatcatcggtacggcgcgcttgcggaattcctcgcgcacttcggtatcggcctcgccgagcggttcaccgtcatcgttcaggccctgatcctggtgggccagtgcggtcaggtccacgccgtcggactcggcttcggcctgaacacgggcggcgatctcgttgatgtaggcacccttgtagccgtcgcacggggtttcggtctggtagccggcctcacccaagttattggcctcggcccaagcggcgaccagcgacttggcgaagcggttgatctgctcgccgtggtcgttgaagtagtattcgcgcaccaccttggcgccgttggcctcgagcacgcgggccatggcatcgccgacggcagcccaacgggtgccgccgatgtgaatcggaccggtggggttggcggagacgaactcgagattcagggtctggccgcccagatggtcgttgcgtccgtattcgttgaccttgttgagatgcttgtcggcgtcggtcacggcaccggcggcgagtacggtgtccaccacggcggcggccgaggcggagtcaagcgtgatgttgatgaagccggggcctgccacctcgaccttggcaatgccgtcggcttcagcgagcgcggcggcgaacggctcggccagatcgcgcggcttcatgccggccttcttggccagctgcatggcgatgttggaggcccagtcgccatgcgcacggtccttcgggcgcatcacggcgagcttttcgacgggcggaatcagctcgtcggtcaacgcgccggcctggccggcggcgacgaggttgtgggcaatgctggaaatcagttcacttaaggcttcaggactcattcttctaaggatactgagaacggcgacacttgtaccctggtatgcctatatgctgcccctgctggcgggggcaagcacacagccgaaagataccaagcgaaaaagggtaggcgacaatctccggaatcgttggaggctcgccgaaaccgctatacataccgtcggtcggtatctatagtgatctgcaacatcaagcacagtagggaggccaccatggcacgtaacgctcaccccgaggtgacgcgcacccgcgtcctcgacgccgcacaacggctgttcatgaccaagggctatgagcacacctccatccagaacatcgtggacgagctcggcgacctctccaaaggcgcgatctaccaccacttcaaatccaaggaagccatcctcgaagagctcaccaaccgagacaacaatgtgcaggacgacttcaacgaatccgtcatgaatcgcactgaccttaccgccctcgaaaagttccgcgtgctatggcggcattcgatgaccgagcaagaccacgtgcagatcatgcgagccgccatgccgatgctgagcgatccggtttcgttcgccgcgaatatgcaggtatggagcaagcatctgcccgaacgcttcctgccgctgatcgaggcgggcgtcaaggatggctccatccccaccgagtatccgcgcgaggccgccgagctgctttcgttgctgccgaattattggctgatgccgtatttctacccggcgaccctgcccgaaatggagcatcgcatccgctgcttggccaccatgctcgacgcgatcggcgtgccgattttcgatgacgagctcatcacggtcgccgcgaagggcatgatgacgttcgcaggggagccggagaaaggctcagaatgaatagcacagtgaaacccgagaatgacatcgccggcaccgccacccaacgcccgctgctgtcccgcgacttcgtgctgctggtcgccggacaaggcatctcgctgttcggcaatgtgatgctgcgattcgcgatgtcgatgtgggtgctggacgaaaccggctcagccaccatcttcgcctcggtgctggccatctccatcgtgccgaccatcctgctctccccgttcggaggcgtgctggccgatcgcgtcaaccgccgcaccatcatggtggcgctcgacgccatttccgccgtgctcgtgctggcgagcgccatcgtcttcgccaccacgggcttccatatcgtagccatcgccaccatgcaggtgctgctcgccgtgctcggcgccttcgaaaccccgaccgtgcaggccgcactcccccagatgttccggcagtacggcccggccaccatgcgccaaggcatggccgtgatcaatcaggtccaacaactaagcagtctgctgccgagcttcctcggcggcgtgctgtatgcgatgttcggcatccgtctcatgatgatcatcgccatcgcaagcttcgccggcgcagccgcgctcgaatgcttcatccgcctcagtgccccggatcgcggcgacgaggagctgcccaccccacttgaagacctcaaggcaggcgtgcgattcctcatcaaggaccggccgaacgtgttcagactgctgttgttcgcggcggcgctcaactttgtgcttatcggctattccggcgtcggcttcccgtacacgattcgtacagtgctcggcttcgacgccactgtctacggcatcgccgacggcctgatcggtgtttccggcgtggcgggcgcattcatcgccggcctgttcgccgccaagctcacgatgcgctggctgccggggctgatggcgacgcttacgctggccatggtcccacagggtattgtgttcctgctgccggtcgacgcatggaccaaactcgtggtgctgatcgtattcacctgcggcacgatggtcgccagttgcttcacgaatctcatcgccgtgcccgccatccagctcagtacgcccgaggcaatggccggcaaagtgatgtccatggccgcggccgtgagcatgtgtgcccagccgctcggccagatggtgtacggctgggcctacgaccaaatgccggtcgccatcgtgctgttcatcaccaccgccctgttcgccgtgctcaccgtgctgatggttccgctcgccaagcagttcgaggactgacgatcggcgcgcacgccacatcctgccgcccggccataattgaatcaccgcacgaaaaggcacgaaaaggcacgaaagaggtacctatggccacgctcaacccccaatcattggtcacgttgtggcaaatcgaacagtatggttcgttctccgccacggccaaggccacgggttggtcgcagccggccatcagccagcagatcaaaaagctggaggcacagtgcggttcgactctggtgcaacgcacctcgcatggcgtggaactcaccgccaccggttcgatgctcgcccgccacggcgaggccatcgccgatcggctggagcgggcggcccgtgaagtcgaggattatcggcatcatcggtttgatcacctgcatttggtggccccaccgtcaatctgctctactatcgcggcccgtaccgtggtcaagctcagtatgttcacggacatcgagctgagcctgattcagatggagccgccggaggcgatcggtctgatttcccaaggcaaggccgataccgccgccgtgttccgctacagcagcatcccgaacttcctgcacatcggcgacgacctgaccttccattcgctgggttacgatccgatgcgactgctggtgcgccgctccagcggcatcgccaaacgattcgaggagaccggcgaacctgtgccgctgtccgccgccaaagacgagcattggatcgccggctgccccacctgccgcgcaaatttggtgaaactggccacccgtgccggattcaagccggatatccgccactgcacggatgattactgggccacgcagaacctggtcgaggttggtatgggcgtctcgctggtgccggcgctcgatacgcatatcaacttgcagggcgatctggtggcctgtcccattgccgacgattttgcggcgcgcgaggtcggcatcgtgactcgtgccggcgaccatcgccccgcgcttggttcattgctcgaggagctcgagcgcacgtcactcaaatatttgagtgccaagtagtcgcacagcgataagcaagcttgcgagcgccatcacgatttcggggagccagaccgttgagcagcccttctgcaccgggaacaatgacatgttatgagcatgaacaacattccccagtcaacgactttgagcaacacaaccgccggcacctcttgctttgatgccaatcacatcgacgtgacgaccatcgaggatctggagcaggtcggttcggataaatggacccgttaccccggctgcatcggcgcattcatcgccgagatggattacggtctggcaccatgcgtggccgaagccatcgaagaggctactgaacgtggcgcgctcggctacattcccgacccgtggaagaaggaggtcgcccgctcgtgcgccgcatggcagcgccgctacggctgggaggtggatccaacgtgcatccgcccggtgccggacgtgctggaggcgttcgaagtgttcctgcgcgagatcgtgcgcgccggcaactccatcgtggtaccgactccggcctatatgccgttcctgagcgtgccgcgcctgtatggcgtggaggtccttgagattccgatgctgtgcgcgggcgccggcgagagcagcgggcgcaatgatgaatggctgttcgatttcgacgccattgagcaggcgttcgcgaacggctgccatgccttcgtgctgtgcaacccgcacaacccgatcggcaaggtattgacgcgcgaagaaatgctgcgattgtccgatctggccgccaagtacgacgtgcgtatattctccgatgagattcacgcgccgttcgtccaccaaggccacacgcatgtgccattcgcctcaatcaaccggcagacggccatgcaggctttcacctccacttcagcctcgaagtcgttcaacattcccggcaccaagtgcgcgcaggtgattctcaccaatccggacgatctggaactatggatgaggaacgcggaatggtccgagcaccagacggccaccatcggtgccatagccaccactgcggcctatgacggcggcgcggcatggttcgagggcgtgatggcatatatcgagcgcaatatcgcgctggtcaacgagcagatgcgcacgagattcgccaaggtgcgctatgtggagccgcagggcacgtatatcgcgtggctggatttctcgccactgggcatcggcgacccggccaactatttctttaagaaggccaacgtggcgttgacggacggccgtgaatgcggcgaggtcgggcgcggatgcgtacgcatgaacttcgccatgccctacccgctactggaggaatgcttcgaccgcatggccgccgcgctcgaggcggacgggctgttgtagaaaattgtggctcccctcagagaggggagccgaggaacggccgaattaatcgaagtcggcacccaacgcttcgagtttgccgcggaagtcggcgtagcctcggtcgatcaggctgatgccgtgcacgtccgaggggcctgacgcggccaaggccgcgatcagatggctgaacccaccacgcaggtccggcacgtcgatgtcgcgtccggtcagcggggtcggtccgaagatcacggcggaatgcttgtagttgcgctgccggaaacggcacggcagcgagcccaggcactcgcggtacaactggatggtggcacccatctcgaccagcggcttggtgaagccgaaacggttctcgtacacggtctcgtgcacgatcgacaggccgttggcctgggtcagggccaccacgagcggctgctgccagtcggtcatgaacccgggatgcacgtccgtctcgatcgccacgggcttcaagtccccgcccggatgccagaaacgaatgcccttgtccgtcacctcgaatttgccgcccaccttgcggaacacgttgaggaacgtgatcatctccggctgggtggcacccttgacgaaaatgtcaccgtgcgtggcgagcgcggcggacgcccaggacgccgcctcgatgcgatccgtcagcgacgtgtgcgtgtacccctgcagttccttgacaccctcgatgcggaaggtgcgatcaacgtccacagaaatgattgcacccatcttctgcagcacgcacaccagatccatgatctcgggctcggtggccgcgccggatagttcggtcttgccttcggccagcacggcagccagcaaagtctgctcggtggcgcccacggacgggtacggcaggtgaatcttcgcgccatgcaggccattcggagcagtgatgtgaatgccgtccttatgttccttatccacggtggcgccgagcttgcgcagcgtctccagatggaagtcaatcggacgtccgccaatcgcgcagccgcccaacgcgggaatgaacgcttcacccaaacggtgcacgagcgggccggagaacaggatcgggatgcgcgacgaaccggacagtgtatccacgtcggccacatcggccagctgcacacgcgaggcgtcgatggtcacaatgccgttcgcaccgtccacatccacgtccacgccgtgcagacgtagcaaatcggacaccacatgcacgtcacgaatctccggcacgttcttcagcaccgacttgcccggtgccagcaacgcggcgaccatcgccttgctcacgaagttcttcgcgccacgcaccttgatcgtgccattcaaaggcttgccgccctcgacatgcaacacgtcatccggattctcagccacgccactctcctcaatcaatcaagattcaaaaaatgctaccgtccagtttgccataagccatgtgccgactccgtgaaatgcaccccagccgaactttgatcaccgtgcacaacggatcccataccccccgtcgaatcaaaccgataacgtgatcttcctcacatttgccgccacggtgttctccatacttctacgctacgattcagggcaatggcatcagacgccatggccacaagcaaaggagcattcatgaccacagtcgccgtcatcggctgcacgcacgccggcacgttcgccaccacctcgattctcgccgagcaccccgattggaccgtccatgttttcgagcgcaacggtacgctgtccttcctctcctgcggcatcgccctgtgggtgggcgaccacgtatccgacccgaagaaaatgttctactcctcccctgccgctctggccgaagccggcgcgaccatgcatatgcgcaccgacgtgacgtccgtggacctcgacgccagaaccctcacctaccgcgcgctggacgaggccggagaccccgccgaacagaccctcgctttcgacaaactggtcgtgaccaccggctcgcgcccggtcatcccgccgatccccggcatcgacagcccgcatgtgctgctgtgcaagaactgggatcacgccatcgccatcaaggaaaaggcgaaaaccgccaagtcggcagtggtgatcgggtcgggctatatcggcgcggaaatcgccgagcagttcagcgtcaccggcgtcaagaccacgctggtcgacggccttgatcgcccgctggccaataatttcgataagaccatcaccgatcaggtggcggccgcgttcgaggagcacggcgtcacgctcgcgctcggccagaaggtggtcgagttccgcgacaatgacgacgacaccgtcactgtggtcaccgaaaagggcgagtacacggccgaaatggcgattctggccgtcggcttcctgccgaacaccgacctgctcaagggcaaggtggacatgctgccgaacggcgcgatcgtggtcgacgactacatgcaggcgtccgcgccgggcgtgtacgccgccggcgactccgccaccgtgttctacaaccccaccggccagcacgattacattccgctggccaccaacgcggtgcgccagggcctgctggtgggccgcaacatcgagacgccgaccatgaagtacatgggcacgcaggccacgtccgccgtgcagctgtacgatctctcgctcgccgcctccggcctgacccgcgccggtgccgaacgccgcgggctcacggtccgcgagacctcgctcaccgaggattatcgcccggacttcatgctcaccaccaccccagtcacgtcgattctgacctgggacccggaaacccgcaaggtcaagggcggccagttctgttccaaggccgatatctccggcgcggcaaacgtgatttccatggcgattcaggccggcttcaccatcgaccagctcgccaacgtggacttcctgttccagccgaacttcgacaagccggtctactacgtcggcgccgtggccatgaaggcggcggccgagtaagacggctgtacccaccgcaaaaaagaaaccccggcgtgatgggcgccggggagagaaaggagagaagaagaaaaaagaggttaagttatgcagcttgttcggccgtgattacatataacaacaccagtttcaatgcaacgtgggcactggctgggaattgtctgggaatcacggcccgtacaggctgtttcttgttttggagccgatttaccggctcgccttgatcttgtgggccagctcggcgtcccacatcgcgccggttgcggacatcaccgaatccgcgccggcgtttctgtatgcctgatagtcggccggcgaaaccacgccgcccacgccattgatcttgaaatcaagaccgagcttctcgcggatcgcggccagacgggcgaccatgtcgaggccggcgccacgaatcgcattgccacacacgccggagcgatcgcggcctgcaccgggcagggcctgattgccattggcatcgaccagtttggcggaaatcgtattgatggtgctgaatccctgcacagtgccgtggcctacggtggaacgcaccatgagttcaaggtcgccgtcgctggggatgtaggcgagcttgaccatcagcgggatgtcgccgatctcctgcttcacggcctcggtgatgcggcccacgagcagcggattgtggcatagcaggcggttgtggccctcgttggggcagctggtgttcatcaccatgagcttggcaccggtttctttgaccaggcgggcggtggtggcatggtcggcgatgtattcctcctcgctcatgccctccacacgcgagccttggaagctcgggaccagcacttgaccggggccggcggcctcgatggcggcgcgcatgtccggctgccaggcatccgggctttgcgagggcacgccgaagctattggagatggagatcggagtctcgtaattggtgtcggcgagcacgccctcgtccagttcggcgctgcccggcgtcagtgaaccgtccgccgccttggggtgtacggcgagcacgttcgggaacggattgcagccccaggcgcgcgaacgcacggttttgtaggtcgccagatcgaagcccatgcggaaggcggccgtggtgaagcggctgttgagcagcgggcctgcgggaatgccgaaaggcaggttgaccggctggcccaggaaggaggccgaggcaccctcggaggcaccctcgctggtggttccggcggcatcggcaccgttgccatccttcagcgcctcggcaaacgcgccgaacggcccttgctcatagttgtcttcgtagctgcggctgacgtcgtaaaacggctcaaaatcactcatgcttcaacgataagccaacctacatgcgtacacgcacactcaacccaccatcgcgccgtcaaacgaaataatggcgaaagcggcattggctaccacaaagatgatgaacgtcggagctgcccagccaaagtacgtgtctggaatactacgattcgtacggtgatattggtgcaaacttaaatagtgcaaacacaccctagaagagataggagggaatggcactttctcgcgttgttggtggaagtatttgggacgctaagcgagttgccgcattggaaccagacgattgcgtgaagtgaccctatacgtaaaaggtctcactggcgagagccagtgagacctttgtctgatgcgatgcgagcgacccaataatctcaatcagacacagagccaacggccctgggcctgcaattatggactcgcctttcggcgaggctcaatgctggcctcgctgctgtcgcagctcggcaggccgatcgcggctaaataatgcctcgatcggccaacggccctgtccagtctgcgccctccggctcgcgggcggactcgattctttcttcggcccagtgtttggcggggatggtcttgggcttgaaggggaacttttcggcgcgcatcttttcgtagacggcgatgtcgtcctcgtgctgcagcgtcagatcgatgtcgtcgtagccgttcatcagacgccaacgcacgtaatcgttcacctcgaacggcagggtcacgtcaccgcaagtgacggtgcgagtctccagcgagacagtcatctcgcgaccaggctcttcctccagcagcttccacaggagctcgacggactcctgcggcataatcgcggccagcacgccgtttttggcggtgttgccgtagaagatgtcggcgaagctcggcgcgatgaccacgcggaaaccgtaatcgtgcagcgcccacacggcgtgctcgcgggaggagccgatgccgaattcggggccggcgaccagaatctggcccttaccggcgtattccggcttgttgagcacgaagttcgggtctcggcgccatgcgtagaacagggcgtcatcgaagccggacttggtcacgcgcttcaagaacacagcgggaatgatctggtcggtatcgacgttggagcggcgcagcggcacgcccacgccggtcagtgtggtgagtttttccataacaattttcctttcggggatctctcccccagtcagtcttcgactgacagccacctcgtcagagggggctcatgtgtattgactcagagatcggcgggggacgagattgtgccgcggatggcggtggcggcggctacggccggcgacgccaaatgcgtgcgcgagcccttgccctggcggccctcgaagttacggttcgaagtggaaatcgagcgctcgttcggcaccagcttgtccgggttcatgcccaggcacatcgagcagccggcgttacgccattcggcgccaaagtccttgaacaccttatcgaggccttccttctccgcctgcaaacgcacgcgggaggaggccggcaccaccagcacgcggtggatgttctcggccttgcggtggcccttcataatcgcggcggcctggcgcaaatcgtcgatacgaccgttggtgcacgaaccaatgaacacggtgtccacggcgatgtccttgatcggcatgcctggcttcaaacccatgtatgtaatcgcacgttcggcggcggcgcgcttggtggcgtcggcgatcttgcccggctccggcacggaggcggtgatcggcagaccttggccggggttggtgccccacgtcacatatggaccaagcttggtggcgtcaatatccaccaccttgtcgaatacggcatcgtcatcggtcttcagcgtcttccagtacgccacggcctgatcccacagctcgccttccggcgcgtgcggacggcccttcaggtactcgaacgtggtctcgtccggcgcgatcatgccggcacgcgcaccggcctcgatggacatgttgcacacggtcatgcgctcgtccatggtgaggttgcgaatcgcctcaccacggtattcgatcacgtaaccctggccgccgccggtgccgatcttggcgatgatcgccagaatgatgtccttggccgtcgcgtccgcgggcagcttgccgttgacgttgacggccatggtcttgaacggcttcagagacagcgtctgtgtggccatcacgtgttcgacttcggaagtgccgatgccgaacgccagcgcgccgaacgcgccgtgcgtcgacgtatgcgaatcaccgcacacgatggtcatgcccggctgggtcaggcccagaatcggggcgaacgcgtggacgatgccctgatcggcgtcgcccagcgggtgcaggcgcacgccgaactccttgcagttcttctccaaagtcgtcaactgcaacgcgctcgtctcatccgggttcgggcgatcgatatcaacggtcggcgtgttgtgatcctcggtggcaatgagctgatccacgtgacgcggcttgcggccggccaagcgcaggccctcaaacgcctgcgggctggtgacctcatgcatgagcatcagatcgatgtacagcaaatcaggggctccgtcgctgcccttgcgcaccagatgatcggcccagaccttctcggccagtgtcgttcccatagtgattcctccaaaaaattccgcgcgaggtattgtgttcgcgccttgttcgtggtattagcctatgtgcttgcgatgggcccggccatgagcatgccggatattgagatacggtcaaatgatggcctcaatatgactcggatacgactcgaacatgacctagtcatgactcggttccgctccagacatgtctcttcggcatccacgaacgccctttcaacttcatggccaccctgtgagacacttccccaatttgctatttcactatgtgagatggcataatcgcccttattatgactgattcccaagaagagccattgaacaacagcttgaccgagtccgagccggttgaagacaccaccgccaaggacgatggggaaatccattccggcgttggcgtccttgataaaaccgtaaagattcttgacgcactggagtccggcccgtccacgctgggacagcttgtggccgccaccggtctcgctcgaccgaccgcacatcgtttggctattgcactggaacgccaccgtttcgtactgcgcgaccagcatggccgattcgtactcggatcccgtttcgccgaacttgccgccgcagcaggcgaggatcgtctgctgaccgccgccggcccgatcctgcagaccctgctcgatcgcactggcgagtctgcgcagatttaccgccgccagggcgatcagcgcgtgtgcatcgccgctgtggaacgcacctccggcctgcgtgattccattcccgtgggtgccatgctgtcgatggaagccggttccgccgcccagattcttctggcttgggaggattccgaccgtctgcaccagggattgcgccacgccaagttcaccgccaccaagctggccgccgtacgcaagcgcggctggtccgagtccgtgaacgaacgcgaagagggcgtgtgctcgatttccgccccgatccgcaacgcctccggccaggtcatcgccgccatctcgatttctgggccgaccggccgcatgggcgccgctcccggacgccgttatgcgccgctggtgatggccgccggcaagtacctcaccgaggcactggtcaaagccgttcgctgaaacataccagtcaatccaaccgatagcccaaccggcagaaatcccgcgaggtatccgtcgagacgcgggatttctgccactaatacacagcggaaggcccccgaaaccccgaatacttcgcgccgcttcccgcctctatcaggaacagttacctgaataaaccggacagttgactccatagcgacggcttgcgcagcaaatcatcgccctcaccctcgccaggcgtggtctggttcaccgcataggtgtaggcgcgtttggaactgggcttgcccaccagttcgccaaactccagcaattgcgtacgcggctcgtaagggtgacggatatcaaattcgatcaatcgcgtggcacgtttggccggagccggtccgtacgtattgaatccgcaggttggcgtagcgataagcaacagaccctcatgttcgccgacgaaaccgttacgatgatcatgaccagctacgacgccgaaatacccctcgcgcagcaattcgaattcgcctgacgtatcagggcaggatatgccttctcccaaatatccgccgggctgggtttgcaattcgtccagcacgtagtaggtatcggcgtgcgaacgatagccctgcatggcaaacgccgcgttggccgccaccggcttcagcacgttgtaatactcgggcatcggcatgtgctggaacaccattgatttcgcaccgatacggtcgggcacggcgttcaggaaggcgagcgctgcgggcgatggtgcgccgaagccgccgccatgcacgtaatcgccggagtcaagaatgaccagacccagcacattgcgcgtatggtcaacgtccataaccggcagcgcgaaggtgcctggttcaccggaacccactgcggatgcgggggaagacacagcagaaggcacaacagcatcggcaccagcatcgtcaacgacgcccaacgtatcagccttcgcggtaatccccgcaccggagccagtggcaccagacggcgtctgcacagcgccacccgctccacaggtatatgcaatctggttcggcaaggtctcactcggcggattgacacaaccggggaactcacgatagataccgtccagttccgcattgcttagcccgcattggaaatcatggttgccatacgtcacagcccacggaatgccgcgcgccgccaacggctcagtgaactggccaatggccttgcgcaccagcgctcgggtatggttcagcgcggattcggcaataggttcgtcacaccagcgacgtttacggaatgaatcggcgaacgccggatcgtagccggcgatctggttgccggagaaaatcaccagatcaggccgtgtggcatcaaggctggcctcaatcagggcgatggtgtctttggagactttcggcccatcctgaatgtcggcaatctgcagcacgcggaacttgccggaatagtggaattgcagtcgtccgagacgcgcagagatagagaccgggcggccgtcttcggcatcggccggcttgatacgaggtttcgacgacatcccctctggcgtacgctgtgtttccgtcatgccctccactgtacacacaaacgaaaaggcccgccggagcgggccttttctacaagttcaactactggagcagaatctctgcacaacatcatcgttgtaacggtaagtctttccaatgcccgtccaacgtaacagtcctcgtgaccatacactatttgtgggctctgctctgttcagttgttcttgtacctcataatctattcatcactcccgtttctcgcaacctgcagagagtcgttgtgcgttttttatcacaactgttcaatcgcactttctggctatcggaaaacgagctgaaccgttcacatcgaacccgtccgatgttcgatttcgttcgtttcaccgccgctcacggcgtgtcgcgagcgacgctagcacactcaaaaccaaccaacaccgaactaacatgaacacccgttgaattctggcgcgttcagtcgttttccggccacgccaaagcttacgatataagctatggcacagatatttgacgcaccctcgaaggcaattctgcgcagccaaatcgcagagcatattgccgaaaacgacaacaacgaccgccgcgtcgatcaggaaggcgaggcaccgctgcccaaggaccgtttcttcgaccgcgagctcagctggctcaagttcaaccagcgcgtgctcgaatgtgcggagaacgaagacatgcccctgctcgagcgcgccaacttcgccgcgatcttcgcctcgaaccttgacgagttcttcatggtccgcgtcgccggcctgaagcgccgtatcgactcgggcatcgccgtgccgtctgccgccggcctgagcccgcgtcagcagctgcgcgcgatcagcgagaccgcacaccgtctgcaagacgagcacgcacattacacgatcgacaccattctgccggaattggagaaggagcgcatcgtcctgctgacgtgggacaagctcacatcctccgagcaggagcgcctctcgcgctactaccgccagcaggtgttcccggtcctgacgccgctcgccgtggatccggcccacccattcccctacatttccggcggttccatcaacctggccgtgattgtggagaacccggcctccggcaagtcgcacttcgcccgcgtcaagatcccgggcaacctgccgcgcctggtgccggtggacgacatgaccgatgaggagtccaaggacgagcgttacggcttcatcgccatggaaaagctcatcgccgcgcatctggaatccctgttcccgggcatgatcatcaaggaggcccgctccttccgcgtgactcgtaacgaggacatcgacgtggaagaggatgacgccgagaacctgctcaacgccatggagaaggagctgctgcgccgccgcttcggaccgccgatccgcctggagatcacggacaccacgagccccttcctctcccagctgctcgccgaccagctcggcgtgagccaggacgaggtataccgtctgcccagcccgctggacctgaccgtgctctttgagctcggcagcgtggaccgcccggacctgaagaaccgtccgttcgtgccgaccacgaaccgtcagatcgccgaggtcgagtcctcccgcgcacaggatattttcgccgccatccgcgagcgcgacatcctgctgcatcacccctatgactccttctccacttccgtgcaggccttccttgcgcaggccgccgcggacccgaaggtgctggccatcaagcagaccctgtaccgcaccagctccaactcgccgatcatcgacgccctgatcgacgccgctcatgccggcaagcaggtgctggctttggtggaaatcaaggctcgtttcgacgaggacgccaacatcgcgtgggcccgcaagctcgaacgcgccggcgtgcacgtggtgtacggcatcgtgggcttgaagacccactgcaagctcatcgaagtcgtgcgtcaggaagcggacggtctacgccgctactgccacgtaggcaccggtaactacaacccgaagaccgcgcgactgtacaccgatctgggtctgctgacctgcgacccggtggtcggccaggatctgactcgtctgttcaaccagctctccggttacgcgccgaagtccagcttccaccgtctgctggtggccccgcgcaccgtgcgcaccggtctgatccagcgcatccgccgcgaggaggacgccgcccgcgccggcaaggaggcctggatcaagatcaaggtcaactccatcgtggacgagaagaccatcgacgccctgtaccgtgcctctcaggccggcgtgaagatcgacatcgtcgaacgcggcatctgcgctctgaagcccggcgttcccggcctgtccgagaacatccgcgtacgttcgattctcggccgcttcctggagcactcccgcatctacgccttctgcaatgctgacggcccgcagatcggcgagggcccggcttccggcccggaggtctacatcggttcggctgacctcatgcaccgtaaccttgaccgccgcgtcgaggctctggtgcgcgtcaccgccccggagcagattgacgagctcatcaagtacgtggacctgcagatggccgactccaccatgagctggcacatgcagcccgacggcgcgtatgtgctgcacaccaaggacgacgagggccgcccgctggtcgatagtcaggaatacctgattcgcaagcaccagcgtcgccccaattcgcacaactgatttcactcgatgctccctgtcagcgcaagctgactggggtggttacgatgcccggctcctctttcgagaggatgccgggcatcgttgttcagcgcgcaaaaactacgtagcagcggtccaacgtgacctacaatacaagagatgggtacgaacagtatgagacgaatcgtggaagccgccggcggtattctgtaccggtggaaggatgatgccgagccgacgcaggcatcatctccatcaacgaaatccaatattgccaccgatggcaccatcatcgcgaacaccgcggattctgacggcgagaccacggcagcacccggcgcatcggacgcggcttccaccccggacccggcgcaggccgacagcccagccacggcggacaacgtactcaaccgcatcgaactgtgcatcgtgcatcgcccgaaatacgacgactggagctggccgaaaggcaaggtcgacccaaacgaatcacaccggcatgccgccgtgcgcgagatcggcgaggaatcgggcctgcccgtggagctcggcccctatctgggcgacatcgagtacccgctgtccgaagagggccgcaaacagcgccataccaaggatcggtcggcggacaccaagcacatccagttctggatggccacgccaatcagcgccatcgacaatctgcggcgcacccatgcgttcggcccggtgcatcgggcggacatcggcgaaatcgacgaagtcctgtggttgacgccggctgaggcccgcaagaaactcagccattccaccgataaggacatccttgcgctattcgttgaccgggtgcaggagggcgcgcttgacgccgtgccagtgattatcgtgcgccacagcaaggcagaagcgcgcaaactgtggaagggctcggacgagaaccgtccgatcacgccgcgcggcgcggctgcggcatacgcgctgaaccgtgagctggcgtgtttcaatccgaaccgactggccacgtcgccttgggtgcgctgccaggagacgttggagatgttcgcgtggcagaccggacgagacatggttcatctcgatccgctcaccgaagatgcatacgccgctgcgccggacaccgcatgggaatgtctactcagcgaaatcgagttcgcacttgagcgccgtcagcccatagcgatatgcatgcaccggccggtgattggtggtatgttcgaacacctgcgcagcatgtgcgttgcgccgtctctgagcaaacgcctaatcgccaagacaccgttcatgccgaccggcactgcggcggcgctgttcgtcactccgacgcctcatggtcccaaaatcatcgatattcagaaggttcaaccgcttgtctactagacccgcattccctgattcatccaactcctcggccgctgccgccgcagctcatgccgcgcacaatggtgccgccggcagtctgggcccaggcttcggctcgttgcgtgcggccggagcggcattcggacctgctcgcatgggttcttcgcgtccttcgcgcccggctcagctcgacccggctgtggccgatggattggccggcggcatggacccgcaagcgttgagcgagatgagccatctgtccgctgccgcattgctggatcgtgtgcgccatagcgaagacccggcggttgttgagcgggtgctcacgttggtggagacggtcggcgtggatgaaatcgccgaactgtggagcgatgctgagccggattcgctgcctggtgtgctgtggcgactgtatatgttgcgtacgtggatgcgatcgaatcgcgactcaatcgcgcatctgtggcgcttgggtgagccggtggccactaccgcctccgccatcgccggcgtggatcaggctcccagtgaagatgacatcgtgcgattggccgattcgattctctccggtgcttttgtgggcgattttgccgtggcgcttgagcgtgcggcggcgtttaccgatgtggtggcgttgggcttgcgcgtggaggcgcggcgcatggtgacccgggccgaggccaacggcgccttctcctcggatgccgatgagaaggccgtacgcaccaaagccgcccgccttatgcacaccgccggcagcctcatggccaccgccaaggatttccagcacggtgccaacctctggcgtcgcggacggttggagtaaccccgctccaggctccctctgatgagggagctgtcacgggcgatgcccatgactgagggagaaacccaccgaccgcaccccaacaatcagctaccggccaacaccaccccttccccggcgcggcgagacccatcgcaagctatactaagtatccgcgtcggaccgtgcttaagccccgggctccattttttgccgccgcgagcggcccttgcgccgacaggcgctttcgcggttcggcgcttctcttcttttaccagattcacgccccgagcgttgcgatgggcacgaccagtatgccgtcattgcggcgataggccttcccacctcggccggtaaggaacatcatgaactctggttcgcgaacttgggccatgggattgccgcagattttgttgcggaaggatttgagcttatccgcattgtcatcgttcaccttaaggtcactgagttttatttcgatggcaccccacctgccgtcagacaactcgataatgacatcaacttcaagccccttgtcatcgcggtaatacgcaatgcaattcccggcacccggcatagccgacagatatacattcaaatcacgaatgcacagcgtttcaaacagatcgccgagcgtctgtgtatcccgcatcagcgtcttcggcgacgcacctaaaaccgcagcaggcaacgaaggatccacgaaatatcgcttgggcttggttcgcacacgactctttgcgcggagtggcggttcccaaccctccaaatccgtcagcagatacaagtccttgaacatttccaaatagctcttcaccgtctgcgtatccggctcacgccgctcatcgccatatgccatatccgcagccagcgtcgcatattttggtgcctgcgagatgttcacggcaagagctcgcatcaaagctcgtgcagtttcaggattcttcttcatcttcggcacgctgatatccagcacacttgcgatatattcgcccgggatttccaaggcgaattcatcgtctagctcaagattcgcgggccaaccgccacggcaacaccatctggcgatgtcttcgatactcgtattgcattcggcaggctcgaatttcctctcgaacaaatcggataggctgaccgcgcccgtggattctccggattcagccaagctcatgggccacatgcgcagacgagcaatgcgaccagtgccgctgtgatgaatggcgtcacgatcctttggaatagccgaacctgtaagaatcagctgccccttgcggttcgcattgtcatctatatggcgacgagcggcatcccaaatttgcggtacatcttgccattcgtccaccagatggggctcctcccccatcagcaccaatgcaggatcggtttgggcggccgcgaaaactgccacatcatccagacggtcaacgcttcgagaccgggagagcgcggtccatgtcttgccgcaccatttcggcccaacgatttccaccgcaccgaacgccttgagcagtttgcttaatctgctatctaccacgcgtgaacgataatcaggcctggtcaaggtaccatcacgaccactcaaatcgttcatattgcagcctttcccagttctatcgttctaacaatatagattttacaccagtttcattcccgattttacgcctatctcattcccggttttataccagtttcattccctgttttacaccgtgttgtttttacgctttaccccctcagaggtatcagaggcagatctcgacacggacagggcattgtcctgctgcaactggcctatcgcagcaaaaagtcgaatcacccacaaatccaatccgatgagcaagccgcgccattaccaattcggcaggtcggcaaacttggactaggctgggaatcatggaactccatgttttgaatcatccgctggtcgagcacaagctcaccgtgctgcgcgacaagaacaccccctcctccaccttccgcgagctcgtctccgaactcgtgatgcttgaggcctacgaggccacccgcaacctgtccgtggtggccgcgccgatcgagacgccggtcgccccgatgaccggcaagaagctcgcctccccgcgcccgatcatcgtgccggtgctgcgcgctggcttgggcatgctcgacggcatgacccgcctgattccgactgctgaagtcggcttcctgggcatgaagcgcgacgaggagcaccccacccagcaggtgacgtacgcgaaccgtctgcccgaggacctgtccggccgccagtgcttcctcatcgacccgatgctcgccaccggcggaacgctggtcgccgccacgcactacctggccgagcgcggtgccaaggacgtgaccgcgatcaacatcatcgcggcccccgaaggcatcaagtacgtcgaggagcacatcgacccgtccatcgacttcaaggtcgtggtgtgcgcggtcgacgaacgtcttaacgacaagtgctacatcgtgccgggactcggcgacgccggtgaccgtctctatggcgtaattgactgatttccctggctcccctccccgaggggagccagcataacggaacatctatgcaaatcgacattattgcgccggggcgcgtgaaggagcgttaccttcgcgacgccattgacgagtattccaagcgactttcgcgctactgcaagctcaacatcattgaagtggcagatgagaaaacgcctgaccatgcctccgaaggcgttgaccgacagatcaaggccaaagaaggcgaacgcatcgccaagcatctgaaggacggcgcgtttgttattgcccttgccatcaatggcaagcagctgtccagtgaagagttggccgccaaaatcaacgaccttggattgcgtggcaccagccatattcagctggtcatcggcggttcaatcggccttgacgacgcgattctgcgtcgtgctgattttctgctgagtttctcgaagatgacgttcccgcatcagcttatgcgcgtgattctgctggagcagatctatcgcgcttataaaatcaacgctggcgagccgtatcacaagtaaaacgccatacctcatggggcgggaaatcccccatggggcggtaattgccccatggggccgtaaaaccctcatggggcggtatgccaaaatggcttaattccgcggtttcacatattcttcaaaccgccccatgggcaagttaccgcccgatgagcctgtaaccgccccatgggcgcatcaataacgccctcaacctcacactgcgtcggggacgaacgcttcgaagatgtggcggtcgaagtagggggcgcactgggcgagttcatcgctgttgcgcacggtccatgaaaccggcatcgcacccatcgaacgagcgagcttgacttgcggcgaagcgccaccggtccagtcataagccacgaaatcaggacgagacagccagtcgaacgccagtaagccggcggcccattcagccgcaccattcttgctcagcttcgccggccagctcagctgaccgcggcacacctcagggtgatgctccttgtaccaattcaccgcgcccgggtggaaggattcgatcacgtacgggccgtcatacgcctcaagcaaggcatggcccttttccatgagctcttcgctacgctcatcccaagccctgttgttgctgaacttgtattccacaatcagcggagcccggccggccaccacgtccagcacatcggagaacagcggcacatgctggtagtaccccttcggcgcggcggacggcgtgaccaccagcggcgggttcgcgtcggcacccggcaacggttcggccttcaaatcgcctgactcgccgttcgggaagagcggaatacgggtgagttcgtcgtaagtcaggtcttcgatgcggcgcggatcgccggccacgcgcaacaaatcggcgtcatggaccacgaccacttggccgtcgagcgtaagctgcacgtcgagttcgatgccatagccagcctcgcaggcggcggcgaacgcggccagcgagttttcgggagcaatcggaccggtcatatccgcactgccgtagccggccttgacagccatgcgacgggcaagcgacacataatcatcgttttcggcgatggatcgctcagtggtatcggcttgggcgctgaccggattatccccaccataatcagcgatatcggtatagccgaccaaaccagaacccgcatcatgcaagccacgatgggcataccatacctccggaatggagggcacgaaattacgacgcttgtcattgaacgtgcgcggggccacggcccacacggcagcaccggcggcggccacgcctgccagcgccacgtttctccagagcttcgacgacattggaatccttcctgttgggctgcctctagcctaacgcttctgccagccattgtggagtggttggatcatccggtttcagcgcgcggtccaggtggttggcgcgcagtggctcccagctgaaatctgccagcagatcggcgggtttgcaaggaattggagtgggttgccgacgcagcagccaggcgcagtatccgatgatttgctcgggggttacgttgcgggcgcgcaaggctcccatatccagcgaacgttcgcgcttggctaaacgccggccggccgcattgtcgataagcggcaggtgcgcatactcggggtgctcggcgagaggcttttccgtgttgccgcattccggctcaaagccgccagccaacagacactggcgaatccagatttgcagcgcggtggagcgcagcagatcacggccgcgcacgatatcatcaacacccatatcgaggtcatccacgaccacgaccagttgatagccgaacagtccatcggctcggcgaatcacggaatcgcctacctcgcgggccaaatcgtagtgctgtggactatagacacggtcgttaaagcatgcgacaccatcaacgattccggcatcgccctgccgttccggcggcacggctcccaacagcgcagcggaatcgtcaggcactgtacgttgcttttctcccgctgccgattccggcatggcgatacggatggaatgctggtcgccgcgaaccaaacgggcacggacctcgtcgggatggtcgtgcagcaggcggcggcacgtgccggggtacaccatgaagccgtcgccctcgttgggggccgaggcggcgcgaatgtcggcacgcgagcagaaacaggggtacagcacaccttgcgagcgcaggcattcgagagcgtattcgtatcgttcagtgcgctgggattggaacatcggttcgccatcccagtcgaggccaagccaatgcaggtcatccatcatgagctggtccgcaccggcggccacacgcggcttgtccacgtcctcgatacgcatcagcatgcggtcgccacgcgagcgggccgaaagccatgcacccaacatggcgtacacgttgccgatatgcatgcgccccgacggcgtcggcgcgaatcgtccagtcactggtcctcctcgtatgaagttcagcaccatggtagcgaaaaggctctcctcctcagaggagagccaatatagtgaagctcgccagcccgaactcccctcagtcagcttcgctgacagctttgctcagagagggagccagtgattgtcacttgtcttcggtgacgttgcccacgctcacgtccggatcgtcggagacgatctggtcgctggcccaggcggaaagctcaagatgctcaccaccggtctggtcgaccagcacggtgtcgccatcgtggaccttgccggccagcagcatacgggccagctggtcgcccacttcggtctgtaccaggcggcgcagcggacgagcgccataagccgggtcgtaaccggtgttggcaagccattcgcgagccgagtcggtgacgtccagcgtgatgcggcgatcggtcagacgctgggacacgccagccacctggatatccacgatgccgccaagctcctcgcgcgtaagcgggtggaacatgacgatgtcgtccagacggttcaggaactccggcttgaagttcatgtggacagcgtccatcacggcctttttcttggcgtcggcgtccatgtcctcgttcacgaggaactgcgagccgaggttagaggtcataatcaggatcgtgttcttgaagtccacggtccttccctggccatcggtcaggcgaccatcgtcaagtacctgcagcagcacgtcgaagatctccgggttggccttctcgacctcgtcgaacagcaccacggaatacgggcggcggcgcacggcctcggtcagctggccgccctgctcgtagcccacgtagcccggcgccgcgccaatcaggcgcgagaccgaagccttctccatgtattcggacatgtcgatgcggaccatggccttctcgtcgtcgaacaggaagtcggcgagcgccttggccagttcggtcttgcccacaccggtggggccgaggaacaggaacgatccggtcggacggttcgggtcggagatgccggcacgcgaacggcgcaccgcgtcggacacggcggcgatggcttccttctggccgatcacacgcttgccgaggtagtcctccatgtgcagcagcttctcgttttcgccctgcatcaggcggccgacgggaatgccggtccagtcggagacgatctcagccaccgagtcggcgtccacgcggtccgggaccatcggctcattggccgggttggccgcgctggcatcagcagattcagcatccgcgctctccgcggcggcaagctccttctgaatggacggaatctcgccgtacagaatcttcgaggcctcggccaagttaccctcacgagtgaacttgtcagcctgcacgcgcaggtcgtcgagcttggcacgcaggtcgccgaccttgttgtggccggcctgttccgcatcccaacgcgccttgagaccgctgagcttctcacgggtgtccgcgagttcggcttgcagcttgcccagacgctccttggacgcggggtcctcggccttcttgagctgcatttcctccatttcaagacgggtcaccttgcgctgcagctcatcgatctcctcaggcgaggagtcgagctccatacgcaggtgagcggccgcctcatcgaccaggtcgatggccttgtccggcagctgacggcctgaaatgtaacggttcgagagggttgcggcggcaaccagcgcgtcgtcgccgatcgttaccttgtggtgcgcctcgtaacgctgcttcagaccacgcagaatggcgatggtgtcttccacgctcggctcgcccacgaacacctgctggaacctgcgctccagcgccggatccttctcgatgttctcgcggtactcgtccagcgtggtcgcgccgatcaggcgcagctcgccacgggccagcatgggcttcaacatattgccggcatccatcgagccttcggccgcacccgcgccgacgatggtgtggatctcatcgatgaaggtgatgatctggccgtccgcattcttgatttcgttcaggacgctcttcaggcgctcctcgaactcgccacggtacttcgagccggccaccatggagcccaagtcaagggagatgagcttcttgccttgcagggtggtaggaacgtcgcccgccacgatacgctgggccaggccttccacgacggcggtcttgccgacgccgggctcgccgatcagcaccgggttgttcttggtacgacgggagaggatctgaatcacgcggcggatttcctggtcacggccgatgaccgggtccagcttgccttccttggcggcggccgtcaggtcggtggagtacttctctagggccttgtacgagccttccgcgtccgggctggtgaccttcgcgccaccacgcacgccgggtacggccttgcgcagggaggctgcggtgacgccgttcttctccaagatttcggccgactggttcggcttgctggccgcgatgccgataagcagatgttcggtggagacgtattcgtcgcccatctgctgcatttccttctcagcctgggcgatggcggcggtcagctggcggctggcctgtggctgcgaggtgctggagccggatgcgctcggcagtgcgaccaaagcgttgcgcacggcggcggcgatggcctgcgggtccccgcccgcggcctcgatcagagagcgcgccacgccgttttcctggcgcagcagcgcatccatgacgtgcagggtctcgacctgcgcgtttcctgcggcggacgcactctgaatcgcgtcgccgacggcttcttgggccatagtggtgaacttctgttccatatcgtattcctccatatcatgcggtctgcgcagtgcggctcgcgggcttcgaaagccctgcgagcgttgcgacagaccgcagcttgtcgttgtctgatatggtcaaccgacctggaacccattctattcccaaaacttgagtgcatatgactcaagttttggattttggtggggagggtgactagtagctccttctgatgagggagcttgggcagccgctacttcagtgcgccgacggcggattcggcggcggcgaggacttcgccggagagaatcgcctcggcaacgccctcaatctgcggggtggtccaggtatcgcgtacgtcggggccgatttcgttggcgtactggcgcaccacgcggtatacggcggcgcccgccgcacccggacggtacggcttgcggaagtcgaaggagcggcaggagcacagcagttccacggccagcacgcgcgcgaaggccggaatcgaccggcgcagcttgcgggcggcggcccaacccatcgacacgtgatcttcctgcatggcggagcttggaatcgaatcgaccgaggcaggcacggcgttacgcttcatttcggagacgatgccggcagcggtgtattgggcgatcatgaaaccggagtccacgcccgggtcaccagccaggaacgccggcaggccgcggttgcgcgccacgtcaaggaagcggtcggtacgacgctcggagatagaggctacgtcggcggtcggaatcgccaggaaatcgagcacataggccagcggcgcgccatggaagttgccgttggactccacacggccgtccagcgtgacgcacgggttatcgatggcggaggcgagttccacgcccgccacggaggccgcgtattccacggtgtcgcgggcggcgccgtgcacctgcggggtgcagcgcagcgagtaggcgtcctgcacacgcacggtggagcccgggcggccggcctcgatcagaccagagtccttgagcatgcgggcgatgttcgcggcggaatcgccttggccgcgatgcgggcgcagcgcctgcaagtcggcggcgaatacgcggtcgttgccgagcatgccttccacgctcatcgcggcggcgacatccgcggtcttgagtagcaggcgcagatcggtgatggccatacacaacatgccgagcatgccgtcggtgccgttgaccagcgccagtccttccttctctttcaaatcgacgggcgtgatgccggccgcacgcagcgcttcgccgccgccgatcttgaggccgtcagcgttgcgggcctcgccttcacccatcgccaccaaagcacaggctgcgagcggcgccagatcaccggagcatccgagtgaaccgtattcgtagaccaccggggtgatgccggcgttcagcatatcggcgtagacctgcgcggtttccgggcgcacaccggtgcgtccagtgcacagggtgctcaggcgcagcaccagcaggccgcgcaccacctcacgctccacttccggtccggcaccggcggcatgcgagcgaatcagacttttctgcagctgcgcacgctgttccttggggatggaggtggaggcgagcgcgccgaatccggtggagataccgtaatgcggcacggtgtcgtcggccaaatgatcgataaccgcgcgactcagcgccatctcatgcttcgattcgtccgaaatcgccactttggcaccgccgcgcgctacggcgataacgtcctcgatgctcagcgctccaacacctacggtgaccgtctgctctgccatgctcatacctttctatatatgtgccgcattccgcatatacgacatatgcggcacatgcttcgccggggatccgcgactgcccgcattcgctcaccgcacctgcccatcaacagcaggcgacgcaaacgcgaccaatcgctccccgagtaatcaaaccttggccatttcacctcagtcggatgcccgccataagccacttcgtccatcttgtgtctgaaatctcagacatgtaaggtgatggaaatatgagccatgcctcgcagcaatacgccttcaccgagccacgtaccgtcaagcgggcgcaggtgaagccatcagaacgggaacatcagacatcatcatccgcgccacgtgtctcgctggctccggcggccgaccgtacgctcgacatcctcgagttcatcgcgagcaatggtcagacgcaagccgccacgctcgctcgcgaactcggcattccgcgctccacggtgtaccaattgttggagattttggagcgtcacggactggtcacccgccttgccgagcagcgcgcgtacggcatcggactcaagactttcgagctgggatcggcctattctcgccaacatcgtgtatcgcaggtcgcgcatccggtgttggcgcgtcttgttgacgagaccggcgaaaacggacatctggccgtgctgcacggcaacgaaatcatttatgtgattgaggagcgcgccgcgcatcgcccgccgctagtgtcaggcgtgggcgtgcgcctacccagtcacctgaccgccaccgggcgggccattctgtccgcactcccccgcaatcaggtccgcgcgctatatcccaatcgtcaggcgttcaccgaccgcaccggcatcggccccaaatcgcccaaggagctggaggcaacgctcgccgaaacccaacgcaccggttttgccgaggaacacggagacgtgacgcccggctttgattcatacgccgtcgctgtgcgcgactacaacgactttcccatcgccgggctggctctcactttcgtgagcggatcgctgcgccccgaacaggagcggttgcttaagaccaagctgcggcttgccggcacggaactgtcccggcgtctcggcgcggtcggcagtttgacatgaggattcgcgagatcatcgtgctgggctccttcgccccgatcacgattttctcaactaagttcaccgattcgctgaccggcaacgccaaactcgccggcttctcgctgacagtgacggccatcatcagcctggtggtgatgaccgccctgcacgcacttctgccgggagcgtaaggcgcgttcttgttctccgcctggacggttcccctcagagaggggaaccagaacgaatcacgcccgaacgattacgttgcgcagatcaccgatgccttcgacgtgcacgatggtctcgtcgccggggtcgaggtggccggaggcgttcggagtgccggtcatgatgacgtcgccaggcagcagcgtggagaacgacgaaatcgcggcaatctgctcggggatgccgtgaatcaggttcgcggtggtgccagacgccatcggcacatcctcgccgttcagcgtgaaggaaatcttggcgtccttccagttgaggtcgtcacgcatcacgatccacgggccgagcgggcaggaggtatcgaagcccttggcgcgcgtccacgtggggtcgatgccctgcagatcgcgcaacgtcacgtcgttgacgcaggtgaagccgagcacgtaatccatcgcgttttcaacggacacgttcttggcgatgcgtcccatcaccacggccacttccggctcgaagttcatgtccttggagcaggccgggtacacgatcggatcgtcggggccgattaccgaggtggacggcttggtgaagatcaccatgtcctccggcgcgtgggcgatttcggaatggccggcctcgtgcatgaactgggcgtgggcctcgtagttcttggccagaccgtaaaccttggaggggatcaccggggaaagcaggcggatgccgtcgccgtcgaccgggtaacgagtgccggtgggcttgacctggtcgccggccagcggatgaccgtcgagttcgatgaggtagtccttgccgtccgtttcgtccttttgtacgaaggcgtagcgcggcgaatcattcaaagaaaaacgtgcgagtctcatgcctgtaagcctactccttggcggttccttccgcagaagcatccgtccaaggagcaagcagaccggccttcaatcgaccaaaacgcacgttcgctgggattgctacttttcggtccaggttttgtcatacagcgactggccgctttgcgtgtgcatgatgacgcgcaatgatgccttgccgctggaggtcttgcacatcgagcccagcagattcgcggtggattgataggtgctgtccatagcatccagtgaggaagcgaaggtatcgcctagcgaggcgtagctgtcgtcgagcacgtactcgtacaccaaggtgtcaccgtcgacacggtagttgaaggtgatgccggtgtctgcaaacgtatccgcttcggattcaatggagtccttgaattccaaagagtcgacgaaatcctgaatcgaatcgtacagcccataatcgccgtcggttagatcgtcatgggtttcgcccaacgtgtcgtccagcacatcgtcaagattatcttgagctttgctcttatcgctgctatcaccgttgcccgaagaggactgactatagaaggaatcggttttcgcctcatctatagccttgctggcatacgaggcaccgccgacgatcagcgcgatgaccagtattacctgtatcaccatgcccgccgcactgatgatgatgccggcgatggccaagcccttgcccttgccgccctgtttcttaatctggttgaggcccacgatgctcaggatcagaccgaggagtgagacaaggaacgagcagataaaaccggcaatagccagaccgttgtacttctggttcgcttcaggcggcacactgccgtaagaaccagaccatcccggctggccgttcggttggccgccttgcatatacgggttatagggcgtttgcggaggcacggccccgccgcccggatataccggagcactgacgctgccgtagaccggaggaaccgatccgcctgccggagccgcccccggatagggcgaattgggtgctgccggtgcgggcgcaggcgcgggcgctgccggtgcgggcgcgggcgcagcggcaggagtcactggtggcaaagcctgcgtaggcggtaccggctgattggccggcgcaaaaggctgggtgggctgctcggcaggtgtaaacgcctgcgtaggctgttcaacaggagtgaacgcttgagtgggctgctcgcccgctgcgattgcttgggtcggagcattgttggcggcggttcccgtttccgccgtcatcgcatttaacggctcagtcggattggcgtcagcttgctgccacggcacctggccgttcggattgacattcggatcagtcatgacatgcactccttcaactgcatcgcaccccacttgcgagatgcgcccctcgtcttacgcgccacattgtgcgttacagacaactgtactcctcgtggcgagccttaagcaccccaggaaatttggcttccaaaaaacacaaaagcctgaaaccggctattgcctcagcaatattcagtcggtttcaggctcaatcgttaatcctctggcgaaacgacggtctacttcttcagcagcggtgcgacttgctcctcgtaagcggtcagggcggtgtcgatcacgttgtgcatgtcgtagtacttgtacgtgcccaggcgaccgccgaacacggtgttcggctcggccttggccttggcctcgtactgggcgtacagtgccttgtccgcatccgtgttgaccgggtagtacggctcgtcgccacgctcggcgaaacggctgtattcctcccacaccacggtcttgttcgggttctgggcatcgtggcgctccgggttgaagttcttgaattcgatggcgcgggtgtagggtacgtccgcgtcggagaagttcatcaccgggcagccgaagtggtcgccttcgtcgtagcggacctccttgaagtcgaccgtgcgccacttgaggtcgccgagctcatagtcgaagtaacggtccaccgggcccgtgtacaccaccggcacgcccgcggccttgagcgcggtcttgttgtacggctgggattcgtcgaagaagtcgacgccgagctccacggtgatgcgcgggtcgtcgatcatcttctccatccacgcggtgtagccgtcggcgggcaggccctcccacgtgtccttgaagtagcggttgtcgtagttgaagcgcacgggcaggcgcttgatgatggcggccggcagctcggacgggtcggtctgccactgcttgccggtgtagttcttgatgaacgcctcgtacagcgggcggccgatgagctggatgcctttgtcgttcaggttggccggatcggtgccggccagctcgcccgcctgctgttcaatcagggccttggcttcggccggcgtgtaatgcgcatggaagaactggttgatggtgcccaggttgatgggcagcgggtagacctcgccgtcatgcgtggcatacacgcggtgcacgtagttcgtgaagctcgtgaaacggttcacgtagtcccagacgcgcttgttggaggtgtggaacagatgcgcgccatacttgtggatttcggcgccggtctcctcgtccatatacgagtaggcgttgccgccgatgtgatcgcggatatcgatgatgtgcacgcgggcgccggtgtgctccaccgcctgctgcgccaccgtcaggccaaacaggcccgcgccgacaatgactaggtctgggtattgagtagtttccggcatgcgcgcattccctttcataaagtcaatatatcaattattatgttcgatttccgagaaaatatactatgattattcaccatcgcggcgaaacccgccactctcccaatagccagtccaggatgttaacttgcttgatgccggcgtggtctgatgtgacttgatttttgttccgcatttcctctcacttgataggagatgatggaatcatggcaaggggcatccgttacacgagggaattccaggagaaggcgctgcggcttctgggcgagtcacgcgcgaaccattcgtcggagacgaaggccttggcctcggtctcgcagagcctgggcatagccccggagaccctgcgccgttggcgcaacagggccgataggacggtcacggcgcaatccgcgcgcgatgcgcaggcggcggccgagctgaagaggctcagggcggaggtcgcggaactgcgcaaggcgaatgagatactgacgacggcgtcggcttttttcgcggccaggctcgacccgacacggcgttgaaggccgcgtgcatcgacgcgtaccgcggccgtttcgggggtcgggccgatctgccgggtgctgtcggccgggccggactgcggtttcctgaccgcccgcggctaccgcgccttcaagacggggcctctcagccgcatggcggcgcgccgcgaggcattggcgcgtgacatcacgtcgatccacggggacgagttcatgcgcgtgtacgggtaccgcaaggtgtggcgtcagctgctcgaccaaggctgggatcccttggaggccggccgagaccaggtcgcccgcatcatgcgcgaactcggtctgcggggcgttcggggcggccgcaggccggtcaccaccatccccgccagggggacgggcggcaggctcgacctggcggggcgcaagttcgccgcccgcgcgccgaaccggctgcacgtcgccgacatcacctacgtgcggctggcggacggctcgttcgcgtacgcggcgttcgtcaccgacgcatacgccagaagaattgtcggctgggccgtcgcctccacgatgcgcaccggggagctgccgctgcaggctgtgttttagcaagttggcgtccgctttgtgagcggtgtttttccgcagtgtaggcagcgggttttccgcagggtgtgcggtatcggccgctgcctgtctgcgttgtgttggttatttggtcatgacggcatgagcatcatggatcgtcgacgcgagctcggtcttgtggcatgattggtggtgatggaatcaacgacgagtccaacaaaacggcaccagccccaacacgaaacaccgacttgacgaaatacacatagcgtcgtttgcccgtggcggggtcgcggccgacctcacgccggaactcccacgagccatccttgcggtggatgatgcttcccgcacccttcgtgcgtcgtctgccgttcgtcgccatgatgttcctcccttgtcgggagcgccttcgagcatccgctacaagcgccctcaaaaagggcactctattggcacactatccgggccacaaacggccagatacggggcataatcggccattcttcaataatcgaaaaacggcgcaattccacagttccgaaaactcgaaaacgttggaatcacgccgttttctggggtgttcacaccctacttggacacattgaacttgaactccacaatatctccgtcggccatgacgtagtcgcggccctcctgacggagcttgccttcctccttgatcttggccatggagccgtcggcggccacgaaatcgtcgtaggagacgatgtcggccttgatgaagcccttttcgaagtcggtgtgaatcacgccggcggcctgcggggcggtccaacccttgtggatctgccaggcgcgcacttccttgacgcctgcggtcaggaaggtctgcaggccgaggatgtcgaagcccacgcgggccagctggtcgagaccggactcgctcaagccagcgtcggccagcatttcgcgggcatccgcctcgtcgagctcggtcaggtctgcctcgaactgagcgttgaggaacacggccggagccggagccacggatgcggcgagcttagcctgcaggtccttgttggccagctcgttgtcgtccacgttgaacacgtagatgaacggcttggcggtcatcagatgcaggtcgtagacggaatccttgtcgaagcggccttcgcgtgcggccttgtcgagcgtctcgccggcttcaaggatggtctttgcctgcttgactgcgtccatgtaggccggctcgatcttcttgccgcgcagatccttctccagcttgggcagcgcgttttcgatggtctgcaggtcggcgaggatcagctcagtgttgatggtgtcgatgtcgtcggccggatccaccttgccgttgacgtggacgatgtcgtcgtcctcgaaggcgcgcacgacctcgcagatcgcgtccgcctcgcggatgttggccaggaacttgttgcccaagccttcgccttcggaggcgcccttgacgatgccggcgatgtccacgaaggtcaccgtggccggcacgatcttctccgtgttgaccagcttggccagcacaggcagacgatcatccggaagcggcacgataccggtgttcggctcgatggtggcgaacgggtagttttcggccagcacgttgttgcgggtcagtgcgttgaacatggtggacttgccgacgttgggcagtccgacgattccgatagtaagagacatgattccaagtctagggagaagctggacaccttgaacctgcatgtggtgaaccggccatatgcaaaggcctccgagcatacggctcgaaggctttgactgtgatatgcgaatatacgcgaactctgattggcagtcagccgacgatggcatcgacggcgtcgatgaccgagccgcggaaaccgtccttttcgagctgggcgacgcccttgatggtggtgccgccgggcgagcacacggcgtccttcatggccccgggatgggtttcggtggccatgtagagcgcgccgacaccttcgaccatcttggcggcgagccggtaggcggtggctcgctgcagaccgtactgcacgccggcgtcgcccaaggcctcgatgtacatgtcagtgaaggcgggcgcgcagccggccaccaccatggcgatgttcatatgcgcggtgtccacgcgctcgatgaggctgatcggcccgaacagctgctcgaaggtttcggtttcgtcgtcggtcagggtgttgacggattcggtgacgagcacgcccttgcccacagccatcggagtgttcggaatggtgcactggatatggatgtccgaagagtcaacggattcgccgtcttcggtggcgaacaggtcctggtacttcttgagattccagccggcggcgatggagacgacgatcttgcccggcttagcaagttcgtcggccagcggcttgacaacggcggcaatctggtagggcttgatggcgatgatgaccacgtcagcggccgtcaccacttccagcgcattgtgcagcgggcgcacgccaagttcggcggtggtcttctcaagcttgtcgtagtgggcagcacaagcgaccatctggccgccggtgaccacgcccgcgtcaacgaagccctgggcgatggcctgggccatgttgccatatccgataaaaccgatggtgaggttctgagtcatacgttttcctttcgtgcatgtatacagagctccctcatcagagggagcttgcttccttgagtcagaacagttcttcgaggtcgcctcggttgagggcttcggtgtagaggtgcttgaagacgagcgagccgtgcagaccgtcatgctcgaattcgttggtggtccagtagtggctgttacccacgcggctcaaggtgtcgagctgcataccggaatcgacatacatgtcgtcgaagtaaacggcggcctgcagcggcacctcattgcgggccagctgttcttcgtcatagatcacgccgaagtgcgtgtcttccatgagcaggtccatggccggcctgaacgggcgtaacgcagactcctgttcgaacatccacgggaacatggcctcgccggtgaagttgagcgggcgttcatcagcaccgaattcgggcttgccatcgcgcacgcgctgggcggcccagcgaatcggctgttccatctcaccgttggcgtagatgaactcctgcagcggccagtacagcgggcgcgacgaagtggcgttcatcaccttggtcaaaaattcgtcagacaacggcgagtcggcagaagcggaaccatcgccatcaaggaaggcgtcgtcaagaatccaatggacacgctcgaagctcggcttcatgccaaagtcggatcccaagcactggaagcgttcgacggtgagcgggtcgccgttcggcatcagcgggaagccgtgggcggccatgccggcgatcacgccaagtcgatgctccacatcggtaccagccatcggattcagtaccgaatcggtgagtttgccaatgaattcggcgacttccgcagtagtcggcagcttgtcggcgatggcggccacgcgctccttgtcctgtgggtagcgctcgtagaactgagtcgtcttgcgcaccatgcgcgggaaggtatgctcgtacacttcagcggcgtcggccggcacgtgcgggatgccgccggtggtgaagctggcgattacgccggccgggaacagggacagtgtggtcagggtcaggaagccgccgtagctttggcccatcgtcacccacttgcggccaccgaattcggtcaggcgcagatgttcgaagtcacgcacgatggaatcggcaaggaacttcttcagatagtcggcttgggctcgtgcgccggccgcggcatcatcgtcgtgcgcggcggcgatgcgggccatggcgtgcgtgtccacacgcgaggagcggccggtgccgcgctgatcgggcagaatcacgcggaaatgcttggttgcctcctcaatccagccatcagaagtcgggctgttgaggcgagggccggcaccgccgggaccgccttgcaggaagatcagcaggggcaggtcgtcatgcacgtgttcgggcgtggtgaccacgcgatagaacagtttgatggtttccccgtcgaacgcccgcccgggctcgtggccggtccagtcgagcggaacatcgatggaatggtcctctatggccagtccgggcacatagtatttgctcagcattgtcatggttcaagactctagtccataaatcctcctgaagagtgataccggttcgtcgccggacacgctagcattgtgcgttatggagatgatggcgcgcgtgagggcatggtgcgcacgggagtcgacccgcacactgctatgggacacgttgctcgccgcggtgctgatcgccggttgtgtgccgttcaacggcgtcaccaaccctgattcgacgggcggcatattgtttcccgcaactcaggcgtcgatgacgctgtggtcgctgccggtcttcgtgccgctgatgctgcgcaggtattgcccggagccggcggcctggctgttcgtggcgctgaccatcacgcatcttgtgttcggcccggcgatcacgtatttcgatttctacgccctgatcatggtgtattcggtgattctgtacggcagtccccgacattcctggcggttcatcgtcacggcgttcgtcatgggactgatcacggcgacggtctggtcggtgtctttcaacgtgggtccgctgtttgccgaaccttcctccggttcgcgcaccatccgcgacggctggctggccgatgccatcacgatgcccacatgcccggcggtcaccggcgtcgtgggggcaagcgccgccgtcaactgcggggccaagatgctcgctgacgtcggcatggaggcggcgctcatcgaatcgagcgtgctgagcattatcatcatggccttgtggcagcgtgcgcgcaaggccacgctcacggccatgcgcgaacgcaatgcttccatcgtggcccgggaagcagaggagacgcatatcgcggcgctggccgagcgtgcgcgcattgcccgcgatatgcatgatgtggtggcccatacgctctccacgattattgtgcagtcggatggcggccgatatgcgggcgcgcatgatcttgccgtcgccaggcatacgatgagcacgattcgccatgaagcggaacgcgcgcagcgtgatatgcagcgtctgttcaatgtgttcggtgcgagtggcagtaccggatatgccgacatcgattcgctgtttgatggccatctggtggtgtcccggcatatgaccggcaaagcgcaacctgaccggctgtccgccgacgcggaaaccgccgtgttccgtcttgtgcaggaagcgctgaccaatacgcgcaaacatgcgggcgagggtgctaaagccaccatcgatgaattctggtcaaacgatgtgctgtcgattaccgtatccgataacggccgtggcgcggcgtctgcagcagacggtcataagcccggatacggattggttggtatgcacgaacgcattgagtcgttgggcggcagcgtgcaggccggcccagggccgaatggtggctttattgtggaggctacgattccgctctcctctgccgccccacagtctggcaccgatgcggaggatccggtgctaaccattatctcgcgtatacgaggattgatgaatcgggcgcgccccaaagtactcgaccaaggagatacgcgtgagtcgaactgggtgggtcgatttgcgcagtggaccgagcggcactatcttctgatggacgttatcgccactatcgtgctgattgcgctatttgattccgccacgtatggcgatttgcaaatgatcggcaatgccccgtattcgccgaaccgcgtgctgactatagcgctgacgattattatgctttcgcctttggcgttccgccgccgcttcccagagggcagcgcactggtcatggcgattctgtccgccgtgcagctgctgtttctgccatccatcctgaccgtcaacatgttcgcattggtgtccgtgcatgccgccgtgctgtatggccgcgaacatgcgtggcgctgggtcagcgtggcactggttgcggattcgtggctggccggcatcaagataatgtccggctggaacggctatgggatgctgattcagatgctgctgcccttcaacggcgaatcggcgatgtcccgctggctgctggtgctttccggtctgatgccgggtggcgtggtgatgctgtttggctttgcctgcattgcgatggcccggtggagccgttcacgcggttcgaacgcgctggtgctcatgcaacgcgaggaagcgctcaaggccgagcaggatcggcagaaggtgctggccgccaatctggagcgcaatcgcatcggcacggccatgcaggccgaggtattgaatacgttggaatcggtgatcacgcaagccgatgatgggctggccatgctgaactccgaaccggctcccgatagcgagcagatcatcgccgcgttcacggtcatcggggaacgcgggcgtgcggctctggcgcacatgcggcaattgctgacggtgctgcgtgaaaccggattcagcgacgagatgcatgaaggcgcacaacccgacatgcaactgcgaccggctgctcctctgtccagccagatgaggcaggcggaatccacatctcagacggattcgtccacgaacatgaactcagggaacaatcagggtgtccatggagcggcgctccgataggaaacggatacagtggagagcatgaacgagagcagaagcattcgcgtgattattgcggacgaccaggagctggtgcgtgccggttttgccatggtcattggttcgcagccggatatggaggtggtcgggcaggcacccgacggcgcccaagccgtggcgttggcggaatccctgcatcccgacgtggtgctgatggatgtgcgcatgcccagcatggatggcattgaggccacgagccgtattacctcgctctccgccgcgccgggcgacgcggccgattcggccagtctggccgccgacgcgaccgtctcggccgaatcggctgacgaccggccgacgcgcgtaatcattctgacgacgttcgatttggacgagtatgtgatggcggccatcaatgccggcgcctcgggcttcctgctcaaggacaccgaaccggaaacgttgctcaattcgattcgtactgtattccaaggcaatgcgattatcgcgccttccgccacgaagcgactcatcgaaaagatgatgcaggacggttacgcgcagcatggttcgttgggtggagaaaccacacactccggtgccgtgtacggttccgccggcggcgtctctggcggtgcggccggcaacggtgctggctcgatgaccggcttcccctcccctgccggagccgcttccgacggttccaatacgtcacgcccggcatacaccgatcccgaactggatctgcttaccgaccgcgaacgcgaggtgctggtggagatcgcccatggtctgagcaatcaggagatcgcggacaagctcttcatttctctgcccaccgtcaaaacccatgtggcacatattctggccaaaatcaacgcccgcgaccgcgtacaagccgtagtcttcgcgtacgataacgggctggtgtaacaaagctccctctgatgagggagcttattgccctacgcctcggccaaagcctcgacgggtggcgtcttgacggctcggcgggcgggagccacgctggccagcagagcggcgagcgcggcgacgccgagcaccacaccgttggtagcccattcgaacgggaacacggtgtcgccgtacaaactaaacaccatgtaggatccgagccagccgaacagggtacccagtaccactcccaccacgccggagacgagcgaaagcagcaacgcttccaccgccagcgagcgccgcagttggccgcgcgtcatgccgatggcacgcaaggtggcggattcgcgtgtgcgttcgatcaccgacagactcagcgtgttcgccacaccgaccaaggcgatgagcacagccaccgcaatcaaaccgaccaacaatgccatcatgccgttgatcatggtctcccattgagtacgttcggccaccggaccggtcacggtaacacccgcactggcggagaacacattctgcacgttggtgaatacgtcgttcaacgcaacacccgcgccttcggcgtcaatgcgcataagcatgatatgcccgtcggccttgatcccaccgttggtgaagtggctggcgtccacgaaggcgaccgcggcgtagttggaggcgatgcggcgatagtccaccttccgcggtttgagcgtcagcgtctgtgtgccgccggattgtccattgccgttttcggcgctgccgttcgcatcattgccggacggaccattggcggcatcggcttgtgcttcggccgctccagccgtgaacgtaacgctcttgtccagcggaatatccttgcctgtagcggcggaatacttgggcatcagtacggaatcgccatcaatggtcacaccggacaaatcggagcgcaccaccttgcgcagcgcgtcgacgccatccacgcccacgaccagcacactcaggctcttgccgtcggcatccttcatggtcatcatgcgggtcggcgcgtagataccgcgctgaacgcccttgactttggctgcctcgctggcctgtttaccagtcatatcggtgccagcggcaatcatgtcgacgctgtagcgcgtggtcagcgcctcgttcatggtttgcttggcgctggcggcaccggtggcgatggtggagaccagcgtcacgccgataagcagtgcggcaccggtggcggccacgcggcgcgggttcttctgaatgttcgcatgtgccactttggcggacggaccggccagtgcaaccatcgcgcccacgccgcgcatgagcaccggtagccagaacgtggcggaaagcaccagtccaaggaagatcaatgcacatccgatgatggcggcgagcagcaccagcggatactgcttgtcggccattgaatcacgtccggcgatgttctcggacatctgccatacagagaatgcgcacagtgccacgccggccacaatcagcagcacggaaatcacggcgcggaccacaccggcccgtcgcgtgtcggtcagttcgatgggtcgcaacgcttccagcggggtgacggcggtagcggaacgcgcagagcctagcgaggcaatcaccgtcataatgatgccgaatgccataggcaccgtgaacaccggaccggatagcaccagtcgcatggtcatgccggtggctttcatcaggcccgactggcatagtgcggccatgagtccgatgcccaggcccactcccagtgcggaggcgatcagtcccagcacaccggcttcaaacagcacggagacatacagctggcttttgttcgcgccgatggtgcgcagcagggcgagtgtgcggcggcgctgtgccacgagcacttggaaggtgttggcgatgacgagtgccgcgaccagcatggcaagtatgccgaagctcagcaggaagatggtggtgatgctggtttcgcccgagctcatgcttttgacggattcctcgacgagcgcggcacgggattgcacgctgaaatgcttagggagcagtgtgctgacctgtttcacggtggatgccgcagccgtgtcactggcatcgtcgatatcgagatagacgaggtagacaggcaggttgccgaaatcgttgctgccggccatcgcggtaataacgttgtcggaaagcacggaagcgccaccgtagtaggcgtaggcaccgttcgggtcgtcggtaaggcctaccacgcgcacggtcatgccggagtcggcagtgttggcgccatcggatgagacggacgcaccggacgcggcatcggaatcaccgtcgtgcgagctcgtgccatcggcgttctgggccgactcatcaccagcgtcaccggtattaccggccgaatcgccggtcttgcccgcatactgcgccgcctgcgagttgacggtcacacggtcccctaccttgacgccaagctggtcggctacggacttggtcagggcaatctcgttgctgtccgccggctggtctccttgcgtgatggtgaccggcagcagcgtacgttttgcggcggtggtgatgacgtagctgctggcatgcttgttgccacgggttacggtcacggaacccgcgtagctggcgcgcgcgtccttgacgccttcggtggcgcggatgcggtcaagctggaagtcgttaaccgtgcgcgtgtagatgtagtcctggtccttatcggtcaggtccttgccgctatccgggctgatcacgtagttcgcgccgccgagctgggcggtgttctgagcggcaagcgcatcgttcatcgcgttgccgaacaggaaggtagcggcgatgaacgcagtgccgatcaggatggcgatgcctgccggaatcagcatcctggcgcttttcttcatgagtttcagagtgatggaaaacatgggggtgtcctgtctctcgctttccggctcagcgagcgtgctgggcggcggcgcgggcatggcgcatggtgccggttctcccagctgggggcaatggagcgtcggtgatgggcaggttgggcacatcctttacaccggcaagacgggcgagcgtgtcggcgcgtgtgctggtgacggcagtgcgcgtggcgcgttcgcgttcggccataagcagctcgttcatcgtttcggcagtgggattcgcctcgtcggccacgatctgtccgtcggcgaatacgatggcacggtcggcgtaggaggcggccaccgcatcgtgcgtgaccatgacgatggtttggccaagctcgttgaccgaacgcttcaggaagccaagcacttcggcgctggaaacggagtcgaggttgccggtcggctcatcagcgaacaccagcttcggcttggtaatcagcgcgcgggcgatggccacgcgctgctgctggccaccggacagttcattcggtcggtggttcaggcgctgcttcagtcccagggtatcgacgagcaggtcgaaccaggcgtggtcgggcttgtctccggcgagagtcagtggcatgaggatgttctgttcggcggtgaacatgggcaacaggttgaagctttggaagatgaagccgatcttgtggcgacgtagcaaggtgagctgcttgtcgtccatgcgggtcaggtctgccccgccgaaaagaatatgcccggatgtggcggagtcgaggccggcgagcgtgtgcataagcgtggatttgccggagccggacgggcccatgatggcggtgaatttgccgcgttcgaaactcacgttcacgccgcgcagggcatggaccatattgctgccagcgccgtagttcttgaccaagtcgacggcctgaatagcgatgccgcgcgatgcggccgggttctgcacgttcataatgtctctccatatttggccgggccttatgcccggatgatgattccaacttatgaagaaataacggcgcgccccatcgtgcgccagactgaattgggcggtcggccacgcgccggccctcatccttgaggattatgtcgtctcaggtctcacactattcatgcctctgcgcaaacagtgtgaggcatacagacgcaagaaagcccgcactgcatgacatcagtgcgagctttctattccttgggtcaagcgatcaggcggaaggcaccccatgcggctcgatgattcgtgatgcaccccattagcatcgcgccccttctcatcgggccgtcaaccttcctgtcgacctcacttggccaagccggaagcgcgaagggcttcgaagccgcccttcaggtcatcgaggatgtcctcgatgttctcggtgccgatggacaggcggatggtgccttggtggatgccctgatcctcgagctcctccactgtctcctgggagtgcgtggtggaggccgggtgaatcacgaggctcttggcgtcggccacgttggccaacaggctgaacaggtgcaggttgtcgatgaacacgcgtgccgcgtccttgccgcccttgatgtcgaaggtgaagatggagccgccgccattcgggaagtacttcttgtacagctcgttgtccttgcggccttcgatggacgggtgggagatggactcgacttccggaacggtcttcaggtaatcgatgaccttcagcgcgttctggacgtggcgttcgacgcgcagggacagggtttcggtgccctgcagcagcaggaaggccgcgaacggggacagggtggcgccggtgtcgcgcagcaggatggcgcgcacgcgggtcacgaaggcggcgccgccgagggcctcatagaagttcaggccatggtaggacggatccggctcggtcagggtcgggaacttgcccggcacttcggcccagttgaacttgccgccttccacgatcacgccgccgagggtggtgccgtggccgccgatgaacttggtggcggattccacaacgacgtcggcgccgtgctccagcgggcggaacaggtacggggaggcgaaggtgttgtccacgatcaccggcaggtggtgcttgtgggcgatggcggtgatggcctcgaagtcgggcaggtcggcgttcgggttgccgaaggtctcgaagtagacgagcttggtgttctcctggatggcgtcctcgaactcctgcgggttctcggcggagacgaaggtggtggtgatgccgtcgcgcggcagggtgtggcgcagcaggttgaaggtgccgccgtacacgttcttggctgcgacgatgtggtcgccggactgggtgatgttgcgcaccgcgtattccacggcggccgcgccggacgcgacggccaggcctgcggtgccgccttcgagggccgcgatgcggtcttcgaacacgccctgggtggagttggtcagacggccgtagatgttgcccgggtccgccagtccgaagcgggcctcggcgtggtcgaagttgtggaagacgtaggaggtggtctggtagatcggcaccgcgcgggagtcggtggccgggtcggcctgctcctggccgacgtgcagctgcagggtttcaaaacggtacttcttgttgttctcggccatggtattctccttggttgtgctaggtcgcgaggatttttccttgccacccgcctgccgtgttcgggcggttggcgaggtgttggttatgaagttacgacgcttgggccgcgcggcgcaagctgaacgttatcggacttgcctataagggcttataaagccttggaatcattgacgtgagcgactgtcagaagtcacgaaaaagtcgttgaaattatcgcgacacgccgggccgcacgcatgcgctttcaaggtcgactgcggtcacggtgatatcgctgccatgcctttcgcgcatggctcaagtgtccgtgatgattgcttgttccacccgtcaccaagacggtttgcccgctcggtgatgacgtctgtttcattttcctgccgcccggttacatggtttacatgacgaacgactacagtcaaacatcgccaatgaattattccgccaacatggtgaagggattcgaacagacatgaccgatgtaactctgtatgaccgtgatccgaactatattccgcgcgtggccgccgtgcacgacatgtgcggctacggcaagtgctcgctgaccgccgcgattccgattctctcggccgccggctgcgatgtgtgcccggtgccgaccgccctgttctcggcgcacacacgctatgcagtgttcacgttccatgacaccacggatattctctccggttacttggatgcctggcagaaggaagacgtggagctggatggcgtgtattcaggcttcctcggctcccccgatcaggtggcgatcattcagcgtctctaccgcgaatatccgaacgcgctgcgtctggttgacccggtgatgggagacgccggcgaaatgtaccccacgtacacaccggagctgtgcgaggcaatgggcgcgctggccgatggtgccgacgtgttgatgccgaacctcaccgaagcgagcattctcaccaagcgtgactatcctggccaggatattgatgaggccacggttaacgagctgcttggtgctctgctggagttgggtgccaagaacgtggtgctgaagggcattgaccatggcgatggcaaaatcgtcaactatgtggccagcgcttccaccggtgttgccggcaagatcgagctggctcatgagaagttgccatacatgattcatggcacgggtgacgccttcgcctctgccctgtgcggcgcggtgatggccggccgcggcctggccgagtcggccgaaatcgccggtgagttcgtgcgtcacgccatggtcagcacccgtaaccagccgcatttcgaggatcgtggcgtcagtttcgaactgaaccttggcgaactcaccgatttggtgaagtgaccgcaccttggctcccctctccgctcactgggtctgacgtattcagcgaacaatccgatgggttgttttttcgtcacagggaagtcgactggtgagccttggtaaaccttctgaactaatggtggataaccgagttttcatccacacgttatccacaacacgccaaaccgcgtcatagtatccacatttgccggttgcgcttgtgctcttacataagtaacccgcacagtggaatcatgaacgctttaccacctactcagccgacgacgaagtccggcatcgacgccggtcttgcctttcaccagcccatgctggcttcacctgatccgcaggcaatgctgccttcggaacggattgcggccacgatgggcgaccgcaatctgacgcccaaacagttcggcgcgctcggcgagcagtatgccgccgcgtggctggaggaacacggttggacgaccttgagccgcaattggcatacccgttacggcgaattggacatcgtgatgctcaatcccgagtacacggtggtgttcgtcgaagtgaaatcacgccggtccatgcattacggatatccgcaagaggccattacgccggcgaaacagcacaatctcaggaaagccgcctgcgattggctacttgaccggcgtaatcgggtgccgcattcggcggtccgtttcgatgtcgtcaccatcgtgcttcgggtgggcaggccgctcgtgcatcacattgaaaatgccttctgaagcccccccccccaaaaaaaacagccacgttgcgaaacacattgtgaaaggagtagacatggctatcggcagcaccctctcagtcggactgatcggccttaaggccttcatcgtccaagtgcaggctttcatcagccctggcttgccatacttcagcatcatcggattgccggatgcatcgttgtccgaagcccgcgagcgcgtgaaatcagcgtgtcaagccactggattcggttggccgcaaacccgtgtgaccgtgaacatgagccctgcggccatgcccaaacgcggttcgtcgcatgatctggccatcgcggccagcgtcctatgtgcggcgggtgccatagggcatgattgcctagaagataccattgtgctcggcgaagtgaatcttgacggctcggtgctgccgattcatgggctgctcccgatcatgctgcatgccgaggaacgtggcgtgcgcaaaatgattgttccccatcgcaatcttgacgaggcttcgatggtggatggactggatgtagtgggcgtgaggcatgtgggtgagctcatcgaactgatgggcggcgatgccacctatacgattcccgatacaccggttaccgacgagaccaccacggatcaatcgcccacaagtcatcccaacgattgtggcgatatgaacgaggttctgggtcaggagcatgccaaatgggcactgcaagtggcggcggcaggcgggcataatctcatcatgaccggcccgccaggcagcggcaaaaccatgttggcctcacgtatgcccggcatcatgtgcccgttgaacgaggcggaacagctggaggtggcatcgattcgatcgctgtgcggcatactgcctcagtacggcatcaccgacatgccgccgttcgaggcaccgcaccacaccgccagcacggcggccttggtgggtggtggcagcggcatcgccgttcccggcgcaatcacacgcgcgcatcgaggcattctgtttctggacgaggcaccggaattcagcgcacgcgccctgcagacgttgcgcgaaccattggaatccgggtatgtggcgctttcccgttcaaaaggcagcacctactacccggcctcattccaactcatcatggcggccaacccctgtccgtgcggatactattacggcaccggcgaacgttgcgcttgccgggaaaaagaccgtatacgttatttctcgcgattgtccggaccgatactggatcgtgtggatattcagatggcggtgccaccagtctcgcgcattgccgcgcaaagcgagccaatcggcgagtccagtgccgggatacaagctcgtgtgattcgtgcccgtcaagtggccaaagaccggttcagacagtatggatgggtgtgcaacgcgcaagcttcgggcaaatggctgcacgccaatacatcgctgaaagcgatggaattggtcaatcgggccctgtccaatcatcaactcacattgcgcggggctgatcgcgccatgcgtctgtcttggacgctcgccgatctggccggccgcgtatcccccactgaacaggacgtccatcagggcatcgaaatgagaacgaggatgacatgagtaacgctactgatatccggcaatctggcggcaccgcaggaagtgtggatcacaccgatacgagtctcgccgtttcgcgcactattcccgtacctcccacggatacgttgtatcgtgccgcgctcacgttctgtcttgatggcgcggatgtgatgatgtacgccacgctcaaaggcgcggaaaacgccgaatccctctggcatgcgttggcgcaatcccatccaagccagccatctgaaatctgcggcccggcgctgtcacgtattgaccgcatgttcgtggacggcctcactcgatggggccgcaaggcgtcggcgaacgcgatgcgctccttccgcaatgcactggcctgctggcataaccgcatgatggacctgccctcgcaagacatcatccaactggccgactggttcactatggatggcacgcaatggattatcggccctggccatccatgttggccctcgcagttggccgacctgtccattcgctccgattgggcgccaccgctgtgtttgtggatcaaaggcgatccacgcgcattgaccagttgcgccaaaccggtcggcatcgtcggttcacgggacgtgaccgaatatggccggtatgtggcacacaccgtagccgaacaggcagccgttgccgggcatctggtcgtgtccggaggcgcgatgggcacggatgcggcggcacattggggagcgttgaatgcgctgcacggcagaatgcccgccaatgtgggcaaaaccgttgccgtattcgccggcgggctcaaccatatcggaccgatgcgtaaccgcacgctgttcgaacgcatcgaggcgcagggtggtgcactgatcagtgaactgtgccccgggacgattcccgaagcccgtcgttttctgcttcgcaaccgcattatcgcggccatgtcttccacattgattgtgacgcaagcccggttgcgttccggagcgctcaacaccgcgggatgggcatgcgaattgctgcgcgaagtgtatgcggttcccggtgacatcaatcagccttgcaacgccgggtgcaataagatgatcggcgaccaccgagcgatgattctgtgtgccgccacatccaccgaggatatatgccatgaacggcataagcccgttatggcagcatgcccaggcatatcgaaatccacaggtcaggactcgtccgaaaacgaggaggccatggaagtgccggcaacgactccgttatcgccagcatcctcggaatcatcggtgtcacaggagtcgtcacaagattcaggtcattcgaaacgttcgaagaccaagcatactcagcctacgcgcactcaatccaaggatgggccggcgagcgcaactgccgattccggtaacgacaaaagcaagggtgaagagcttccctcgtcgcatcagatgccggatcttcgtgtcaagccgaagcccgatcccgagaaggaagcccaacaacgtatcatcatcgccaagctgccggaaatggaacgcacattagtggcattgattcgtgaatgccgtaaacgacatctcatcgtcaccccggacgcactattgcgtgtggcgcgagagacggtacccgacgagattcccaatatcggcaccatacttgagctactcggcgcattggagctgaagggagtgatcgagcgggatgccggcatactcaagctgagcagccgtgtcggctaatcggcttccatgacacggctcgaaggctgttcggcgggtgtgcgagaatcgaacccatgagtccgaaacgtttggaagatatgtatgatgcggtgatcgtcggcgccggagcggccggcctgtcggcggcgttgggactgctgcgctcccccgagatcaccgagctcaaggaacaaggcgtggacccgaagatcctcgtggtctccaaactgcagccgctgcgttcgcacaccggttcagccgagggcggcatcgccgcgagcctgggcaatgtggagtccgatgactggcactggcattactacgacaccatcaagggcggcgactggctggtggaccaggatgcggccaaactgctcgccgaatacgcgccgcagaccgtgatcaacctggagcgtcagggcgtggccttctcccgtaccgaggacgggcatatcgcccagcgccggttcggcggccacacgcgcgagttcggcggcgccccggtcaagcgcgccgcctatgcggccgaccgcatcggccaccagattctgcacgccttgtggcagcagtgcgtggccgccggcgtcgagttcgccgaggaatggtatgtgaccgacctggtgctcgccgacgacggcaagcaggcggccggcatcgtggcctttgacacgcattcgggcaagattcaggccatccacgcgcgcaacgtgctgcttgccaccggtggcgcgggccgactgttccacaccacgtcaaattcctgggatctgaccggcgacggcatggccttgaccttggccgccggtctgcagctggaggacatcgaatttgtgcagttccaccccaccgggctcgcgcacaccggcatcctgctgtccgaggcggcccgcgccgagggcggcattctgaggaacgccgacggtgagccgtttatggaacgctacgctccggagcataaggatctggccgcacgagacgtggtctcccgctccatcatggcggagatcgacgccggtcgcggcgtcgccgacccgaaggacccggatggtccgaaggactgcgtctggctggatatgaccggcatcgaccccgaacgtatgaaggaagtgctgccgcaggtggtcgaaaccatcgagcagtacgcgaacctcgatccggccaaggacctagtacccatcaagcccactgcacactacacgatgggcggcatccccatcaccaccgacggcgaggtgtaccgttgggccgacggtgccgtgcaggtagtcgatggactgttcgccgctggcgaatgctcttgtgtctccgtacatggtgcgaatcgtctgggcggcaattctctgctcgacgcctgcctgttcggcacacgcgctggtcagacgatggccgcacgcatcgccgagaacccggttgactcccccatggccgatgattcggccgatgacatgctgaccgatgccgccgatcaggctgccgattctcgcaaagcggagcttgacgaactgctcgccgggccaatagatgattcagacgatggagtgcccaccgccaatccttatcagctcatggcccaactcggatcagtgatggagcaggctctggccgtacgttgcaccgctcagaccatcgatacggcgttgacccagatcaacggtgacatcacaccggttgccgataccttgcgggcccatgacaagaccgccgctttcaatcaggaggtcaccgccatctgggaagtccgtcatctgatcgaactggccgaggtcatgctgcacgcttccgaatcccgtcaggaatctcgcggatccatgcaacgccttgatttccccgaacgcgacgatgagcatttccttgctcactcgatggtcgccgatgatggttcggtaagtttcaagccggtgcacatcaccgactatccgcccaagaagcgcgagtactgatccgctggtggtaatacccaagccgcctagggcttgtggcacaataggttggctaatattggacttgacatcccactgtttcatggaggcagaacatggctgaggcgagcaacacgacggttaccctgcaagtgcatcgtttcacgccgcgacccgagcgtgccgaacgtgcacgcggtggcagcccgtttgccaagaaaggctccccgttcggcggcggctcggattcggcggcgcgccgtcgtccgcgcggcaagcagtgggtgcaggagtacacgattcccgcgcgcccttcggatactgtgttggattgtctgctgaccatcaaacgcaccgtcgacccgacgctggccttccgttattcgtgcggtcatggcatgtgcggttcggacgccgtggccatcaacggcacccccaccctgctgtgcacagccaccatccgcgattgggccaagcaacccggcgccatgcccgaagtcgatgacgaagggttccgacacaccggcaccgaggctgaggaatccgacgattccgcggaaaacgtcgcaaacgcggcggccgcccagaactcagccgcaaacggttcgctgggagtcatcgaactggcgtccctgcccggcttcccgccgcagcgcgacctcatcgccgacatcgcccctatgctcaaccagatcaggaagctcaccccgtatcttcaggcggacggcgtgctcgccaccaccgccgaaggcaaggtggacgtgttcgaatacctgcagaaccccgaacaactcgccaaatacgagctgctgagcaactgcatcgcctgcggcgtgtgcgaaggcgcctgcccggtgtacgccggcggcgacgccttcatcggcccggccgcgctgatttgggcctcccgtttcgtcaacgattcgcgcgacaccaaggccatggagcgtatggatgccatcgacaccgccgacggcgtggccgcctgccagtccgtgcgcgcctgctcccgccactgcccgcgcggcatcgatgtgggcgaggagatgtggcagatcgtggctaaggtccgcgagcgctaagccgcgccgcggctggctgcggcgatcgcctaagcacatgcgtcgatgcatccgctgggtgcccgcacgagagaagacatgaaagaacgaattatggacagaacgcagtacaccaacctcgccaaggcatgggaattcaccgaggaacacgcgcgcgaacgtgaatccgatgcgttgaccgacacccgtacggccgccgacgagtccggccagttgcagggttcggcggcgcaggcccgtctgctgggcatgctggtgcgcatcaccggcgccgcttcggtgattgccgtgggcaccggctcgctggtggagaccttgcagctcgcccatgcactggataacaagggcctgctgactgcggtcgattccaccgcccagggcatcgcgctgattcgcaaggcgttcgccgagctgcaggacgagaccgacaccacgttgcgtgcggtgaacgccccggccagcgtgtttctgccgcgcctcaacgccaatgattacgatctgatcgtggtggcgggcgacgccgagaactatgccgccacgttcgcccaggcctcccgtctgctgcgcgtgcacggcgtgatcgtgttcaccgatgtgctggcgttggaggacggtcagggcggcgtgatcaatccggccgaccgcagcgacaaggccatcgccatgcgtgagctgctcaccaccgtcgaagatgacgaaggtttcgagtccacgctcacccctgacggcaccggcctgctcatcgcctacaaaaagtaactctgtccttggctcccctcggagaggggagccactctatctcgcttacctcacaattgcgctgacggccacgtccacggcttcgtcggcgtcatcggttacggtgaccagtttcgggtcgatcgtcgagatcatgccatgctcggccaccggaccgttgagccagtcaaagagcccctgccagtattccttgccgtagagcaccaccggaatattcgccaccttgtgggtctgaaccaaggtcaataattcgaacatctcatccagtgtgccgaagcctcccgggcatacgatcacgccggaggaatacttgatgaacatggtttttcgcacaaagaagtaccggaagctcatgccgaggttcacccactggttcaacccctgctcgtgcggcaattcgatgccaagtcccaccgatttgccgccggccagtgccgctcccctattcgcggcttccatgatgccgggaccaccgccggtgatgacggcgatgttgcgcttggctatctggctacccatgcgccgtgctgccttatagatcgattcggtgcgctgggtgcgtgcggagccgaaaatagagaccgcaggtccgagctcggcgagcgccccgaaaccgtccacgaattccgattggatgcgcagcacacgccatgggtccatgtgcagccagtcggtgtcctgatcgggtttcagcaggttggcggtggtgttgtccgagggaatcatctggccgcgtagaatcaccgggccgcgatgataggtatcgcccagcggcgaggcgtcctccagatcgaccgggttcaccggtgtggccgcagcctcagttgccgtctcagcctccaacgccgccgcatcattcgcggctgtggcttccaatggttccatatcgtccacgactgcggacttggatgcggcctcggctagattctttgcttcagcggcctttttgccgtcgttcttcttggatttcttctgcttctttgccatccaatgtcctcctgtacggcgctatcgactcttcgcattctagcgcctgaagctctgcgtacgttttccgcgaaatcatccttgacttcgtgaagaacgtacggtgagtgacactgagcgtacgttttccgcgaaataaggcctcatctcgtgaagaacgtacactgagcgcgtctcagcgtacggttttcacgaaacaaggccaacaatggagtagggaccgtctaagccatcagtggcggaagtcgatttccacactggcggtgccgtcggcgagggtgccggggtgttccgtgggcgtggtgggctctgtggtgtggcttggctgcccgatgccatcaccatcaatcgattcgtcatcctccgcatcagccgctgctgcggctgcggtcttctcgaatcgcttggactgacggctcagcagcacaccggaaatcgcggcggcgatcagggaggccaccagcacgccgaagcgcgcctcagcggaaagttccgcgttcttgtacgccagcgaagcgatgaggaaggacacagtgaagccaatgccgcaggcgacggcagcgggaatcatgtcgcgcacacgcagccccttggccatcttgagcccgcccacatgcgtggacagccatgcggtggtgatgatacccagaggtttgccgaccaccaaagccacaatcagtgcgatgaccagcggcgaggccaacaatagcgggctcatcgactcgaagtgtacgccggtggcgaacaaggcgaagatgggcagggccagcagtgcggagaatggctggagcttgttggcatagcgttcggcacgcggcgagagttcgccgtgcatttcacgagagggggtcagcaggccaaccagcacgccggccagtgtggggtgcacgcctgcctcgaacatcatgatccaagcgaggataccgacgatgccaaccgcgatccacggcacttttttcagtcgtacgaggtatgcccagatggcggcgcatacggcgatgccgatgaaccaataccaggcgttaatcgaggagaagaatacggcgatcagaataatggccagcaggtcgtcgacggtggcaagcgtcatcaggaacgcgcggatcgaaccgggcagggccttggcgaacagggcgagcacggccagcgagaacgcgatatccgtggcggtgggcactgcccagccgtgcgacatctccgagaacgggatgctgctgccggtggtggtcagaatcagcgtgccgggttcaccaggcccgatctgagagaacaatgccgtgacggccaggaacaggatgggcggggcgatcatgccgcccaccgcgcacagcatcggcacggcggccgctttcggattggcaagcgagccggtggtgagttcctgcttcagttcgaggcccacggtcaggaagaagatggtaagcagaccatcctgggcccagtggccaataggcaggtcgagattggtgtaggggatgaacagatgcgtttccgctacggtctcgaacgcatgcgcggtggcgggcagattcgcgagcaccaggccggtgagcgcgaagccaagcatgatgagtccggaaatacggtctgaggcggcgattcgcctgatggtggaccaaagtcccttcttcgcgccggcggtcgtggccatcgcgtctccttgctgcactctcttggatgaaccgtatgtaatagtacggaatatctcaggacgttccgctccgggctgagtcgcgaagggcaaccttagcccaaccctgtgtggccgactcaaccgactcaaacgggccaatacaattggaaaagcctcggaagcatttcgctttcgaggcttactgtgcgccagacaggattcgaacctgcgacctgctgatccgtagtcagctgctctaatccgctgggctactggcgcataccactgttgtccccgtggttcgggagtgcgccagacaggattcgaacctgcgacctgctgatccgtagtcagctgctctaatccgctgggctactggcgcatgttgtctttcagacaactcgatatataatacacgccgttcagctgaatgcaactcggcgtgttgcggcgagtcgcaccatcccgaccactaccgcaacggcgtatttactggcctcacgcctcgtgtgtacggactcggtcaagcaaaaccgactacgcaactttgagacgtccctgcggcacatccacggcttcgcgcaggagtttgggcgtgctggaaccctctacggacgccttgtccacaatcacctgcctcacatcatccaaactcggcaactggaacatcgtgtcctgcaacgtacgttcgataatcgaacgcaacccgcgtgcgccggtcccctgcttgatagcgatatcagcaatcgcccgaatggcctgttctgtgaattgcaggtcgacgccgtcgacggcaaatagtttacggtactgcttgatcagcgcgttggctggctgggtgagaatcgccgtcagatcgtctacggtaagttccttcagcacactggtgaccggcaaacgtccgatgaactcaggcaacagtccgaactcggccagatcatcggcattgacctgttcgagcaattcctcgtctttcatgtcggcgtcgtgccaattcgcgccgaagccggtctctcgacggcctaatcgcttgcgaacaatgtccgtcagccccacgaacgcaccgccgcagatgaataggatgccgcgtgtgtccatctgcgcaacgtcttgctccttatgcttgcgcgtgccctccaacggcacggaggcgatggttccttccaagatcttcagcaacgcctgctgaacgccctcaccggacacgtcacgggtgatggaggtgttctcaccggatttgcgggcgatcttatcgatttcgtcaatgtaaatgatgccgtgctgggctcggcttacgtcgccatccgcagcttggaggagacgttggagcacggtttccacatcgtcgcctacatagccggcttcggtcagggtggtggcgtcggtgatgacgaacggcacgttcattacgcgggccaacgcctgcgcaagataggttttgcccacgccggtggggccgagcaacagaatgtttgacttggcgacctcgacgtcagccaaagggtcattgctgcggcgggcagcacgcgtctgggtgggaacggattgcttggcttgtttgccggtctggccactgtgcccgttattcccgtcaagctgctcagcggactcctgaagctccatgttgacgcgcttgtaatggttgtatacggctacggataatgcgcgcttggcgttctcctgaccgatgacgtagcggttgagataatcgaagatctgagcgggcttgggcaggctcagcgaattgacctcggcatctttgacacgctcctcggagatgatgtccacgcacagggcgatgcattcatcgcagatggaggcattgggaccggccaccagttttcgtacctgatgttcggttttgccgcagaacgtgcaacggggtacgtcctcgttgtagctcaccacacgtcccatgattctcctttgccgactgcgccgcaccgtcgaaccgccactctgcgcattatcattgtcatccttgaaatacaatacccccggtcgttgccgaccgagggtattgcaatgtccggaagttttactggcggtgttccaacacctcgtccacgatgccgtattccttggcttcaggagcggtcaggaaagtgtccacttcgatgtcgcggcgaatcttctcgacgtcctggccggtgtgcttggcgagggtctcctccagccattcacgcatacgcagcatttccttggcctgaatctcgatctccgtggccttgccgaagccttggtcgatggccggctggtggatgagcacacgggcgttcggcagcatcaggcgcttgcccttggtgccggaggccagcagaatggcggcggcggaggcggcctggccgaggcacacggtctgcacgtcgggcttgatgtactgcatggtgtcgtagatggcggtcatggccgtcatcgaaccgccgggtgagttgatgtacatcatcacgtcacggttcggatcttgggattcgaggaccagcagctgggccatcacgtcgtcggcggaggcgtcgtccacctgcacgccgaggaagatgatgcgatcctcgaacaggcgggagtaggcgtcctgggtcttcatgccatacggggtcttctccacgaactgcggcatgatgtaacggttggtcggcgcgggctgggctgcgcgggcggaggccggcatgaaaccggctacgccctgacggccggccaagcggtcggcacgggcggcgaactttgcttcttcacttgccatgagtctcactccccctgctggttgttgccgatggtgtccggcgtggtcacgagcttgtccacgaagccatagtcgagggcttcctgggcggtgaaccagtggtcgtattcgttgtcgcggtagatttcctcgagggtgtggccggtctgctcagcggtcagctcgctcatggtcttcttcatgtccatgatgagctcggcgttgatgcgcacgtcagtggcggtgccgccgatgccgccggaaggctggtgcatgagcacacgggcgtgcgaggtcaggtaacgcttgcccttggtaccggagctcagcaggaattggcccatggaagcacacatgcccaggcccacggtcgccacgtcaggctcgatgagctgcatggtgtcgtagatggccatgccggcggtgatggagccgcccggcgagttgatgtacagccagatgtccttcttcgggtcttcggcggccagcatcagcagctgagcgcagatgcggttggccatatcgtccttgacctcttcacccatccagatgatgcggtctttgagcagacggttgaaaatcgggtcgacggggccggccgggacgtcatcgcccgccatgaccggcaaggtcgcaaaggtattgctcaccttgattctccttctaattactcgaacattgttcagactaccgccttgaagcgactgaaggcggcttttcgcgtgctttttggcgggcagcgtagggatttcggtttattcgagggtgtcgaggacgtcgtcaatgaggaggcgggtctgggaggcggcatcgtcgcccagacgcgggaagcgacgggcggcattggcggggctggcaccggcggctcgcgctacgttggacttgctggcaccatgggccacggctttttccgcgagccgatcgaccagtgaatcggcgacttggcgcatctgttcggccacccataattgggccatatccgcaggtaagtcgtagtcttcggccacatcgctggctgcctcctgaatggcggcccataacaccatgaatggctttcgatagtagtcaatctgctcagtgagcggctcagcggcaagcaattcaagtgccgagcgaatttctgtattttctgacatagctttctttacctcggctcccctctctgaggggagctgtcgccataggcggctgaggggagtttcgaccggggcagctcccctcagagaggggagccagaatatatgtatttacttacgactcagcaaccactttgatatcaacgacgacgtggccacggccatgccgaccggcacaaagaaggtaatcggcgcttcagagagctccatcaccaagcacatggccataagcggtgcctgttgtgaggccgaaagcaacgaagccgcaccgatcaaggcacacgcggttaccgaatcggtcggaaacatcagtatccatacgaggccgagcatcgcacccagcgtggaacctaatgcgatgccgggctgcagcacaccgcccgacgcaccggagcgaatggtcatcagcgtcaccagcgctttggcaacaaaggtgagtgccaacacacccagcaacatccagatattggactgggacagcgggaaaccggcgttcatcacggatccagaagggccgctcccaccctgaagcatggcccagaacgatgccattccagagcccgctcccccgccagaggccgaatcggatacattaccgccgcccgtcagcaagttccatggagaggcggccgctgaagatgccgactgcatggcaccagcagtgccggcggtttcaggaatgaatgtgctgaatccaagttgcgctgcggcacggccgttgcccatcacctgcggcacaacagtcgccaccaaaccggtgatgagaccagccagcggcatctgccacagaatagccttaccggttggcttgtgcgcttccgcccattgcgaaccttttcggaacaatgcgccgcccactccacatgccgcaccgcagatcagagcgaacagcattaacgttggcgtggattccggttgcatggcggtaatgtcgtagaacaggtgatgccctttgatcgcaaccgccacgaatgcggcaatggcagacatgcccagtccaaacgcaactttttcgattgtcacatctaccaacaggatttcgacggcgaagaacatgccggccagtggcgcgtcatagacgcctcctagaccagcaccggcagccactgccaccaccatgcgccggtcgatgccgtcaacgccctcgatatggaacaggtcgcagaaacgttgcgcgagcatggcgccgagttcgcgtggggcgacttctcggccgatcgaggcaccggagccgacgatgaaaatctgcaataccacatgcgcaatggtttgccagaaaggcattcgctttcccgccacggccttcttgactgagggcaccgcagtcgttttgtgtcgcatcagataccagataatgcctgcgatgctgagtcccacggtcaccgatatcgcacggcgtgcagcgggcacgccgaatggaccaggcaattctgggccttcgatgtagccgagcagcacatgttcaacgccgtagagcaacagggtcagcagacctgctcccacaccgatgagcacgccgagcacaatggtcgccgcagcgagccaaccaaggcgtttgatagtaaccgttggctgcatgtcaacctccgcaccctatgcaacgagtatgccttgggaactcccctcagtctcgctacgctcgacagctccccctcaaagaggggagccaaagaaacagtccttttgccagaataggaagagcccggaaccatgaaacacgattccgggctcaaacaatcatgctaacgcgatgaggctatgctcactcagcatccttggcgtcatccttggcggacagttcgtcggccacggcggcagcagcggaagcggcctcgacggactcggactcttcgtcctcagcggcctcgcccaggaaggcggagaggtccacaacctcgccatcagcggtgaacttgacggcgcgcatgccggcgagcaggcccttggaacggccgacttcctgcacagcggagccaagctggccattcttgacgatggcctggatgaagttgttcggatccatgccgtactgctgggcgatggaagcgaggaagttgaacacgtcggactgggacacctgaacgtccagcttctcggccagagcgtcgagcaccatctgatcgcgcagatccttctccacggtctcctcggcctgagccttctgctccttggtggccttctccgggtccggggtcatgcccttgagctgctcttcgaccatgttggccttgacgcccttcggcaccgggatctcgaggccttcctgcagcttggcgatgaaggcatcgcgagcctcggtggcctgacgaccttcggcgtcctgagcggcagccttgcggatgtcagccttgagctcgtccagagtgtcgaactcggaagcttcggaagcgaactcatcgttcagctccggcagttcctcagccttgacggagttgaccttgaccttcacggtggccttctggccctcgtgctcgccggcttccagcgtgccttcgaaggtggtctcctcgccggcggacaggccgtcaagggcctcgtccagaccgtcgagcatggtgttggagccgagctcgtagctcacgccttcctgggagtcgacggtctcgccgtcaatctcagcagtcaggtcgatgttggcgaagtcgcccttggcggccgggcggtccacgccgaccaaggtgccgaagcgctgacgcagggcctcgaggcgcttgtcgacgtcctcatccttgacttccggcttggagatggcgatctcaagaccgtcgatttccggcagttcgatgtcaggacgacgctcgacggtggcggtgaacttcagcttggtctcgtcgttggcggactgcggaacatcctgcacgtcgaactccggctgagccatcggacgaatcttcttctcatccagggccttggagtacagctccgggaccgcgtcgttcacggcctcaccggcgacggcggcgaaaccgatgcgctggtcgatgatcttgccgggaacgtggcccttacggaagccgggaacgttcacctgcttggcgatttccttacgggccgcatccagatacgggttgagctcttccggttcaacagtgacggtgagcttcaccttggtgggctcgaggttacgaacgctgatcttcacgctaatgactcctcaaaagtcgttatttcttacagttctgccgtaaggcaacctctacatgataacgccacttacggacggtgcaatgagtttcacttgccagttccttgcgccctgctcgatcaggaacgtctcgacgtccacttccaccgggtcttccacccagcacaggttgcgtaggatctgtggcttgatgatcatctcggccggcgtgcgggtgtcttcggcgatgcggttgatcacacgccgcacccgttgcagacggtcataacgctccggatggcgctgttgccacagccgcatggatcggggcgcgttcaccacaccgttttcgtcctgttcgggggcgggcatggtaggccattgggcgggcttcagggccatggctcgatcgatggcctgcttccagaccttcggtttgaccgcacgctgaatcggcgcgtaccgctcgaacattttgtcctgctcggtgccggtatggatgcgcacacgctcgttcagggatcggagcgcgcggaattgggcagcattgtgcggcttgttggtcgccgcctcgatgattgaggaatcggccaataacaggctgggcgcaatatcgtattgccgggcgagtcggtcgcgctcctcccatagggatttggcgatggccaagccccttggatcacgactcagctgggtgatgcgcgagatacgcagccaaggaatcggatgcggtttgcgcggggcaaggcccgcaaccaaagcgtgagaaaactcttcagcggcccactcgtccttgcctgcggctttcaggtcacgacgcatcatggtttcaagttcgataagcacctccacgtcgagcgccgcatagttgcgccagtcgcgcggcagcggacggtaggaccaatcggcggcggaatgctctttggctagcgtgatgccgaggtagtgttcggtgacggcggccagaccaaagcggtgcaggccgagcaatcgcgccgctatttccgtgtcgaacagggctttgggtttgagcccgatttcggcgaatccgggcaagtccatcagagaatcatgcagaatccacgtggcgtcgcccacggcgtcattgaattcattccaatcagctccggcccgggtcagggcgacgggatcaagcaaggcgatgcctgcaccctcacgtttgaactgaatcagccaatcctcgtgtccatagcggaagccggacgcccgttcggcgtcggcggccagcgagcccgtcgcctcggccagcgcatcgcagacacgatgatagccgtccagcgtcgaagtgacatcgggtactcccccgcgaggctctttcagcagtcggggttcggtgtcacggacgtcactcaactggcgtcatcctcctcaaaacggatggtggatctgatgaatgcggcccacgagcggacttgtgcgccggcgtccatagtaccgtccggcccggtcccgtcaagcggggtccatgagacgcgaatctcacacccggcgctggtggagccggccatcgagccaaaagccgtgttttgggtcacggtgactgtgccggataccgaatccggctcgatgccgtcgaaatagtcgcacatgtcatcccagtacatgccgggggtcagagaatcgttttcggcggtttccagcggcagtcgcgcgaacgccacgcaacgccagttagaatcccagtcaatgcgcagctcatgagcataaagcatcatgatccagcctgtggcgattcgtgattcggcatcgctgccaagaccggcggaaaaggcatcgccgagggcacgctctcccgcttcgaattccacgccgataccataatcggccaaggtggaaggcacgggaatctcccgatagcgcacgtcatggatgcgcttcatggtgctgacggattcgacggctgcccatacttcatccggcacaccctgagggcgcacggggcgtccgtcgttggactctcccgtaggaaatgcgtagatgtcggccatatctctagggtatgggcgaacgggccgaatcgtggtatttacgcgcggttcggccctgcaatttaatacacggtgaagccgtggtccttgaactggttggccacccgttcgcgggtggcggcgttgggtcccttctggttctccagcgggtatgggatgcgcagttcgtgccacttcgggcggccaagctggtggaatcccagcacgtcgatgtgttcgacggcatcgccgaaggactcgcagatcttcgccacgttttcgacgttctcttcggagtcggtcaggcccggcacgagcacaaatcgcacccagatcttcttgccggccttggccagtcgctggccaaaatcgatggtgggctgcaaggtgccgccggtgaccttgtgataggtctcctcgtcgccggatttgacgtcgagcagacacaggtcgatgtcctcgagcatctcgtcggtgtagctcgtgttgaggaagccggacgtgtcgaggcaggtgtgcacgcccatctccttggcggcatggaacacacgcgagacgaaggcgggctgcatcatggattcgccgccggagaaggtgataccgccatgcgtggccttgaacaggtccttgtaacgatcgaccttcttgatcatggcgtcaaggtagacgggcttgccgtcgcgcatcttccaagtgtccgggttctggcagtactggcagcgcaacgggcagccggacatgaacacggtcatgcgggtgcccggtccatccacggaggtgttgatgtcccaagagtggacgaagccgatatcgccggatttcagggcggaaaggcggtcacgtcggtcgagtccgattggggattcaaagccggaaaggccacccatcaaagtctgcgaggcataggtcttcgattccttgagcatatgcctggtcgtggtgcggaacgtgggtgttgcgggcatcgttgtcctcctgttccaaatgatgcgaaagtctgtgggaaataaggaaggggtggagccgtgccccaccccttcagttagtcattgccgcggttcgcggggttggtcatcagtcgacgacggcaccctggtggaaggtacgggagatgacgtcgagctgctgctccttggtgagcttgacgaagttcaccgcgtagccggagacacgcacggtcaggtgcgggtacttttcggggtgctcgacggcgtcctccatggtctccttgcgcagaacgttgatgttcgcgtggtagaggccgtggccgttgccggcgtccaggatgccgaccaggttgccgatgcgctcgtcctcgtcgcggcccaggccatcaggggtgatggtgttggtcagcgagatgccgtcaagagcgtcgttgtagtcgatcttgccgacggagaacatggacggcagcatgccgtgggagtccatgccgttctccgggttggcgcccggagcgtacggggtgcccttggcgtggccggacgggaaggaaccggtgttcttgccgtactcgacgttggaggtgatcgtcaggatggactgggtcgggacggcgccgcggtagaccgggagcctcttgacctggcccatgaccgtggagacgacccacttggcgatgtcgtcggcgcggtcgtcgtcgttgccgtagaccgggaactcgccctcggtgcggtagccgacgatcaggtcgtcgtcggcgccctcaacgtactcgtactcgtggccttccagggtcttcgcgtccttgttgtagatcgggtagaccttggcgtacttgacggcggcgagggagtcggcggcgatggacagaccggacatgccgcagccgagggtgcggtacacttccttgtcgtgcagggccatctcgatggactcgtacgcgtacttatcgtgcatgtagtggatgatgttcagggccatgacgtaggtctcggacagccactcgagagccttctcgtagttgttcttgaccttctcgtagtccagggtgccgtcggcctccggggtaatcggctcgatcacgcccttgtcgatgacctgcatgccggtcatctcgtcgcggccgccgttgatggcgtacagcagggccttggcggagttcacgcgggcggcgaagaactgcatctgcttgccgacacgcatcggggacacgcagcaggcgatagccgcgtcgtcgccccagtggctgcgaatctccttgtcggactcgtactggatggccgaggtgtcgatggagatcttggcgcagaagcgcttgtaggcctcaggcagcttcggatcccagaagatggtgatgttcggctcggggccaggtccgaggtgctcgagggtcagggtgttgagcagacggaacgaggtcttggtgaccatcgaacggccgtcatcgccgaagccggcgtcggaccaggtcgcccagtacgggtcgccggagaagatcgaatcgtagtccttggtacgcaggaagcgcacgatgcgcagcttcatgacgatgttgtcgatgagctcctgggcgtcggtctcggtgatcttgccggcctggaggtcgcgctcgatgtagcagtcgaggaaggcggagttgcggccgaaggacatggcggcgccgtcctgggacttgatggaggccaggtagcccatgtaggtccactgcacggcttcctgcgcggtctgggccgggcgggacaggtcgaggccgtactcgttgccgaggttgatgagcttcttcagggccttgatctgctcgtcgtgctcctcacggaagcggatccagtgctcgatctccggctcggtgaagtcgttgcggtacggcacggagtccttgtcgcgcttcttgaaggcgatgagcttgttcacgccgtacagggcgacgcggcggtagtcgccgatgatgcggccacggccgtaggcgtccggcagaccggtgaggatcttgttgtggcgggcgaccttgatctgcttggtgtacacgccgaagacgccgtcgttgtgggtcttgcggtacttggtgaagatcttcttgatctccggatccggttccttgccggcttccttgatggcctgctcgaccatgcgccagccaccgttcggcatcatcgcgcgcttgcagggaacgtcggtctggaggccaacgaccacgttatcgacttccggggagtcgatgtagccggccgggaaggcgtcgacgtcggccggggtatgggtgtccacgtcgtagacgcgctgcttgcgctccacggccaggtagttgtcgtcgaggtacttccacaggtgcttggtcttctcggtggcaggagccaggaatgtctcgtcgccctcgtacggggtgtagttcttctggatgaagtcgcggacgtcaatatccttctgccagttgccctcggtgaagccggcccacgccttggcgtcgagctcctcctgggagacagctgcattttccactgcggtcatgtcactccttaaatggggttgtaggtttcgcatcttcacggaacccttggttcaacagtgtagttggcacttgcttgagaaaagctgaaattgggagtgagctatctcacattgtttttgtgaacgctaccattccaatggcttctaggtattgatgggactattgcacgtctccagatatgggaaaccgctcatactgtgatgttcgtatgagcggtttgatgagcggttcggtcttgagattgacagcagaaccgtatcagtcagttttcgaccgtcaatcctcggggtgagcctgtgcgggtttcacgccgtagttcttccagcgccggttctcctcctcccatctggcattgcggtccaccacgatgtcccacgcatgttcggcgtcttccttggtcttgtacggacccatgcgctgttcgatcggtgagatcatgcccagctcggcctgcttcttgacggtgttgaaataccactgcttcttgttatcgtctgtcattggtacctcctcaacggtattacttgctcccgctggcgggagcaatatatgtttattccctgaatgcgttggtgacgggcaggcggcggtcgcggccgaacgcgagggccgtgaccttgggacccagcgggtattggcggcgcttccattcggcgcggtccaccaatcgcatcacggtgtctacggtgacctggtcgaagccgtcggctaacaggtcggcgcggccgtgcgcgtgctcgatgtatgcggcgagcaccttgtcgagcagcgcgtattcgggcagggagtcggagtccttctgcccggggcgcaactcggccgagggtgccttctcgatggaggagaccggaatcatcacgccgtccttcaacgggatgccggtgttgccgtcctcgttgcccacgatcttgagaccgccgatgccgacgcctgcggccgcggccttgttacgccaacggctgatctcccagacacgggtcttgagcaggtccttgatgggtgcgtagccgcctaccgcatcgccgtagatggtcgagtagccgcaggcgagctctgacttgttgccggtggccacggcgagcagaccgcgcgaattggagctggccatcacgatcacaccgcggatgcgggcctgcaggttctcggcggagacgccatcaaggtcaagttgctgttggtaggcgttgaacaatggctcaatgggctggacctcgtaatgggcgccaatgttggaggccaaatcggcggcgtcgtctttggaaccgtcggaggagtacatggagggcatggagatgccccagacgttctcgccgccgcatgcgtcggccgccatggcggctaccagtgcggagtcgatgcctcccgagaggcccagcgtcacgccggtgaagtggttcttggccatgtagtccttgaggccgagcacgcaggcagtgtatacctcttcgtccgggtcgagttccggaacgatctcggccttggcctgatgttcggcggcggaatcgaagtcccagaacgtcaggttttccatgaacatcgggctgcgttcgataagcgtgccgtcggcgtcgaccacgaagctgccgccgtcgaagacgaggtcgtcttgaccgccgacctgattcaggtagatgaccggggcgttaacctcggcggcacgacgctgggcgagctcgaaacgggtgttggtcttgccttcctcatacggcgagccgttgatggtgagaagcaggtcgatgttcttggtggccaggtcggccaccgggccgccgtcctgccagatgtcctcgcagatggccacgccaatggtggcgccgtccacgtcgagggtcacggagcggtcgccggcggagaagatgcggaattcgtcgaacacgccgtagttgggcaggaagtgcttgtcgtagccggcccagaccacgccctggtgcaagaccaccagtcggttgcgcggcttggaggtcttgcggtcggtgcccacggtgccgaccaccacgaacagatcgccgaggccgtcgtcgttgagctgggtggcgagttcgttggccttgtcccatgcggcttggcggaaggtgcggcgcagggccagatcctcgatggggtatccggtgagggtcatttccgggaaaacaaccacttgggcgtttcctgcggcggctttacgggagtagtcgagcaccttggcggcgttggcgtcaagcgcgccgacgcaggtgtcgatctgggcgagtgcgaagcgaagctgtgtcatagcttcttagtgtagccgcgtatggcgtcggattgcctgttcttccggcttggcgtcattcattaggtcgttttttcgttcattaggtcactgcaatgcgatatcagtcgctgcaatggcgcgattccaacaaccagtatcgccgttcaccaacctaatggacgatgaatcgacctaatgaacgaatgccactcccctcagtcagcttcgctgatagctcgtcctgcacttatggacggacgaggtccgtccatatccggttcggctgtcgcctcaccttcggctacagacagcccactgggctgtctgcctaacgcctcagcctccggaggggagccagaaaaggatttacctcagctcgttgagcacgcgcagagcggtgttgacgtagaagttgacgaaagtgggaatggattcgtcgagacccacgaaatgcgggctatgccagtcggcgcaaccttcctggccgtttgacccgacgaacgcgaacaccggcaacgtcaccttggcgaattcgcagaagtcctcccccgccatcgactgacgtatcggttcgagctgcgcgtagtcgttgacatccgccgccacggccttggcgagacctggatcggagaccagcgggtcttgaaagtcatcccagaccacgtcggcgctgatgccgtatgcctcggcggtgtgttccaccacttccttgaatcggcggccgaccagattgccatccgacttgtggaaatagcgcacagtcccttggaatccggcttcggcgggcaccacgttccacacatggccgccgtgcacttcggtaacggacagcaccagcgggtggaagggcgtgacgttgcggctcacgatggtctgcaggctcagaataatactggcgagcgcttcgatgggcccggtgcccttgtacgggtaaccggcgtgggtgccttgggcgtggagggtcacgcggaatttcacgcagccggccatcatcggctcaacgccgatggccagctggccgggcgcatagttgggattgttgtgcgtgccgataatggcttcgacgtcatccacgagtccggcgtcgatcatggcgcgagcgccttggccggtctcctcactcggctggaacagaatcttgatcgagccggcgaacttgtcacggtgctcggcgagccagaaggcggcaccgagcagaccggtcatgtgcaggtcgtggccgcagccgtgcatcacgccttcattgacggagctgaactccagtccggagtcttccacgatgggcaggccgtcgatgtcagcgcgcagcccgatacgcggcccgggaccggcctcgccctgaatgagccccacaacaccagtctccagcgggttgtgcaggatctcgatgccgtgcgccttgagctggtcggtcagatagatgctggtgccgaattcacggaaactacgctccggatgggcgtgcaggtagtggcggatggtgatgagttcgtggtcgatgtcgatatgttcactcatggttcccgattctagtagcgcgaagaatatattgcggccctcgctccatattggcgagggccgcgatctatggggtcagtatgtcttgttattgctggcgtttgagcagtcgtttggcgatggcgttggcgatgccctgcaccacctggaccagtacgatcatgatgatcacggccgtccaggtgacggtctggtcgaacttctggtagccgtaggcgatggcgaagttaccgagaccgccaccgccgatgtagccggccatggcagacatgtcgagcacgccgatgaacaggaaggcgtaggccaggatcagcggtgccagggcttcggggatgagcacggtgcggatgatggtgagcttgccggcacccatcgaacgcgcggcctcgattactcccgggtcgaccggcacgagattctgttcgaccagacgagaagtggcgaaggtgcacatgaccaccatcgggaagatggcggccacggtgccgatggacgtgccgaccacgacgatggtgagcggctgcatggctgccaggaaaatgatgaacggaatcgggcgcacgatgttgacgatgatgtcaaggatgcggtagacgaccgcgttctcgaacaggttgccggggcgggtgccgtagagcaccacgccgaggatcaggccgaggaatccgccaatgacgagggtcacgagcaccatggtcagggtctgtccaatggattcgaacagtagcgggcgcagcacgttccagtcgctacgcgggttggcgaggatgatcatgcgttgtctccttcatgtgcggcggcggatacagcgggcgcggtggcagtatcggccgccagcgggtcataggatcggtcttcggcgtaggcggcgtgtccagcgaccgcgtcggcgtaagccacaggctttgcggcggtgccgaagtcgatgacgtcgctattgacggcgagctcgcgcaggaattcgtccacatgccagccgggcccgttgaattcgtaggtgatggcaccgatggcggtacctttgaccgtgtcgataccgccgtagagcaggctggattcaacgccgtatttggcgatgagttcggagatattctgtccggatgccttgagttcatggccttgggtgccggaaacgtccttttggcggataagcacggtgacaatgcggcccgaccattcgtgatgcaatcgctcgacccggtcttcctcgggcaggccagacaatgcggtggcgatgaatcgcttggtcaccggctgctggggtgcagcgaacacgtcgtatacgtcgccggattcgaccacgcgtccggcgctcattacggccacgcggccggcaatctgctggaccacgttcatctgatgggtgataagcacaatggtgatgccgaattcctcgttcacacgcttgagcaaggccagcacttcggtggtggtttccgggtcgagcgcgctggtggcttcgtcggcgagcagaatctccggattagtggccagtgcgcgggcgatgccgacgcgctgcttctggccgccggacagctgcgaagggtatttgtttgcgtgctcactgaggcccacgaattcaaggagttcgttgacacgacgatcctgatagtccttgcgccagtgatcgagttgcagtgggtaggcgatgttctgggccacggttttggtggagaacaggttgaactgctggaaaatcatgccgattttctggcggatgggccgcagcttggtctcactcagagaggtgatatcagtgccaagcacggtcacagcgccggaggtgggtcgttcgagcgcgttgataagccggaccagtgtggatttgcctgcaccggaatagccgatgatgccgaagatgtcgccgcgatcgatggtcaggctgacgtcatccacggctcgtgcgatgttcgcgccgcgtccgcgtgttttgaattccttcacgacatggtcgaaggtgatgatggggtcgctcatagtgctccctgatgctggttgttggtgtccggtcacggaagcggagcgaatcccgattgttggctcgggtactcgctccgcttggtggtaatggctatggataggttagtcgtgcactcgtatcagccacggctcactgctgggctttggcgtccttctcaatgtcggacaggaagccttgcagctcgctggcgctgaacttgtcggcgaacaccgcggtaccgccggagttctcctgcagggcgtcgagcacatccttctgctggtagatggaaacgagcttcttgtaggtctcgttgttcacgtccgccttgcgggccacccacacgttgatgtaggggcgagcctcttcggattcggcgtcatcctggtagatggcgtccttcgggtcgagaccggcgtcggccacgtagtcgttgttgatcacaccagcggcgatggtcgggtccttcagggtggtggccacctgttcggccttgagcggggtgaccttgaccttgctcttggcttcgtcgatgtcggccggggtggagaaggcggtccagtcgtccttgagcgtcacgagaccggcggccttgagcacgccgatagcgcgggcctggttggtttcgtcgttcggaatggtgacggtgtcgccctgcttcaggtccttgatgtccttgaccttggtggagtacacgccgagcgggtagatggcggtgccgccgatgggctgcaggtccttcttgttgctcacgttgtagttggccaagtagagcaggtgctggaattcgttgaggtccagctcgccggagtcaagggccgggttttcggaggtgtagtcctggaagtcgacgatgtcgacgtagatgccggccttctcggcgttctgcttgaacttgacccattcggggttggtagcgccgaccacgccgatcttgaccgggttgcccttgctgcccttggcggacgactcgttggcaccggcaaacgcgcggtagccgaagaacgcggccacggcgataatcgccacgaccacgatggtgatgatgacgttgcgggcggtgtggttcacacgcaccggctcgttattgttaggagcggccggggttgccggctgggttgctgctgtcattggatttcctctctccaaaattgatgtcgggtaacaccataacgcgcttgaaccgcgaaagtgacggaaaatggccgattgccgtataggtgtcttttatggcgcgcatgcaatgtccgggattcgtgcgtttgataacccgctataggcgtgctgaacacgccggaaagcacgtcgagaggagctttgacaatggaagttatgactaccgatactgccaatgccgatatccgagccgtattcttcgatatcgatggcacgctcaccagtttcacgacccatacggtgccggattccacaatcgaggcgattcaccggctgcaggccgcaggcgtcaaggtgctgatttgcacgggccgcgcgccttcacagatgcacgtggtgctggataccatgccggtgacgttcgatggcgtggtggcgttcaatgggcagtattgttttgatgacaccggcttctttgcctcgcaggccttggatactgctgatattgaggtgattctcgactggctggaccgtcaccccgatgtggtgtgcaatttcggcgagaaggattacgtgtacttcaaccagtccaatgatctgcttcgcgccacgtggagcaaactgggcaaaaccgcaccgacccggtatttcgaggacccgcgcacccgcgcgctggatcatgagaccttccagatcagtccctttgtcgggcccgagctggaggccgaactggtgggactgtgcagcaatgtgcgcggggtgcgttggcatccggatttcacggatctgattccggccgatggcggcaagccgcgcggcatccagcggttcatggcgcattacggcatcacgcgcgagcagaccatggccttcggcgatggcggcaatgacacggatatgctcgcctacgccggcatcggagtcgcgatgggcaacgcgaccgccgagccaaaggccgccgccgattacatcaccgatgacgtggaccacgacggcgtactcaacgccctactgcatttcggggtgctacgcgattaaaacatcacaacagttcgctttgttctgccccgccgtgacagggcttatgaataagcaaagggctcgggacgaatcccgagccctttggtgttagcgaactaacaacaccgtggaggtgttatcactcgttgtcgccagcggtagcggcggtagcggtgacggcacccttcttgtcggtgttcacgccggagtacacccagtcggtgtagtccgggtggtcgtagccgttgtcgacggcgaactggaaggcctcatcacggaacttctcgagctcgtcgatcttgtcggcgtacttgtcggcgtcgatcatgcgcagagcctcagcggtcagctcgtagcggtcgatgcggttgacacgaaccatgtcgtacggggtggtggtggagccctcctcctcgtagccgtggacgttgaagttgtcgtggttcggacggtcgtagatcaggccacgcacgtcgtgagcgtaggagtggtacgcgaacagcaccggcttgtcggcggtgaagatgtcggcgaactcctcgtcggtcagagcctcgtcgttctccttggcggactgcagggagagcaggtcggcaacgttcacaaccttgaacttgacgcccagttccttcagcttgtcggaagcagccatgatctcctgagtcgggacatcgccggcggcggcaagcacgacctcggcctcatcgttgttcttggcggtggaagcccaatcccaagcggcggcacccttctcgagctcggcacgagcctcgtccagggtcagccaggtggcagcaggctgcttgccggcgatgatggcgttgatcttgttggtggacttgtagcacttctcggcgatggccagcagcatgttcgcatcggtggcgaagtagatgccgatgacgtggtcgttgtggaagcacttgttcagcaggacggaggtgacacccgggtcctggtgggagaagccgttgtggtcctgacgccaaacgtgggaggagaccagcaggttcatggaggcgatcggcttgcgccacggaatctcgcggacggtagcctcaagccacttggcgtgctggttcagcatggagtcgatcacgtggacgaaggactcgtaggagctccagatgccgtgacgaccggtcagcaggtaggcctcgaggaagccttccatctggtgctcggacagctgctcaacgacctggccggagacgtgcatgtgctcgtcgacctcgtcggagatgtagccggcatcccactgcttgttggtgacttcgtaggaagcctgcagacggttggaagcggtctcatccggtccgaagatgcggaagtcgcgcgggttgttcttgatgatgtcgcgagtgtaggcacccagggtacgggtggcctcgagctggccccagccgtggccgtactcagccacttccttgacctcgtagtcctcgaggttcggcagcttcaggtcgttgcggatcacaccaccgttggcgttcgggttggcaccgatacgcagctcgcccttcggcatgaaggcaaggacgtcgtccttgacagcaccgttggcgtcgaacagctcttccggcttgtaggactcgagccagttcttgagaacctcgaagtgggcctcggtgtcgcgggcggaagccagcggcacctggtgagagcgccaggagccctcggtcttcttgccgtcgatgtacttcgggcaggtccagcccttcggggtgcggaagatcagcatcgggtagaacggacggtgcacgttgtcggtctgagcggtggccttgatgtcgcagatctcgtcccagatggtctcccacagctcggcgaagcgacggtggatggacatgtggtcctcatcatcgaagccagcgacgaactcgtagggctcataacccatgccgtggaagaactcgtggagctcttcgtcggagatgcgggacaggatggtcgggttggcgatcttgtagccgttgaggtgcaggatcggcagcacgataccgtcggtgcgcgggttcacgagcttgttggactgccagccggtagccagcgggccggtctcagcctcgccgtcgccgacgatggccgggacgaacaggctcgggttgtccatgatggcaccgtaagcgtgggacagagcgtaacccagctcaccaccctcgtggatggagcccggggtctccggagcgaagtgggacggaataccgcccgggtaagagaactgacggaagaacttctgcagaccagcttcgtccttggtgatcttcgggaaggtctcggtgtaggtgccgtccaggtaggactgggaggtaccggccgggccaccgtggcccgggcccatgatgatcacggtgttctggccgtggtcagcaatgaaacggttgatgtggccgatgaggaagttcaggccaggggtggtgccccagtggcccaccagacggtgcttcacatcttcgcgggtgaagggctccttcatcagcgggttggaacgcagataaatctggccgatggaaaggtagttggcaacgcgccagtacttgtcaacgccttcgagggcttcctcggaaaccggagcgttgagcttcttccaaggggtgccaataacaggactcgtcatgtgtactcctgtactcctgcacgtgatcgtgcgattgattatttctgttcggtcacggtccctgacccttgcggtgccaaggttttccgttcccaatcaatcgtcatggtacgaggacaacgcgacttttgaacgatttcttgcgggtgtgttcggaattgttgcggaaatttcagtatttgtgcggttcaactgaccgtttgtcaacattagttttttcaaaatactttttcaaaacggcggaagcatgcggaaatccagcatttggctagaacagcgcacgttcgatttcccatgttcgaaatcggcgtgttgtccgtctacgggcatgtagtttgttcgatttgcgcacatagtctctgcgtgtcggccttgtcgccttgaccagtgataatcaggggtgttcagcccacgtaaaattccaatgaacgttaggggaatatcaatggcaaacggtcctgtgcttgtcgtcgacttcggcgcccagtacgcccagctcatcgcccgccgcgtgcgcgaagcaggcgtgtactccgagctggtccctcattccatgccggtcgacgagatcctggccaaggatccgaaggcgattattctgtctggcggcccggcctccgtgttcgagcccggcgcgccgaccatagacaccaaggtattcgaatccggtgttccggtgcttggtatctgctacggcttccaggtcatggcctatgagctcggcggcaaggtggataaggccgcgctcggcgaatacggcaagacctcagccaccatcgacgacgccgccggcatcctcgccgactcccccgccgagcagaccacgtggatgagccacggtgtggcggtcgaacaggccccggccggcttcgaagtgctggcccacaccgaaggcgcgcccgtggccgccatggcggacgaatcccgcaagctctatggtgtgcagtggcacccggaagtcaagcactccccgcttggccagaagcttatcgaaaacttcctgcaccgttgcgccgcgctgcccaacgactgggatgcctcctcgattatcgaggatcaagtcaagaagatccgcgagcaggtcggcgacgccgaggtgatctgcggcctgtccggcggcgttgattccgccgtggccgccgctctggtgcacaaggccatcggcgaccagctcacctgcgtgttcgtggaccacggcctgctgcgcaagggcgaagtcgagcaggtcaagcacgacttcgtcgccgcgaccggcatccgcctcatcaccgtcgacgccgccgacgacttcctcgacgccctcgcaggcgtctccgagccggagcgcaagcgcaagatcatcggcgagaagttcatccgcaccttcgagaaggcccagcgccaggtcctcgaagaggccggcgcccgcggcaaggaggtcaagttcctcgtgcagggcacgctctacccggacgtcgtcgaatccggcggcggcgacggtgcggccaacatcaagagccaccacaacgtcggcggcctgcccgaggacatcaagttccagctcatcgaaccgctgcgcactctgttcaaggatgaggtgcgcgccatcggcaccgagctcggtctgcccgacgaaatcgtctggcgtcagcccttcccgggcccgggtctgggcatccgcatcatcggcgagatcaccaaggagcgcctcgacctgctgcgcgaggccgacgccatcgcccgcgaggaactctccaaggccggtctcgaccgcgacatctggcagtgcccggtcgtgcttctggctgacgttcactctgtcggcgtccaaggcgacgagcgcacctacggctcccccatcgtgctgcgcccggtgagctcggaagacgccatgaccgccgactggtcccgtgtcccctacgatgtgctcgccacgatctccacgcgcatcaccaacgaatgccgccagatcaaccgcgtcgtcctcgattgcacctccaagccgccggcgaccatcgaatgggagtaagccgatagggctttgacctgctcttttgagtgccgtggtgtaccgctgagtttcgtttcgtacgagagtcatggcaaaaccgccagcgacggcagtgagtaaaaacgatttcctagcctccgttccctcgttggaacggaggctttttctttgccgttttactccctttcacctgcgatttcgccatttactccccgtgtttcaagacaacaaggcacggggaggtattcgagggaatgggagtaaggatttatcccaagtgagttgacgcgcggtttttgtccccgagggcgaaacggtgccgtttcggggcccgtgaaactcaaatcgaactcaacgggcattttttgctgggcgtttccaatgttcccgttccgtgggataccctgattctctctgtggtactgtttgtggtgattcctctggctggcggtatgctgacccgttcggctgtcatcaagcggaaggggcagtgtactttgaggagactttcatccgtatgtttgacagtgcaactaccattggcttattgctgacgctggtgatgattttctcgttccaaggcaataccattctggaaaaacctctgcacattgttttgattgcggtaccgctgattttacagaccttcctgatttttgcgattgcgtatatcgcttgccgggttttgaagctgccctacaagattgctgctcccgccggaatgattggtgcttccaacttctttgaactggctgttgctgttgcaatcgccttgtttggaacgacttcccctgcggcactggcaacgactgtgggtgtgctgacagaagttcccgtgatgctgttccttgtaaaaaaacgcaaataaaatgaaagactggttcaaatatgagtaagaaaaaggtggcatttatctgcgtccataattcctgccgcagtcagattgccgaggccttgggaaagcacttggcttccgatgtgtttgaaagctattccgcaggaacggaaacaaaaccgcaaatcaatcaggatgctgtccgcattatgaaagaactgtacgggattgacatggagaaaacccagtattccaaactgatctcggatattcctgcccctgatattgcaatctccatggggtgcaatgtgagctgtcctttcattggtagagcatttgacgataactggggattagaagatccgaccggaagcgaagatcaagtctttgtcgagatcattcgagagattgaaaaacggattctacagttgaagcagtcccttatttgattgaaatagcactctgcttgtggtataatacagatgatccaaaccattgcttttctgctgataacattgggcttgataatcttttgataacaggagtccgacaacgccgtataagttggataattggtatcaaattgagcaactaagagtcaaatcccctaaacagtattgtttagaaccagttttactttggcgagtgggagtaaactggagcggattttgcgcaatcgaaattccgtccgtagagtgtcgcagtgtgccgccacgtacgaaaaagcgtaaagccacctgtgattttgggtgagtaaaaactattgagaccctctggaaacaacgttttcagggggtctctttatgccttttgacctgtagtttcagtcatttttactctaaaagcgcgtacaccacggacatggcgacacgcagcggacgaagagtaaaggatttttcggagagtgaactgtcccagtagtttgtcccaccaccccaaaaacgcccctgaaactcaataggaacgcaagggcgtcatcgtgcgagcaccgcagcctgagccgccgataccaggctcgtttgcgacgccgtcgctgcttgcctggatcgtcaacggcaagtacgtcatgtcgctgccgctctaccgcatagaggcagacctcaaggcgtgcggcgcgacgatatcgcgccaggacatggcgaactggatgatgaacgtgcacgcgcgctggctggcgaaggtccatgagagaatgaaggtcgagctgctgtcgcatgtcaggattcatgccgatgagaccacggttcaggtcctgaaagagccgaaccgcgaggcgaagaagaaatcgaggatgtgtctgttctgctcggcgcgctgcgacgtgcccgtgtatgtattcgaataccacgagacccgcaggaagggcgttgcccaggagtttcttgcgggctggtccggcacgcttaccaccgacggctacaaaccctacttcaatctcggcaaccccaacatcgccaacacggcgtgcctcgtccacgtgcgccgctacttcgcccaaatcgtgaagatcgccggcggcggcgccaaggcggcgtctgcggccagcgttgcgctcgaggcaaggcgcaggatcgacgccatgtttcaaggtcgactccaagttcgacgacatggagccgggtgccaggaaggccgcccgcgacgcggagctccgcccgctcatggaggacttcggggggatgggcgcgggccagcttcccctagcctcgccgaagctggcgctgcaccgtgcgctgcagtacgccgtggagttctggccctacgtcatgaacgtgctcgaagacgggcacctggagctctcgaacaacgtcgccgagcaggcccagcgaatcttcgtcgtagggcgcaagaactggctcttcagcgatgcgccacgcggcgcgcgggcgtctgcggcgatatacagcgtcaccaccacggccaaggccaacgggctcaatcccaggctttacgtcgagtggctgctgaccgagatgcccaacgccggcgagctcaccgatgaggttgtggactcgttcctgccatggtcggatagggtgcctgagtcctgcaagctcgacccagccgctgccgagaaggccaaagagatgcctgacgacttcataattaacatcgaccccgatgcgttcgacgacgagatggcgaacaacgccgaggagggcctgtagcgacatagcggcctaaggcataccgcaacgcaaagatggaaacgtccaggacttttccatccgtatgccggaatggccctggacgtttctgtgttttagcaagttggcgtccgctttgtgagcggtgtttttccgcagtgtaggcagcgggttttccgcagggtgtgcggtatcggccgctgcctgtctgcgttgtgttggttatttggtcatgatatacaggcggcggcaccgatgcctatcacatcaccgggaaacgatgacgacaccggggaaaaccatcagcccacactacggaaaaacactgccgaacctgtcgaacaaacattgaagcaaaacacaggtgctcgcggatgtccttctggaacccgcggctcatgccgcaggtgacgagccgcacgcgcccaggcaccccgtcgtggtccatgaagtccccggcgaaccgttcgaccgtggtcgagtccctgcccggggtcacgtcggtcacgtcgtgctcgaccaggccggcgaccacggtgatgcagttgcggcccttgcggctggtcccgtcgacgccgatggcctccacgcccgtgtggtcctcgagtcccctcgcctcgtccacgtaatgcgagatgaaccgccacaggcgggtgtcggtctcgtccaactgcccggcgagcgtgctcaccggcaggtgccgggccatctccacggcccacgcctcgaacaggagcgtgaacccgctgccgggcctggcccacgggggcggacaccgtcctcaccccgtgcacgggacaggtgacgcggggcatggcggcgtggatgaacgccttgtactggaagaagttcaggtgtcgccacacgcgctccctcgtgtcatgcaccggacaggcgcccccccccggcagcccgtctcggggcaatggaagcgcacgccgggctcgaagccgatcatgatgtgcagtccccgcccgccgtcgcccgcgtccctgaaatccacggacccgaccttccaaggcccccgcaactgcaatgcggcggtgaacaggcaagaggtatccatgcctccaacccacccgccggcatcaccccacaccacaaccacccaccacaaacagcgaaaggcccaaattgttatcgtgcgatgatcgaccgcccctttatcggccgggttccgcacctttttcgcgctgacgaagctgctccgtttgccagcgcgaactgtgttctcatacggccatgcaccgctctgccccctcgaacgacaccgtttttgagggactggggcgctgcagggccgcatctttagttgtaagtacttacaattttagtgtgagcgttcacttttggaggggtggattccttttcgggaaggcaatcagtagaacgcgaatgttgttcacaggtcgtaagtctcttccccacatggcttcgccgggagcccgtcccgcaatcaaggacgggctttgcccgcagcttgtcggttcgcctatcggctcaccctcgcctacgaacagcccactgggctgttcgctatacggctcggcccgtcagaggggggagcttgatggccactcaggcgcgacgcttgcgctggagagtcagagcgataccggcgacagcaagcgccacggctacgccgctaagactaagcacagccgcaccggtcttggacaaaccaagattgttgcccgtcttatcgcccgcatcgacgctcgaaccgtcgctcggcttagtcgaatcgcccgagccatcgcctgaatcggaaccatcaatcttcactaacgcagcctgcgccttaaccaacgcgacggtcgtgtcatcgacgtccttctgcgtagcagtatcgtcggcatagaccttctcagcggaggtcagcatcgtggcaaacgccttccacgaggcggcggtgtagtcggacccgtgcagctgcttggcggacgcaagcgccttggacaaaccagacttatcgaccgcaaccgcatcgtcaaccacatgcaccgtaacggaaacgatcttgttcgccagctcctcggaagagctcatgtcgaacaccggcataccgtcggcagcccagtgcacgcggcgtacgaacatgtcgcggccggtggcattcacggagccgaggttcttcgtagcataagcatggaacacgtagatctggttgccgtcctcgtcctcgctccacatgccgtgaccggtgccgagctgcatctcgccattgaatggaccggacttctgaatcgggtagttgagcgccgtccagctggccgggtcggtcaggtcggagccggcggcatcagccacggccaaaccggtggtgtaggtcttgcctacgccggaaccggagaacatgaggtacagcttgccatcacgcatggtcacgttcggaccttcggctatggcggcgttccacgcatactccggggtgacgatgcgcaccggggagctggtcacatgggccgggtccttcggatccatcgtggcgatgtaggtggcgccgagctgctgccaggcgtagtaggacctgccgtcggcatcctggaaataggtcatgtcgagcgacatgcccactccgccggacgcggtggctgcgagctgcttgttaccgttgagcagcgaggcgtcattgcggtagatcggtgtcggcacagtccagttatcggggtcggtcgggtcgaggtcatgaccgtcggcatcctgcttgagctgcatgtacaccgacttgccgttggaccatgtgttgccgtatccggccatgaacagaatcgtgagcctaccatcaatctcatgaatttctggagcccagaagctgtgcatgatggcattaccctcggagtccttgtcgccagccttgagcagcgacacctccttgttgttgtagccgttcgactgaatcagggcattcgggttgcccggctcgtcggcgagaccggaaatcgtgtcggccatgcggaacggcatgtggggcgaaccatgctgccaagtgacatcaccttggatgtcgttggaagcgatcatcaggaacttggtttcggtgacttccttgccgtcgacctcatgcgtccactgccacttatacaccgatggatcggcgcggtcctcggcgaacggaatctggtattcggtctgcttgacggtgccggtgacagtgtaatcacccaccttcgtcagatctataccctcagtgttccatgaggaaatcggcagggagccggtagaaccgtcggagtaagtgaggtccacgttcttcggcagctgcgaggtcatctcatcaatcgaggaacctttctcgacggtgatgtcagtgagattgctcgtgccggtgttctcagagcggccgtaacgggtgttgagcgccttgacggtcgcctcgtccaccgcgatggtggcaccggagcggaagttcgcgatgccctgcacgccgtcggcatcgagtacgccggacttggcgatggaaccgtacagtacgctgccatgcttggacgcggagcccttgagcgaatcgaacgtggtgtacttggccacgccgttgtcatcggcccagccgacaacatactgcttgctggcggtgtcgtacacggcgtacggagcgttgacgccgttggtctcgccaaggtcgacgatggaaccggagtcctcctgttcgctataggtgagcaggtcttcggaggtggcgatgagcacgctggacttcgcggtggagtcaccggtggcggtgccgcggttggtacgcacggaaatcacgccataggtgccgtcggccatgcggagcaggctcggatccttgagactgcggtaatcattgccgtcgaggttctcgttgagattctgcgccttcggcgaacgtgcgaagaagataccgtaattctcgttgtacggggtgtacgaaccgtcagcgttctgcaacgcgaggtgcatgctgtaggcgatgtcgccgttgttggcctcgtcggcgctggtggcgttgcaatcataggcggcgatggtcgcggacttcgcgtcgggcagcacctttacggtgaagaccttggtaatgggctcgatgccggcgagaccgttcttggagaactcgacggtgatggtaccggtcgtggcctcgtcgccatcgatggtgatcttgccatcctcgacggctacgtccttagtggacgtaaccgtgacggtagtgccattcacagccgccgggagggcgtctccggaacgcacgacggacgggatcacgtagccggccgcggcttccttgagctgttcagcggcagttttcgtggtcgggttgactgtgaccgtgaattccttcgtagcggtctggccacggatcgtgacggcggcggtcagcgtgacagtcttggctgcctcgcccttggcgggctggttgactgtgccgtcagtcgcgatgacgctgctatcggaggacgcccacgtcacgccgttcgcagtgggcaacgaaatgaacggatcgtcgaccgtcgtggggatggtgatgccattcagcacggaaccggtgagttcactggcatgaattgaggcatcggcagtgctgattgcagcgatctgactggcggtgagcgcggcatcgtatacgcggaagttcgagaccgcacccttgaacaggttgtcgggccacggcgaacgtgcgatggcattgagcgactggtccttgacgctggacagtttggccggcacggtgccggatgccacctgcgtgccgtcgatgtacagtttcgcggcggcgccatcaatggtggcggtcaccgacaaccattggtcggccttggccacgcaggagctggactgcacgagcgtctccgtaccgcccgatttcaggccgacgagcgggttacgcgaactgccgcagttgagcgtggcgaagaaatactccgtatcggagctgtcgttaccgatgttccacaggaaatggaaagcattgagcatgctggaatccgctttgacctccaactgcaccgtggcggcgtccttgccgggcagcagattcgagggcaacttgacccagtcgccggaaccagtcttggcaccgccggaaagggtaagagcgctatcggcccagagcgagtcggcggagttctgcacttcggccgcgccaagcgtagcgttcggcgcactgttggccacggtcttgccgtcacttggcttcgtggtgaagtcgtaggcggcgatgagattatcggtcggaacggtatcggccgcgaccgccgtggtcgcaccgattcccatgccggcaagcgccatcggcactgccagcatcacaccgagcaggcgcttgcctatcgatggtttggttgtcattgcttctccttcttgcgcgcggtgatactgcttgccgcgcaacagatctagatgttgagtggtgaagttcggtaatggctattggagctatggggccataaagcttatgcgtctgacagcgtcgtcggacgaacgtgcaatacgccccctctgatgggaccgcaccatgaagcaaacaatccagtaggctgcttgctatacggctcggcccgtcagagggggcttggtctacgctgcaagcagctcaggcctggcgcttgcggagggtgtaggcggcgccggcggcgacgagcagtgtgaccgcggtgatacccacaccgaataccgaggcgccggtgttggacagagcgctgtccggcttggaggcgggcttttgggcaccgtcgtccttgccgtcggtcttgccggagtcgccggacttcttgaccagcttgtcggcggcggactggagctgcgacagcgccttgtccacttcctgctggtcggtggagctctgcaacacctgctgcgcgtcggcaagcgcggcggcgaaagcatcccaaccagactggtaatcagccttgttatagcccttcaccttatcgacaagcgcctgcaacttggacttgtccagcgtggagccgggctcgccggccttgatggtgaacgttgccgaagcagtaccggagtacttgccagcgccggttacggtcactgtggcggtgccgggttcgacgttgttcgtgtaggccaccgtgtagtcggcgccttccttgagcgtcgcgccatcgagcgtaacggttacggccggttccttggcagcaccgtctgcggtgaactcgttggggtcggccgtgacgaccgccccggagatgtcagtgccagtcacggtgacggtcgcctcgaccggcatacgggaatcgtcctgggcgacgcccttgacggtgaaagtgccggtcttggcataggaagctgcgtcaatggcatcccactcaactgcaacgtcagaaacggaaccgtccgcatgagtcagatgcgcggtttccggcagcgtcggcgccacaccaaccgtcgtctcggcagacagcgcgtcaacggacttcacagccgcagccggagcgtacgcctccagcaccttctgatactgggcgcgggtcacgggcagcacagtgccgtgacgcggcttgccgccatcggaattggtcgggaagttcgcctcaggcatcttattgccgataacggtccactgaccgctggcgatatcctcagtcgccatcggcacatagtggtttggaccttgatgatagctcggctgatcggcgaacaggtagtactggtagccgttcacatcgccatcgttggccttgaatagcgatggaccttcgccggaagtgaaggttttaccgtaaccgttagcctggcctttaccgaggttcgtggcaacttcgctccatgcactacccttaagcgcatcggcgtagttcttcacgccggcaccaccaattgcggcagtcaaatctgtggacttctcctgacgcaaagacatcgtgttttcatctttgtagatgcggtagtaggtatcccctaccttttgcacggtcacatcgatggatccactgcctgcaccgcctcggcgatcaacgtcaatccacactaccgggtcggagaagttgacgaagtcatcggtggtgacgtacaccatgcggttgtaggtcagctgcttgcggctgttctcgtcggtgttgtcgtacaggttcgaggcccaatagaccacgtacttgccgatttcctcgtcgtagtaggcctcaggcgcccaagtgttgcctgcgtaatcagagctcaccttgacgtggctttgcctggaccagttgaccagatcgtcggacttccaaatctcaatgtacttggaaccgttagcctgtgcaccagcaaagccattcagcccgttgaggggggcacgaccgtcaatcttcagatcggtagcaagcatgtagaacttgtcaccatccttggacttcatgatgaacggatcgcgcaaacccttctcgccaaactcggaagtgaacagcggagtgccattgttcagcgtgttccagtcgagcgcatcgttgcccttggaagccgcgaggctgattttctcgccgcccacgccctcgccggtgaagaacgcccacacgtaggcctcgtccttctcttcggcggcaggcatcggctgaatggtgacggtgaaggtcttcgtttcggtggcggtaccgtacttggcagtggctttgagcgtcacagtggcggcatcgcttccggcggcagggcgcttaacagtgaccgttcgagatttgtcgttcacgccttcgcctagtgtggcgatatccttgtcaccggtcacttcccacgagatggtcgaaccattgttgcccttggtgggcacggagaagttgctacggatgtcgtcggagtcctcgatggtgacggcgtcaaggtcggccttggcttgctcggcatcggagaactgcttcggcacgaggaccgtgtaggcggcggttttggcgttgttgccgaacgtggcggtgagggttacctcggcatcagctgcggttgcggccggacgagtgactgtggccttgccggtagcgttgtcaacggcgatggctgcgttgcccgacttccacgcaatgctcacgccagcggcgctggtcggcagcgcgaagtcctcggtagcggatgcgggcacagcggccttgacagcggcctcggccttgtcgagcacctgagcgtcatacagcttggtcacgtctgcggcgctgatggcagtgtcgtatacggcgtaatcgtccacgtcgagcttggagttcgggtcagcgtaggaggacttgccaatgtaggcgacgaggtcgccgtaattggtcaggccaccggccggaatggtgtaggtggcgtctccaacctgcttgccgttgaggtagaagctcatggtgctgttggtgccgctgatgacggtggtgtacagagccaaatcgctggtggccttggtgccgatggtggcggcgttcgtcgatccagggccgacttcggtgccccacgggctgttattcgggtcggccgcagtggcattggtcattacggatttcgcgtagccactcgggttggccgggttgagcagccagtagccgttggccggataattgccggtcttggccgcgccgatgtacgcggcggcggtattgccgttgccgtaattgttcttgagccagatggagacggtaacgtccttcttaccggcgatggccgtggtcggcacgctaatggtttgcgagccggtcaggttgatctggccattggccaccgtggcgtcgccggatagggtggcatcgctgttggccgcgctgccctcgttggcgatggtcttggacgtcagtgcgttatcgaatgaatagtggatgatcggactggcgtcgattggcgatgcgctctcggcactggccgtcatcggcagcaccagaccagcgagcagtgttgccacgccgaccgtaagtccggttgcctttcgtatcagctttctcatgtttctcctcattgatagggttgattgtggttgcgcctccagttatgaggcacagttttgaaattgttcaagttatggtgatactaggtgcttcctctccgtccgtcagaagccgactgagaggaagcatttgaatccgctcaagcgcggcgcttgcgccagatagtgagggagatgccggcgacggcgagcgccaccacggcaccaccaaggctgagcacggctgcaccagtctcggacaggtcagcgccgggcttgtcgcccttgttgtcgcccttgtcaggatccttgccggtgttcttgtcaccgttatccttgccggaatcaggatcggtcgggtcttcagggtcaggagcgacggccttcttggtgagcacgaccctgtagaccttgacggtcgtgccatcctgcgtggtcacggtcaccgtcaccacgttgtttgccacggccacagtggccttggcgttggcatcgtttgccacagcctgcacatcggcatcggtcaccttgctcggatcgtcgacttcaagcgcggcaccctcagtagaggcagccgtgtcgaggtcgatatcggaaccgacaacgttcagcgacttcagcgtggcatcagaagacacctggtcctcggtcaccacgaccttcagcgtcacgtttttcttcgactggtcgagctcctcgctagtggtcatgtcgataatcggcgtgccatcggcacggaagtgcaccggaacaacaccggcatggcgagccgtgttgttggtgccactggtcatcgcgtgatacacgttgtacgtatcaccgtacgggtcagtgaagtaggagttgtggcccaagccaaactgaccggcgaaagtaccgttgtgcaaccacgggtagttggacttcgtccagctggccggatcggtcaagtcgtcaccgacatttgcgatgagcataccggtggcatactgcggagtgaccagctgcgcggagaacaccatgtacaccttgccgccggagacgaggacgttcgggccctcattcacgccgtccagctcccaaccccattcggggcgcatgagacgctgcggctcggtgatggcctgccacggcttgtccgagttgacctcggcaatggacacgttggccttggcacccttacgctcctgatcgccttggctccaagcaatgtacgacttgccgccagcctcgaagtaggtcatgtcgatggacagaccgtgcggggacagcacgccgccatccttggcctgcacgcgatgctcaagccagtcggcggtcttggtgggatcgccgccatccttgagctccatcacgtaagcagatggaccggcccagttgggagaattagtgatgttttcatcaccagccttaccggccgggaaggtagcgtagaagcagtatagcttgccgttgataacgtgcagctcaggtgcccagtggtaacccttgtgccccaaaccatcgttctcgccaaacaggtacacatcctgaccttcgaccttgtagccgccttcagttgcggtgccggccttctgatccttcagcccggcgagcgtatcggaggatcggatgaacagtgtcttcataccgccggtgtcggaggtgcccatggcgtagtacttaccgttgtagtacacgatgttcggatcggcgcggttgctcatcatcgggaactgctcggagtagttctgctggttgatggtgccgctgatttcgtaagtaccggcctcggtcaggtcgatcttgttcagatcgtcctgattccagttgacgcggaagtcgaaggtggagccatcggagtaagtggcggttgccgtggcacccttggagaggttgccgttgtcgagctctgcgccgccgttgatctgcgcgagcaggtcatccttggtggtcttgttggcctgcacggtgatgtctgtcgggacttccacaccagtgttgtgcacgcggccaagcctctcggtcaggctgtcagcaacatccttggtaagcgcgatggcgttgccgctaccagcaaccgcattatcgataccggtcaagtcagcttgcgcgcgctcgaagcctacgccgttcttgacttcagagaaggtcttaaagtccttggtcgtcacgtacttggcaacgccgttcaccttccacgagatacggtattcgcctgcggaagcgtcgtatccagctgcgatggaaccggcatcaaacagagtagcgtcagaggtgaccgtaaccatgtcgccacgctcgtcctcattcggcttgccggaccagtccgtcagattgctggaggtagagaaagcaacctggccgccatctacgcgattgccgttcacatcagtgaacactgccacataggcgtacttgccatccttcaactggaacaagtacgggtctacgagaccacgaacttcagtggattcagtgtttgcggttgcgttgatcttcgcctcggcaaaagccacaccgtagttggtgttgagcgcagtggtcgtagtgccgttgttcagcgccagatgcaaggcattgcccacgcgggagccaccgttgatggacctgtcgcgagtgtaggaggagagcttctgggcgctcttcggcataacgcgcacgccggtgaacttctttgtggtgctggtggtgccgagcgtaaccgtcgcagtaaggtcgacggtcttctcagcgtcgccgtttgtgccaacgactgtgccatcgtctttgacgaggctcgtgtcggaggacttccacgtcaccttcgcatcaggggccgcagcaattgcagtcggcagcgttgcgccggcagtgagctggtagtcaaccagcagtcgttcggcggctgcgtcggcggtggtgatggccgcagccacgttcaccgtgaatgtcttcgtgtattcgatgccgttgaccgtggacttggcggtgaacgtcacatcggtgtcttgggccggggctttgacgagtgtgccgtcgttgccgagcactgcggtgttggacgaagaccatgtgatcgtgttgccgagcgcatctttggcaggcagagtcacgctgccttcggtggagccgggcagggtcacgccatcccacaccatgccgtcggaggcgtaggcagccttccaaatcttgatgttatcaagaccgccgttgtagtacttgtcgccggcccatgtggacttgccgaagttcatcggcaggtcggtgccgagctcggagagcttcgtggtcacgttcttgttgatggcggcaaggttgccgtcgatgaacgtggcgatgaaggtcgggctcacggaaatgcggtacgtgtgccacacgttcgcggactgcgtagcggtcacgccctgctcgttaccgttggaggccttggtgatggcagtgtacacgctggttgggcgcagacgggagaagaagtacttctggttgtcggagccgatggtgaacgagaagaagttgtcgttcgcagccatgcgggacttcgagtcgaactgcacggtgaaggagtcggtgccattgagcagaccgttcggcagttcgaggtattgaccatcgttgcctcgcaactggatggcgttgccgcctgactgatggtctccgggtacgccgtattcgacattctcgcccttgacggtcaggtcgttattgttgccggagatgtcctttcctttatcgttggcatcctcaaaatcgtaggatgcgacgagattagcgtccgtcagacctccgtcgttgtctgccgccatcgcggtgactggtcctaaggccagtcccgcaatcatgaccggtagcgccgctaccgccgctaccgttttcttccacttgcccatatatttctcctcattgaatggtggggtggctgagttggttgttaagttgtgaagtgtgtttattgggaaaccacgtttgttgggctcctctcagtccatctgaggcggactgaggggagctatgcagactaggcctgctcagtccttgcgcttgcgccaggcttccagaccggcaccagctgcggtgagagcgaccatggctgtgccgagggctagcacggcggcaccagaggacggcagaccggagtctgctcccgtaccagcgttaccgttatcgctgcctgcaccatcgccggaaccgtcgcccgaaccgggcttaccgggctcggtcttggcactcacggtcaccacgaacgacgtggtgagctgatcgttggccttgagcgtgacggtgacggtcttggtgcccacagcggacatgtccacgtcgccgaccgtgtagtcggcggcatcgagcgtcttcaccgtgccgtccgacatcgtcgcctcgatcacaagaccatcggcggagaactgctcgcccaccgtgtacttggtctttgtcggctcgctcttgacgcggatgccggtgatggacggctcaaccggcgtatcgggctcgccgacggtcaccgtaatggtcaccgtgcggttggccggagcaacctcctgatccttggtcagcgacatgtcgagcatgccgttggcgcgcacgttcacggccttggcccacgtattgcggtcctgatcgaacaggccacccgctgcggaaccggagtgaatttccgggtaggggcgtgcgtggtaggccatgacgatgttgccggcctcatcatgtgcaagcgagatgtggccggggccggcctgcttgcgctcgtacgaggcctcatccgcaccgtaggcaccggtgtaggtgtcattggtgtcgaacgacgggaagtcggccgtggtccagctcgacagatcctgcaggtcggcattcttggcggcacgcatcacgttggtgttgtaatacttatccaccgtggcacccgcataggcaatgtagacgtagtcgccatgttcgaacatgaacggtgcctctacgattgcctgatcagaaccttcagagttgtctccgggggtaggcgcatacttgccgtactcgaactgctggctgacctgatagatgtgctcaaggctgccatccaccagcggagtgacgccatcgcccatctttgccttggcaaggtacagtcctgcgctcttcgggaagagccagtagccctgggccttgccgttctcctcgcgctcgaagtacgtcacgtcgaatgcggcgccttccagcacggtcggctcgccccagttttcggcctcgaggaatccgccatccttgatggaccgctcgtcgccggtgtacgggatgaggatggtgttgttgcaccagccaccgttcgtggacgaggcacccctgtggaagccggccacaatccaccacttgccgttaatcttgtggaactcctgggcccaaatgaacgcgctccaaccgtagaacgagttggggtactggtcttcgtggcccggagtgccgttctccggcttgatgatgatgtgttcctcagcatccttcagaccgttgatggtcttggcgcgcttgaggccgatggaacggtagctgtccttctggttgttggtcgaatcagtggactttacctcataggtggaaccggtgaggtagtagtagccatcgtcttcgttgtagaagatgtccggatcggcgcgagcgtcgttgtacatggcctcggtggtctgctgaacagtgcccttgacctcatacgtgccggcctttgaggtgtccacggcggccagatcatcggcgttccagtcgacgttgaaggtcttcgtggagccgtcgttgtaggtcattgtggcctgcgttccggaaaccgctgcggtgacgtcctcggcggaagcaccgttctccacggttgcgccgcccagagctttaacgccggtgttctgcagatcgacatagttcttgtagaacgcatcgaattcagaggagctcacagcgaatgcgcgggtctggccttcgccggcccatgcgggcagaccttcggtcacgtcgcccacacccatcgcaaccgcgtcggccttgagcgtctcgccgaccgttgccttggcagtcaggtcggagagcgtggccatacggccttcgccgctcaggccatcggtccagaagaccttgtagcccttggaggcggcatcatagacgatgcgcgggttggtgaccatggagctgtcggtcacggtgatggcgcgctcgttggtgaacgtggcaccgtcgcccttgccatcccacacgtaaatcgcaccggtggcgttgttctgcgaggaaaccacaccaagggtaccgtcctccgcacggaagaaagcgggtgagcccatctgcgcattcagcttggcagactgcgagccgtcccacttgaccgacagaatcgactgcgaacggttcaggggctcccatttgccgccatcggcggccttggcggccacgtacagcgagtcggcgcgacgatcgtcgttgtaggcgagcgggtcgtacttggcaccgttctggtcggagcgatcgacatccttgacgtaggaagcgatttcgccgccgttgttgaggatttcggattcggcggtgatagctttatccacgccgtcgatggtggcggtgagcttgacctttacggccttctcgccggacttcggctgcgtgaccttgccgtctgcggctacgagcttcgcaccgtcgccggtcgcggaccaagtaaccgtcttgcccagcacagtgctcggcaggtcgccggtgatttgcgctgggatggcgagcgcagcggcgtagtcggtcttcgcgctttccacgccaagctcgtcgtcgctcagggccttgccccagatcttgaggttgtcgagcagaccggagaagtactcgccgttgctccagttggccttgccgatctgcagcacgccgccatcagcaccgaggatgtcggtgagcttctggccgttgttgttcacggctaccagcttggagtcgatgtacagcttagcggttgcgccggaaatcacgatatcgacgtgcttccagtcggcgttcgtcttggtataggagacgttgccggaggaatcgcgcttgccatcgttgttgttgtagcgttcgacggtaataccggtggtcttgtcgagcacgccgacgtagtgctcctggccgtactcttgcttggtggcgttggaggcggcgaagaaggtccagccggtgttgccggaggcgtcgggcttgacatcgtagctgatggtcacgtcgttcttgcccttgagcagagcgtcgccgttcttggcggtgacgttgagccagaagttcttgctgagcttcgcggccttgccatccttgccgtcggcgagcgtggcggtgccctgagtggcacccgtcgcattgccgccgtcgaaggtctcgccggcgttctcgaaagtgaagtcggcgagcaaatccgggtcggtcggctcggtttcgccggtcacggtcaccttggcggtcacagtgatggcggtggagctgtatagcgtgcggttcttgttggcggtttcgttgtcgacaaaaccaccggtctgcttccagttgttgttcgcgttcgcaccggtgttgatgaggtcgtcctcgtcggtcttcgactcgccggcggcgttcgtccacttccagtggttcttgttcgcgccgatggtgtcgaccgtgccggtgacggcgtactcgccgggcttggaggcgtcgacgttagaaacgtcccacgtcacgtcgcgcttggcagtgccgtaaccgttggcaagagtgacctgctgcgtcttcggcagcttggcagtgatgtccgtatcggcagaacccttatccaccgtcacatcctcggccttcaggtcggcgttgtcggaagccttggcatcagccgcgcgaatcgcgtcgtactgggccttggtgagcgaaacaatgtcaccgtgcttggtgttggcggtgaggaagtagtcgtcggccttcaggacgctccacggattctcggaatcgaggttgtcggcttcgagtaggttgtagccgtagcgggcaccggaggcgacagatccatagttgtcaacgaacatgtaccacttgttttcaccgttgaccttgaaaccgttggcaccttcctgcgcgctgccgagcgtgtgtccgatgttggtctggcgcaacacccagcccttggccgggtcggtcgcgtactgaccctgatcgttggcacgccaccaatcggcacgatcggtgtattccatgaagatcacgccggagccggtggtgcggtatgtgcgggaaccgttctgcagcatcgtggtgtcgatggtgttgccacggttgtacttgctgttaggcacgaagacgccgccaaacatgtaagtctcgttggtgaagtccttggtggcggcccacagcacgtgagtcaccttcttgccgggctgactgttctcgccatcgtatttggcggagacagaccaatacacaacgaatgcgccgccctgctggttcttcgggttgtccttatcggaaccgttgagctggccgtcgtcgttgagatcatagaagttcggcacccacgtagcctcaggagcccatgccatgccgatctcggagatggtattgccggtcacggaatcggtgagcgtctggctcttgttcggattggcagtgtacttgtcggcggtggcggtctccagttccgtcatgtcgttgaagtgaatgagatctttggacgaccacacatgcaacttggtgctgtaacctgtagcccacgtgccccaaccggcattatcgctgccgaacacacgcaaatcggtggccagcacgtagtaggtcttcgactcggggttgtaggcgatgaacggatcgcgcacgccggtggtggattcgttactcaccagaatcggctcgccgccgttgagcgtatcccactgggtggcgtcatcgccgcgcgagatgtcgaggtagatcttctcggcgtagcccttgttgttttcgatgaagtggaccatcacgtagccgtaggcgtcatcggccttgacctcggtgacggtgaccttgagctcggcggtcttggcggcgtcagcttcggaagccgctgtaatggtggcggtgccggccttcacgccggtgaccttgccgttggcatccacagtagccacagccggattattggattcccatgtcaccgtaggctcagcgccttcaggggtgacggttgcggacagggatgcggagttgccttccttgagactcagcttgccgtccttcacattggaaccggagatctcgattgcagtaggcgatgcgatgccgagatcggccgcggaaagtgcggagccataaatcgtgagattgtcgagcaaaccggtgaagtattcaccgttgccccagttgcctttgccgatttgcagcacgccgcctgagccgccaagaatgctcttgagatcctcgccgttcacgttgctcgccacgaacttcttatcgacatagagcttcgcggtcttgccggagatgacgagatcgacatgcttccaagcatccttcgtaccggtgttcttgtcgatggtggcgatgtcggatgcgcggccgttgagatagcgttccacgcgggtcttgtcggtgcggtcgagcacaccgacgtaggtgggggcgctgccgttcaccgcaccggcggtcggcgcggcaaacacagtccactggccaccggtcgcagccgccttactgtcatagctgatcgtcacatcatcaagaccgttgagcagtgcactgccatcggacttggtcacgttcagccagaaaccgctgccgagctgggcggccttgccgttgtcgtcatcttttccgttgatgagattcgccgtgccttgtacggtggccttagcgtcaccctgagcactggcgaatgcaccatcgtccgggtcgctattgaaatcgaagccggcaagcgggtctacagccgcagcagcctgagcatcgctcgtctgaacggattgctgcacctgaggtgtcgtatcgtcagccaacgcggtgaccggcgtaaccagtcccacgctcagcgttgataccgcagccaagcaggccgtcaatcgagtaactctcctcatcgagtttccttcctcgcatccttgctagattgttatcaaattgttatcgctatggcgcttggccactcctttatcggccacttttgcgtctccttgtacgaatcagcacttcctcgtttgctgattcgcattacatttgactgcgcttgcccaccaatccgcccctacgaacaacaccgttttccggggacaacatcgatgcgctatagcacgcccaaatgtaagcacttataagtttagtgttagcgttcactggtacggtacacaggttctacagcacatacatttagcatgaccacaccaatgcaataaaaaaaatgacgcatgtgctgttatacattaaaacgcacagaaaatcacacatatactgtgcgattttctgtgcgttgcagtgagcagctactcagttatgcgcggcgcttgcgccagatggacagcgcaatgccggcagcggcgagcagcaccatggcaccgttcacgccatatacggcggcaccggtggccggcaacttgccgtcagacttggtgtcatcggtcttgttgtcggtcttgtcgcctgcgttatcgcccttgttgtcaccatcgccggtatccggcttggtgggcgtttccgccttctgcaatgctgcgatggcggcgctcagatcagcggcggccttgtcaaccacagcctggtcggaggaagcgagcgcagccttggcggcctgcagtgccttggcgagcgcagcccaggaatcagccgtgtaatcggattccttgagcgcttcggcagcggcgatctgcttgttgagctcagccaaatcgaccttgccctgctcgatgccggccacctcggtcgaggaggggtttaccaagccatcggtgtagccgtcgtaggcgaccgcaacagtgccagagatggtgaccgggagagtcaccgtgaccttgccttcggcgtcgagcttcacggtcttggaccagtcgccagcagagaatttcaccgagccggcgagcgtgcccttgtcagcggcggtcaccgtggcggtgagttcgcgggtttcggcgttgtactcggccttggtagcggagtcaacagcgggcagcgtggtcggggtggaggtattccacttgtgcatgttctccgcgatggcagcggacacgttcacgaacgcgccgtggcgggtcggagtcggcatgttggtcggggtcaccttacccgtgacattcggcccccactgcttctcggtaccccagccgtcggtggaggacagacggttggtccagctggacgccgcgatggcggactcggaggtcatgtacggcttgtatccgccggagtcggccatgatgatcatcgcatcgccagcctcattctggttcgggtcgccagcattgagtttgatggactccgggccttcgaacggcaggatgttctggtcaacgagctgccaggtcttggtcgtatcggcgttcggatcagcggcggcggtggtgcaagtcaggcactgggaacgctcaaggaacgtggacttgccgttggtgatgtaatcgccggccttgccgctttcctcgttcttggtcaggcgatagtacatatcgccaatcttgaacacggtggaatcaatgcgggagtactgggtatcctgccacttctcggccggagtgaacgtcttgaagtcgcgggtggtggccatcacaaggatgttgtatgcgccgttggtcttcgagctcttcactgcggtggcacgggtgtcatcggtgtattcacgcgaggaccagaacaccacataggagttcagcgcgtcatcccagaaagcttccggtgcccaagtcatgcccatgttgtcggcgttgaccttgataccggtgtcgccgtcctcggcgttggtgcgagtccagttcaccatatcggtggactcccatgcttcaagcttcagagagccatactgttggttctggccccagccctgcgaggagaccttgaggtcggtggcgatcatgtagaacttgtcgccatccttggacttgagcacatacgggtcacgcaggcccttggtatcggtgttggagacgataaccgggttgccgctgttaatctcgctgaacgagaagaagttgttgccgtcggtggcggactcgtacagcgcctcaccgatcttgccgttggtggtggccgcatcggaaaggaaggtcacggccgcataagcgccgtccggaacggagcgggtttgctccttgacagtgacttccacggtcttggtcacgacctcgccaccgttgtaggaggcagtggcggtcagtgtgacaggcttggaatcaccgtcgccgtaagccgggcgagtcaccacgccggcacccttatacggatcggccataccgttcttcggagcctcgtacttggcgtcagtgccggtaatgagcttttcatcagaggacttccacgtaatcgcagaaccattcttggtgccttcggcaactagcggcaggttctcggtggtggtggtcttcaacgcggaaatcgcggcgttgaggtcggcttcggcagcgttcttggcgttcatcggctcaacggtgacgggcagttcggccttcacaccacccagctcagtggtggcggtgatggtggcagtaccagccttaacgccggttacagtaccgtctgcggcgaccttggccacggactcatcggaggaggaccaggtgacgttcttgctcacggcgtcgtccggggtgacggtggcggtgagcttggtggagtccttctcaatcagggtgagcttgttgttcaccacaccggtgccggaaatcgcaacggcggtcggcatggtcaggtcagcgcccctgtagaccttgatgtcatccattgcaccattccagtactcatcgacggagtagaacgacttgccgatgtaggcggtggtcgcgccgagatcgctcatcttgatgccggtgttggccttgaaaataatcagggcattgttgcggaacacggcaaggttggtgccgtccacgacaatcttgtaatcggcccagctgttgccgttgccggaaacggtgaccttggatccctgttcgttaccccagttgttgttggagataacgcccttgatggcggtcttgctgttgtagaacatcaggtacttgttggcgttggactgatcggtggtgttggcgtcgttcgagccgtccttgccgacgatgaacgagaagaacttgccgctgtcgtcgtgacgagtcttggacgcgaactccagagtgaaggagtcgccggcgtccttgaacagctggtcatcgatctgggcgtactggccatcgccgcgcagtgagagcgcctcgttgttgctgcggtcaccgtactgttcgatcttggcgttgtctttcagcgtcaggttgtacttgccggtcgaatcggcaatcatgctgttcgtggtgccgtttttgcccgtgaagtcccagctggcgagcagcgtcggttcagcagccttagtagtctgcactgtcgcggtatcggttgtctgtggttgggaatcttccgattccatggcatacgtcgtcggaactactgccaccatcgttgatattgcaatcaacgatgctgccatcttcttccaatgcttcaccgcatctctccttgtcctttgcctcgacccacttgtcgagtgtctcgttcgcctctacgtgaacgcaaacattatttgcgatgataccattacggcactgagactcagtgtgccagattccttatgtatataagcacttacgggggggcaaccgcccagcccgaacactccccgtatgccaaaagcccccttccaagccaatcactaatacccctcaatcggcaccccgctccgccagccgccccaaactgttattaatttgttatctttaccgcgcttgcgtggacagagaacgctcagacctcgaagatcgccgcatattcgtgagaacccgcctagtcaatgagatatggcttgaagacacgctcggcgacggggatatggagcatcagcatggtgccgtaaccaaggatcaccagcaggaacagtccaccgggcatgtggaaccagctggccaccagcagcgccacgaacacggcatccacgatgaccagggccacggtcatcgcgatgtgggagatgccgaagatgaaggcgttcttcaaggtgccggccacggtgttctcgaagcgtgcctgaagcgcgaacacccattcgaagccgataagccagaggatggtcagcgcgaatttgatgatgagcagcggcgtgatctgcaggacgatccatgaccagaccagtgcaatcagcaccaccaagaacggcagccacagcagtgtggctttgatgaagttggctttgaatgacttgaagtagttggaggttacgcctttgccctcgccctcgatggagcggcggcaagcatcatggccggcagtcagggccgcaccgatggtgatgatcggaatcgaagtgaccagcatcagaatgttgatccatacgccgtcaacaagattgctccacgcgcgcatgaatttcgagtccggtgccagccagttcatcaactactccttgtacagcttttggctcccctcagggaggggagccaaattgtcgggctcaacccttgaccgcgcccgccatgacaccagagactatatacttctggcataccaagtagaagacgatgatggggatgatggccagcaccaggcaggccatcatggctcccatatccacggaaccgtagccgcccttgaggtattgcacggcgaccgagatggtcttgtacttgccgaggtcgagcgtcaggtacggcagcaggtaatcgttccagatccacatggcttcgaggatggccaccgagacgatcgacggcttcatgatcggcaccacgatctggaagaagatgcgcggcactgacgcgccgtcgatcatggcggactcctcaagctcctgcgggatgcccttgatcacgccggtgaagatgaacacggccagaccggccccgaaaccgaggtacacgatgcacaggccccacggggtattgagcttcagcatgtcggcgatcttggagagggtgaacatcaccatctggaacggcacgatcatattgaacaggaacagggtgtagagcagcttcgcggcccagttgttcacgcgcacgatccaccatgcgcacatcgcggtgcacaccagaatcagcgccaccgagccgacggtgataagcagcgtccagccgaaggaagcgaagaactgcgtggtctcgatgccgcgcacatagttctcaagtcctacaaacgctttgccggtcggcagggagaaggcgttcttggagatgtacgccttctgcttgaaggagttgatcagcaccaggacgatcgggaaaatccagaacagggagacaacggcaaacagcacggtccataatgcgccatgcttcacaggcttgttctcgttcatcaggctgccacctccttgctcgtggtgagcttgttctgaatcagggcgatgaccgcgaccaggatgaagaacagcacggccttcgcctggccgacgccttcccagcccatacggccgtagaaggtgcgggtgatgttcagcgccagaccttcagacatgttgctcggcgcaccgttggtcaatgcgaggttctggtcgtagagcttgaaaccgttggtcacggtcaggaaggagcacacggtgatggacggcatcatcagcgggatgatgatgcggaacatggtctgccgtccgttggcgccgtccacggccgcggcctccagcacatcggtgggcagggcctgcaggccggcgatgtagatgatcatcatgtagccgatctgctgccagcacaccaggatgaccaagccccagaacccgtaggacgccttataggtcagggcgcggccccagtgggccagtacgccgttcaggagcagcagccagatgtagcccaggatgatgccgccgataaggttcggcatgaagaataccgagcggaacagcgtggagcccttgatcgccttggtcagcatgtaggcgatggcgaaggcgatcacgttgatcacgatggtggtcacgatggtaaacgcggtggagaagccgagcgcgtgcaggaattccttgtctttcaacgctttgccgtagttcttaagccccacccattcaccgtcggtaacggtggtgaattcgcagaagcttaagtagacgcccatgatgaagggcaccaggaacccgatgatgaatgcggcgaatgtggggagcgcgaacagcgcccaccacctgcgtatcgccttgcccgccatgctgatcatgacttttcctcctccttgagtccgctgcgttgtgacactgcatcgtgcgccggctgcggagttcaactcaatgcgagcttgccgatcgagaaccgcatgcacggcctgttctcgttcaagcctatgttcatagtaaacgtcgaatcattatatgtcaaacgttgtcattttaggcgtttcaagttcgagcacactccggctccagcaatcttctttcacctaagataatggccatataaagccaatctaacgccgacatagacactttgcaaacgtttgtaatacaatcgttgtcatcgccgcagatcaatcaatcagcatgtacactggagtcagttgtgcatgtgtattgcgattttccattcaacgcaagggggctgcaatggctacgagcattcaggatgtcgcccgcgaggccggcgtctccatctccaccgtctcacgttccttcaccaggccggatctggtgtcggccaagacccgcgagcgcgtgctcgccatcgccgacaaactcaatttctcactctcccgctcggctgcggccctgaaatccggccgctccctgcgcatcgcagtactgatgagcggccatatccgcctgtggttcaccgcctcggtcatcgaggggctcaacgaggtgctgcacacgcagggctacgatatttcggtattccagatttccagcatcgaggagcgcaaggaattcttcgagatgttgccggtacgccgtaacgccgatgccgtgattgtggcgtctttcgatatcgacaacaacgaaatcgcgcaactggcttcggtcggcgtgccgatcgtcggcatcaattcagtcgaacccgaagcccgcggctttaccgccgccgtcaatatcgacgacgtgcagggctccacgctggccgcccgccatcttatcaatctcggacatcgccgcatcacctacatcagcaccaatcgcgaggtgtcgctgagcttctccgtgcaaagccgattcgactcattcaccgcctgctgccgcagggaaggcatcgagccgcaggttatcgtctgcaaggtcgatgacgatggacgttatgaaatcagcgacgtggtcaaccaactcataagccaagacgagatgcccaccgccatcgcatgccaagaggatggcattgctttgccgcttatgttccagctggagcgcaatggattctccgtgcccggcgacgtctcgttgatcggctacgacgatagtttctacaccggcgatatcggcctgaccaccatccgccaggatccggtggaaatggcccgcgtggcagcccgcatgacgctcgatctcattgacgaaaagccgattgagcaaccctacatcgtgttcccggcccagctgaaggtccgctcctccacctcccgcgttaagtaggctcacacaacaaagcccaccatggaaaaagtgtgaggcaaccgcacagtaacgctcaatcgcacattgtggagaatggcgaaaaatcgccgattcatggccccacagcgtgcgattgagcgggtgcgtgcctcacacttttctgcggcggacgattttgtgcgagactcagcaatacaaagcggcgcccctggagaaggaaaggcaggggcgccgcggattgttgcttatcggctatgggactctatgagactcagtgcgaggcctcgtattcggaagcccaaccgtccacgaaggcggtcttgacggcatcccacttgccggtgccctgcgcgtactcgagcagtgcctggccgaccttgttcttccactcttcggacggcatcatggtgaagttccaagaaacctgggtcatgccggacttctggtcttccacggcggcttcggtcagcgggttgtcaaacttgacgtcatcgaaggtcttgaacggggtggtgaagcccatgtcctgagagatggccttcttgccggtgtcggaggtgatcacccaggagaggaagtcctcggtggccttcttgtcggcgtcggaggccttgtcgttgatgcaccagtagttctcggaaccagtggccaagccctgcttctcttcacccttgacaccggtgtagattggcatcatgcccacggattcggccttcatgccggccttctgcaggtcggtccaagcccaggtgccgttctggtagaaggcggcctcgccgagcgcgaactcggagttcgcatcatcgccggtcttggcgctcagctgggtggggtcggtggtggagtcggtgatgtacaggtcgaagatcttcttgtagttcggcagataagtgcccttgatggtggccggctgctcggtgacgttgtcgtccttgaactcatagtagagcggcaggttggccagatgggtcttgaatcgccagtcggagctggagtcgaagccggcggaggtgaacgcgcccttgatgccgagctcgtccttgcgggcctgcatgtcgtcggccacggccttcagggtgtcgaagttgtcgatttcgtccatggacgtggctttggcaccatccagcgcgaagtatttgttaaggatgtccttgttgtagatcaggccgtaggtttccatcacgtacggcacaccgaccaccttgtcgccgtctttcagggccacgtcctggttggtgagttccttatacacatccgtgttggacatgtcggcggtgtacttcttccagttctggtagccgaccgggccgttcacctggaacagggtcggggcctcggtcttggcaatctcggacttcagggtctgctcgtaggtgccggaggccgcggtctggaccttgacatcaacgcccttctccttggtgtactccttggccagagcggcccactgatcagccgcttccggcttgaagttcaggtagtagaccttgcccttggcgtcatcgccggaggtcgagcttccgcaggccgccaaagtgccgagggacattgcagcgatggccgccactgcgaccgctgacttcactgtacgattcatcatcgaacctttctctttcatcgtcgacccggccatccccggtcaggacaggtacgctaacacgcacctttatgactatcgacatgcactattgtgcaacggtttgcttctttttgcaaacgatagcaatatcggcgcgtcataaatcatcattttcaggccattgtcaacaaatatcccattgattcggtcattttttcctcattatcgcaatgcaagcgttcgcaattatgagagcgctaacatatctttcatggcaatcgattgtcacttatgcccatcaaaaaaaacacggcgacgctatcgtttgcaaatcatttatcgacataccgcaattcccaccacaaacaataaaggcccgcccgcagcagcgggcaggccagcgtaatcacagcgcaaccggggctaggcgttccaccgttcgatgacgttatctcccttatagacgctgagcaccgagtagtgcgccgtatccaaacgcagcaaccgcgcgaaatgcgggtccacgcccagccattgcgaggtgaggatgcgcaggatgtgcgcatgagccaccaacagcacattatggccgtctttcagcagcggcgtaatctcatcgatggcgctcttggcgcgtaccgctgcttcttccagcgtctcgccaggcccggcatggaccggcacctgctcgcccgaaggtaaggtctcgacccaatcgccctccagcgtgggcgtcagcgagcgcggcccgtcacgccacacatcccattcaaaaccgctggcctcactcacctgctggcgcgtacgcccctcggctcggccataatcccattcagcgatgccgtccaacacaccgtggtccgcaaaaccggccagttcagcggtttggcacgcccgcttcagcggactggaaaacacacagccctgactgaatccttcggggaaagcttcgcgcaggcgccttccggcatccgctgcctgctgctcgccgaccgcggtcaacgggatgttcgtgcgcccggtatgctgcccggattcgctccacacggtctggccgtggcgcagcaacaccaaaaatccgttgccgccacgagagttctcgacggcaacggtgccgttcacgttctgttcgctcatgcctccactctagtctgcgctcgttcatgactccaccattaacgcccatcttttgcgctgagatgattgagatgctattagactgagagtcatgagcgacgaaacgaacaccgacttcccctccagcgccgaccgtgcggtcgacagcctgcaccgcatcgacgagaaggtcaacaggctgcgcgaggaccggctcaacgaccctgattctctgggcgacaagctcatcaagtcggtagtcccagcgctggcaggcttggttgccggcaaagcattccagatgatatgggacaagggcacgagcaaacgcaatctgcgcaagggactggcggcagacgcgccgcaaggtctggcaatgagtctggcattcgccgccgtttcggccgcactcggcgcagtggtttcgcagctgtcggatcggggctccaaggcgttcgtcgaccaccgccatcgcaagtccagccgctaatcccccggttggatgatggtttctgttggttgactgatggctcatcgctggaatttcgtcaaggaaccatcagccaatcgacaggaaccatcagtccagcacagttccgccacacaatatcggcatttcactgtgaggtaatccaccgtggcgtccggcgtctgccgtgcgacaataaaaccatggttaccaacgcaacaatcgaggctcttctgggccgccgctccatccgtaagttcaaggacgaggccatcgacgacgatacccgcgccacgctcgaaaccgtcgcccagcatgccgcgtccagccagttccttaacgactggtccgccatccgcctcaccgatccggccatcaaagccaagctcgccgaattcggccatcagccgtatattgccactgcgccgctgctgtacgtgttcgttatcgacgagcaccgcaacgcgcgcatcgccgaacgcaagggcatcgatcccgcttccgacgaattccatctcaagtacagctatcgcttcacccaagctcagaacgacgcagtgctggccttgcacgccatggagaccgccgcctattcgctgggactgggctgcgtgattctcggctctctgctcaacaacatccccggccttatcgacgtgctgaatctgccggaatacacgtatccggtgctgggtctggccatcggcaagcccgatcagaacccgaccgtcaagccgcgcatgccgcgcacgatgcagttcttcgagaacacctacccggctgacgccgatggcgtactcgaccagctgcccgccttcgacgaggaagttcaccggtactacgatctgcgccaagccgaccgtccggtggacgccttcagcgatcaggtcgccacgatcagccagcaggatgtcagccatcagacactgctcgacaaggccgccgctcagggcttccgtctggatcagtaagaccagaaccaacgaaataggctcggatgggctcgtcactgagtcgtctcagtctcagcactgcgacgactcagtcccaacacctcaacatttcatcaccggataccggcaaaattgcacaaccatcccgccggtgtcgcaccatcaataaacgtccacatatcagtcccactatgcggacaaccaacggccagttttgcaagagaacccgcaaaaccagcagtatccgcaccagtggtaggaatagactgcatgtggccgcaatgactacgaaccggaaaagagggactggatgcggaaggtttggcaagtctttctgcgcgattgcagacgtatcttacgcaatcccgttgccgttgtggtgacgctcggcgtagcaatactgccctcgctgtacgcatggttcaacattctcgccaactgggatccctattcagccaccggcaatctgcaagtggccgtagccaatgaagaccaaggcaccaccaacgatctggtcggccatctcgatgcgggccggcaggtcgtcaagaaactcaagcagaacgacgaactcggctggcgcttcgtagacaatgaggaacaggccgtacacggcgtggagaccggcgaatactatgcagccatcgtgctgcccaaggatttcagcaccagcctggtcgaatcggtgaccggaacctccaaacagccgaaaatcaagtattacgtcaacgagaagaagaacgcgatcgcgccgaaaatcaccgacaccggtgccaccaccatcgacgagcagatcaactccgccttcgtcaccacggtagccaccaccgttgcctcggccgtttccgaagcgggaggcgatctcgaccaagccaccggcaaagtccagcacgatacgatcaatgatctcaatacggtgatgtccacgctgaacaccgttcaggattcactcaccgacttacaggacacgctggcccaatcagacacgattctcgccgacgccaaacagaccaccgcctcactcaggcagaccgtcgcggccgcgcagaaggcctcccgccagtccggcacactgttggcggaaacacaggccgggtcacaagccttctccaccacactggtcggcgcgctcgacaccagttcagcacaactctccggactggccgttcacgtcaacaacgccgccggcagcatcaccggctccttcaacagcgcgcagaactccgttgacaccatcaccaacacactttcggccccactgaatgccacccaaacgtcaatcagcgatctgaaagacgcgctgaccaaagccggcatcggcaaagacaccaccgacccggtcggccagaacatctggaaacaaatcgatgcgctcgactcattgatcagcaaacagcagacacagctcaacaccttccataccgacaccacacagttcatcaactccggtaaagacgccaccacgaatctttccggagccatgaccaacaccaccaccggcggcatcgcggcgctgaataccgcgcgcggctcgctgaccggcaccgtaatgccgtcgctcacctcatcattgaacagtttcgccgccctgaatggcacactggatggcacgttgacttcgttatccggcaccttggatcaggccgacggactgttcgaccagcttgtcgataccctgaaccaaacaaaaaccaccatcagcagcacgcaggattcgctgcgccaggtggccagcgatgtcgccaccgtacgcaccgatatcgccacgctcgatagttccgccgcttaccagaaaatccgggatacgctgcatctggatgacaagggattcggcgacttcatgggcaatcccgtcaccctgaccacgaaagtcgtgtatgccaccgacaattacgggtccgcagtcaccccgttctacacgaatctggcactgtgggtaggcggtttcgtgctaatcgccatctacaagcttgaggtcgaccgcgagggcattcgccgtatcaccgctacgcaagcatatcttggccgctggctgctgctggtcaccatcggattcctgcaagccgtcatcgccaccatcggcgatctggtgcttggcatccaatgcgagcatccgctgctgttcatcttggccggaatcttctgttcgttcgtatacatcaacattatttacgcactggccgtggcgttccgccatatcggcaaagccatcgccgtaattctggtcattgtgcagatacccggcgcctccggcctgtatccgattgaaatgatgccgaacttcttccgcgaactgcacccgtggctgccctttacctacggcatcaacgcgatgcgcggcccgattgccggcctgtacgcgaaccattactggctcgacatgctgcacctgttctggtatctgccggcggcactcttcgtgggacttgtcatacgccggtatgcgatgaacctgaacgcgctgttcgaccgtcgtttgggagataccgacctgatgatcaccgagcacaacagcatggtgaacgaacaggtgagcttgaactccgtattccgcacggtgtccgacagcaaggaactgcgcgatatcatcgcccatcgcgcgcaccggttcttcgcacggtatccaaagatgatcgttgccggtctggcattgctgaccgtactcccgttcgtattcctggtgctgctgttcgtcacccaagagaaaatcgccatgctgacctcttggattctgtcgattattcttatcgacgcctatctcattgtggttgaatacgcacgcgaagcctacgccatgcagcttggcgtcagcgccatgagtgccgacgagttccgcaatgtgatgctcaacggatatgtgtggcggcgtttccacggccacggacgtcacgaagcggcgatgggcagcaatccggatatcggcgaaaccactgaacgactcgcaccgttcagtgatcaggtcaccgagccgactgcgcacaccgcacagtccggtcagtccggtcagtctgggcggggaggcgcacgatgaagcttatctggaaaatattcgtacgtgacgtgcgccaagccacccgcaatgtgatcgccgtaatcgtggctatgggattggcgattgtgccggcactgtacgcctggtacaacatcgccgccagctgggacccgtacggcaataccaaggccttgaaggtcgctgtggcgaacgtggatgagggctataagtccgatctgatgccgatcaccatcaacgtcggcgaaaccgtgaccaatacgctcagggccaatcatgaccttgactggcagtttgtggatcgtgctaaggccatcgatggcgtgaactcaggcgaatactatgccgcgctgattattccaaagagcttcagctccgatatgatgacgctgttttcaccgaagatcaagcacgccaagctcgaatactatctcaatgagaaaatcaatccgatcgctccgcatatcaccgaccagggtgctaccaccgtggccacgaccatcgaccagacattcgtgaagaccttggcgagcgtggcgctggatttggtttccaacgtggccgattacgcgcaaagcccgcaaatggagcagtacgtcaacaacgccaccagtcatattgccaccatgtcgtctcgtttgaccggcactgcgtcgcagatggattcctatgccaatctgctcggggccgccaacagcatcattgattccaccgataagctgctggggtcaacaggctcagctgcggccacaaccaaaaaggcgttgaaacagacccgcaacggcgtctccagcctcgacaaggcattgtccggagccaccgatggcgtcggtacggcattgcagcaggccggttcatcctacgacaccattgccaagcaaatcgatgccgcttttgccgatgtgggctcacaatcctcacagatatcaaacaagctaaccgatatgcaattcaaagtggaggctcaggctgacagctttggaaagtatgccgccgctttacgagatctcgccaaacaagcggcttcactgcccgtgggcggagataccgttgccgctcaactgaacgcggctgcagaccaagccacaaaggcgcagcagagcatgcagcaagccgccaccgcgttgggcgatgcggccacgcacatagcaaacggtactgccgatgccgatacagcgcgtcgagatctgaaatcacaaatcgctgccgccaaacaatcgattactcaggcttcagacacgtacaagagcacgctgaaaccgcaactgaacaatctgacctcgtccatggacgaagtggccacgcaggcaagttccgtaatcgacgggcttgcatcgaccgtcagcagcgtgtcaggcctttctggcggcgtttcagacagcctgacggacatccagtcggccttgactgacgcagctagcgctttgacccgttcggcgaagaaactcgacaacttgtcttcccaactcgcctctatcaccaatggcggcaccatcgacctgtctgtgatttcctctgcgaaacccgatgtcattgcttccatgctggcggcacccgtagcggtcgaccgcatcgcgctctatcccgttgccaactatggttccgcgatggctccgttctacacgattttgtctatttgggtcggtgcgatcattctggtcgccatgttgaaagtatcgatttccgaccatgagaaggctcgtatcttagggttgggcaatgatctgccgctcggttcggaagtgggtcttcgcgaggccatgattgccgggcggattgccggaccggccgccgcgttggatgtgctgaagaagccgcgtgccgaggctcccggcaatgcgcggcagttcggtttacgcttgcaccacgaatatttcggccgatacatgattttcggtttccttgctttgctgcaaggtacgctggtgtgcctgggcgatatgttctatctcggcgtgcagtgtgagcatccgattcagttcttgatggtcgggtggttgtctgcactggtgttctcgaatattgtgtatacgctgaccctgtcgttcggtgatatcggcaaagccattgccgtagtactgctggttatgcaggtagccggttccggcggcacattccccattgaaacactgccgacgttcttccaggtcgtttctaaatggctactgttcccctatgcggtggatgcgatgcattcggccatggcaggctcattcggcatggaatactgggtttccatgggcaaactggcactgttccttgtcccctcattgctgttgggacttatgttgcgcaagccggtaattcgcttcaacgattgggttatccgcaaccttgaaaacaccaaggtgatgtaagtgttggacgaagtgtgtccgagcgccctgaacgcttagcagcctacgacctgacgtgtttggaccgtaacctgtctcagacacggcgttggcgaggcctgtggagcttctgacgctaacgtctacgtggcttgtagccctttttacgactgtgtggcttgagttgctggttcagcggtacatgccggtaactggattgcggatcgcgatgcgtgagatgccagcatccgcaaaattcgcaacggtacacccatagctcaactccgcgctcgattaggctttgatcagcggcacgctgaacctgcgccttatcgtgatacatgattttattcgacgtagcgcaacgtttaggggtgaagtaatgcatagcagaagccagtgtagagcgaccccataaccaagccagtttctggctcccctcaggggggccgtccgcacagcagaccggggggggaggaggcccgggcgtcgggattccacggtcacggacgtgccgttttccggatttcctgcggaaatgggaacgcgccgcgccgtctctcttcggccccgacggcggggctggccgggaatggtcccggacgtgggtctcatgagtgcgagaagccccgggtgtttttgtgggggtgtgtgggtttgggtcgtgagtgtttcgggtatgcgaaagccccttggggcgtgtgctccgaggggcttcctgtacgtgtgatgcggcggcgtgctactctcccacaccctgtcgggtgcagtaccatcgccgtgccaggccttagcttccgggttcggaatgggaccgggcgtctcacctgggccatggccgccgcaaatcttctcttcctttccggtcctttctggcggagatacaagcaccatccagttaagaccattccgtggtcggcatgctctgcctaaacccgaaaaatcatcgtgactaaacccgcaacaactaattgaacacaaacaacagcatctgagcattcggcgaaccgcggagaggatcggccgggacaagtccacggtgtcacgcgagctgaggcgcggcctgtggttcgcgtccaacgagaacgggtcgtaccgtccctaccggccgaaacggctgaagaccgggccgtggacctcgggtccgttctattcggcgctggccgcgcagaggaaggcggacctgcgccggcgcggatcccgcaagccgcgtcgcatggactcggaccggcttcgcgcctgggtgctggactcgctgcgcagggggtggagcccggaactgatcgagggacggttgaaggcccggtacgccggcgacccgtcgatgcggatcagccacgagtgcctttaccagtggatctacgccaagccgcagcgggcgctggacctgcgccagtacctggcgcgcggcaggaaacgccggacgaggaaaaagggcaggaaggcgaaagggccgcgcatcccgatgcgcgtgcccatcgcggaccggcccgaggcggtcggatccaggaaggggttcggccatttcgagtcggacacggtggtcggcgccgcgccgtcgaggcgctgcatgaacacgcaggtggagcgcaggagccgcaggctgttcgcccggctcgtcgacgacaagagcgcgtccgccacggccagggccgaatacgagatcttcaaggacatcccgccggccgcgcgcgtcgaccgcacgtgggacaacggcacggaggcgagcctgcacatgctggtggacgaggcgctgggcatgctcacgtacttcgccgacccgtacagttcctggcagcgtggcagcaacgagaacaggaacggcaggatccgccgctatctgcccaaaggaaccgggttcggggacttggcccaggaggacctcgacgcgatcgtcggtgagatcaacgacaccccgatgaagctcctcggctacaaaacgcccaacgaggtatgggacgaggagatcgccaagctacaatcgaaggcagccagcccgaacacaagcgttgcgcttacaaattgaatccggcccgccgaggcattcgccgacgaactgctataattgcaggaccaacagggggtgttgcacctctaaatagacatcgggcacacggtttgcgcggcggtgagcagtgagcggtgagtactgagcgacgtacggcgactcacgtgcgctcacacagtggtgagcaatccgccaaacaacaccacgagcagagcgatggtttcaatcacgaagtacagaatgaaactcgcccagcttttggtcagtacgttcagcggcgaggtcttccggataatcaccagcagaccaacaaacaccagggcgtatacggcgatgccgatcgccgcccccataatgcccagattcgcggcatttgccagaccggcctgcttgccgtagaccacgtacgtggaataccagaaattgagattgagcatactgagtcccgcgatgaactgctcacaggccagcccgagcacgaacacgatcaaccacggccaggacggcgagacgaccaccgccatcgccaatccgacgtacgtgatcaccacggccacccaaccgaccagtgcgataccttgcggagacactcccccgagcacggccacaatggagtcagtattattcaccgccagcgagcgaccgaaccagtatggcgcgatgatggcgcacagtacggcaagaataatcaacgcccaacgcaacggatgggagcgacggcgctcgatatcagccaaagacaaatcggtctcgggtatggaagcctcggggtgcctggaaacctcgacggtctctactttgccgcctacgatttccgtcgcctcgttaggttcttgctcgttggattcctgctccatgcaccgcctcgccgattacctgcttattgccatgtattgccatgccgattattgcgatgcctatcttagcgtgcgtgttgggcaagtacctgatgttccctgtggtttcgcgcactgattggatacagacaggctactgctgttgcccgtctgtatccggcgacttgtccgccgctgtatccgtctgttcctcaggcaacgtattggcagcctgttccttacgccgcctgccgtgcagcagggcctcgagcatgtcgacctgacgctccagttcgtcgatacgacgtacctgctgcgaaatcagcaagtcgcgtaggtcattgttctgctctttgcgggagacggggaagatgatggcgcgacgttcgggcgatacgtggaaatcggattcgctgccggtaccagccggaagtgacgattccgccgagtcgcgccaagctctcgctgctcgcgcactctccggaatgtttggtgcgcccgcggctcccgagcggaaaagctccgaatctgaagcccccccccccagcttattttccacgccggctttggcattgccggagttcaggatttcgtcttgcgattcacgccagcgggcaaggcaacgttcgatgcgcttgtacccgattagagccggatccaatccggcttcacggaacatgcgcacgggtgaggcaccttcgttgtagtggactacacagtaacgcttgaaatcatcggtataggtgatgcgcttcgccgtggcttccgccactgccgacaacgacttcagatacttgatctcctcggggctaaaagtccctccaccactggtcatcctcatcccttacactcgttggaaagctcattgcacaccccccttgattatggggtgaatgccatagttcgggatagtaatacttataattcggacatgcctaacccctagtagggtcgtttttatccccgtttaagtggagcctgagtagtggctggacggcaactgaacgataatcagcccacgaatggggtatacagacccatccttcacccccctatgattgtgtccgcttggcgattgttaccgagcctgcgtgaaacgtttgttgtggcgaaacacaagttattttcgatgcccggccccattacattcaaatcaaaatgccatacattgcccataagattcggagatggcctacaagtcatccgtatgaaatgccgccaatatgacaaatggccgatctgaataatcagatcggccattgttatagctgctcagtcataagcagcagtcaagctcacgcgttgagagcgcgcttggtggaacgggacttgacgaacacggtcaccgcggcgcccgcgatcagcaggccgatcacggagaacagcgcggtgccagcggcaccggtgagcggcagctgggtgatgttcttgacgttggtgacctggaaggtgcccttgttgtccttggacaggttccaggcatccttaccagcgaaggtggcagcagcatctgcggttgcaccggtagtgatcgtgaacttgccaacgaaggtgccgttgtagccagtcgggaccttcgtctcaatcacggtgtaggtggtgttgagcttaagaccgttcagagtgtacttaccctcagcgttggattgcagtgtgtccgtggcgccttcagggtaagtgccatcagcattggcggtcggcagagaatacgcaccgttagagccattgaacttaagcggagtcttcgctttgagctcgtcagcggacagaccgctaacatcgccttcgtacacttggaactcagcaccagtcagagcagcagcgttcttgtcgactttctgccaagtcacggcaccagccttggtggtttcttccttgctgctcttcaggtcgacaacgccggcagcggcgagaacgccagtggcgttgttcacggacggcgcggcgcccgtgatagcagtgccagcgagaatcggagcattgccattccacacgagcttgtgagtgtcattatcttcgacgaccagctttccactctggtcgacaatcaagtacagaccaccctcagcgaaggtgaaggtctgggtcttgccaccgttagaagccgtcggggtaatgtccgtgacagccagatccttaagcgcgttcacaaaagcggtggtctgcgcggcggtcagggtagtgttgcccagccaggcccactcgttcagggaatcacccttggtctggtcgttgtaaccagcagcagcgaaagcagcatccactgcctcaccggagaccaaaccctccagctcaacgccagtgttgccatcagacacatacttggcgagctcaacgtacttgaacatgcgcaggttagcctgcaggtcagcggtgtcaaccggcttggtgtagaactggtttgcatccgtggcgttgactgtgatagtcgtgctggagatgttggcctcagccgcgttggcggtggtggcgccgaaggccatgccaccgagcagggtggccgcagcagcgacacccgcgaaaagcttcctcaacttcatgagaaaccctctcttccttattgtgattgattttcttgcaatcgcggaggctgcagacccacagcagggcctccgtgatccgcaaatccttattgttttttcgggagggaagccttcattgccccccctcagtccgccttcggcggccagctcccctcagcgagaggagccaaaaccacctcaagtttcttgaaatcagaccagctgacgcttacgccaaaccgtgtagcccgcagcagccagcagggccagcaggcccaggccaccgccgaacaccatccagtcacgaccagtcgtgccaccggtcagcggcagactggagatagccacatacttgttcgtgaactgtgccgactccgtattcgttcggtcggaatcgttctcgccgtactcgtaagagacaacggcatccgtcctggagaccgtgaccttgacggtcaccttatcgttgtcatacttccaaccggcagcaggcttttcggtgtcctccgaagcctcgaacgtgtagaccaaattgtcagcaccggtcggaaccctgaacttcaggtccccattgccgaagccaaccgtcgcgctcgcgccgctagcagtcaattcgtccttggacacagtcgtagtcagtccattgttggccaagccggtaacgtcagcgcacttaccagcattcgcatccgtgctatccacgcacttcaggttgaagccgaagtccgaattagcagcatgtccctgcacaaccttcgtcaccttgacatccgaagcgggcaaggtcacgtaagaaggcgtgttggttaccgtgaaggcaccggattgtgcggtcaaaccttgtagcttgaggtcagtcttatcaaccttggagtcatagccttcaaccttgacctcggaaaccgagtatgtgtgcccctcagggccggcaggcaccgtgaactcgtgagtccagttgccggcggcattcagagttgctgaaccgttggcataatcctcgccgtcctgcttgagctggacctgcacggaatcattcgcgtgattctcgttgtcgtcggaccaagtcttcgtcaccgtaatcttggagaccggaagggtgatggtcggcttctgcaggtaggcggcggtctgcggatcgctcgtcgtcgtgccgccctgcgaggaggtcaccacggtcttgtagtcgacagtggcgctggagttgtcgttcgtgtagaagttgttgtcgccggaggcattggcatcgtccttgtggttcttaacagcctcgtcgaacgcagcctgcgtcggcttgacattgaagctcaccgtgtaggtgacgccgtcctcaagcgtgtcgtcgttggacgtgaccggccaagacacggtgccatcagccgcaaccgtcgcctccggggcgtcagcccacgccgtggtctggcctttccgggtcttcgtgtacgtgaagcccgcgggctctccattctcggaggcgctgtcggagctcacgacccagctggacagcctgtcgtgaatcgtcacgtcggcatactcagccgtcttggtgatctcctgataaatggactcgaagatgttgttcagctggccggcatccgtggcggccttgtagtagctgctggtctcggcgcggtcaccgaggttggcgttccaagactttccccacaaatgctcactgctcgttgcagtggcatccgggtagttgctggagatgccgtgcatgtacttgttcaggttgctcgaggtgtcgccggggttggcaccgctgacgacgccgatcgagtagatggtcgtcccggcgtccttcaggctcttcgccttgttcaccgcggtggcggcgacggtggggtcaaacccgctgccgtggttcggctcgccgtcggtgaagaagatgacgaccttcttcgcgttggcgcgaggctgatacgttagcgccgcctgggcgcggtggcggaggtcgcgccggacgcgctcaggccgttaaccgtgctcgtcagtccggagacgtcgtacgtcaggttgctgacgatctgcgtgtagttgtaggaggaccagccttcgcggtaaaagtcattgccgacgctggtcttctcggtgccggcgaacttcaccagggcgatgcggttccgctggctctggtcggtaatcttcgcgttctctgcagccgtcgcattgatgaatttattgaccgcggtcttgagcgagtcaatcttcgtaggctggttccaaccgctagcgatcttttcggccatcgaaccggacacatccaacaccagcacgatgtcgagtggctggttcgtcacgatctcgcccgtacccgcgctcttcgcaccggtgacgttcaacgccaccgtgtacgtgccgtcttcattggcggtaacggtcttctcgcgggccggagcagacaacgtcggatcatccggcacgccgtttgttccctcggtggaaagaggagcaggcgcgctggcggccgccttctcatcggtggtctgcgattgtgtcgtggaggcattcccatcgtccgccatggcggtcgcgctcacaccggcgacgccaccgagcatcgccacggcggcaacgatcgccactaaccgtttgcctttcctgcccgccgcggcccctaccgctgcgaaccattctgcaattctcttcataaccttgcctgtctcttacgatcacgtacgccaaaacccggcgttacgcttataaggcgttgcggtattaagcaaaaagcacgaatgcgtacacccgggtagagggaattttttacccgacattgaaaagaaccttggaatttttgaaaagtggcaccctcgtcatccaccctgcgataacgcacttttcttctcgacggggcgtgccggtcccaccatctgggaactgaggcggatttgccgccgctgcgcgggggccggagttactgacgaccgtcagtatgccactgctccgcatgtgtgcagtatcacataccgctacgcatacacggagacatactacatgcaatttctgtgaacgcaaacatacgactcaccaaggccgtgttctgttgcgggcggtggtgttacgggcaatgttgtgggtagtaccctagccacaaacctatatagtggagcggatgacgggaatcgaacccgcgtaatcagtttggaagactgaggctctaccattgagctacatccgcgttaagcgtcgcttttggcgacttgagttattatacatatttcttcggggatggcaaacgcgtgtggctgcagcaggaccagccaatctagttgatggattgcggctttgccgaggactcccctcagtcacctacggcgacagctcccctcaaagaggggagctagaaaccgtcgaaatcacaaatggatgagctgggactcgtatggttggaggtcgacgtccatcgcgttcagaatgccgttgcaggcgttgaggtgggcgtgctgcgggtcgggcgagaagttgaacaggccgaccagcgtcttgccttcgtgctgacgaatcacagcgagcaccgaatcattgaacgtatcccacgtggacacccaagcgtcaggcgcgaagcagggatcgttgcgcatcgcgcgcaaatcctccatgcccttccacagctggttctgcaacgtaccggacttcttgcgcagagcggccttggtccagtcgaacttactacggtgcagattgcggctgtcttccacgcgatccgggtcttccttgtaatcccagccgttgagctgggcgatttcgtcgccgcagttgagcatcgggaaaccgcgcaggaagctcatggcgtggtgcatcatgaggtcgcgatccaccgaggtctctagcagtggcttgtcgtgcgtgatgatggccttttcgatgccgcacaggctggcggtggtgccgcaactgcgggcgtcgcgcgtggcttcgtcgtagttgtagagttcgcccatcgaccagctgccgggggttgcgccctcgtagaagtggtacaggaattccttgtgcttgagcgggtcgatgtcgaggtaacgctccacgtcttcgtccaagccccagccgatgtcgtcatggcagcgcaaataattcacgaaccagcagttttcgggcagcgagttgagcttgtcgatctggttcttgagcagacgcacgtcgcggctggcgagcgcgctccacaggttgaccatgatggagacgttgtacagcatgtggcactcgggggcctcgggcgtaccgaagtaggcggcgagctccttgggggccatgaccacctcgcccttaagcaccacggccgggcagacgcattccaaaatgatgcgcagcatgcgcacgatggtgtggacctgcggcaggttgcggcaattggtgccaagctgcttccagatgtacggcacggcgtcgatgcggaacacctcgacaccgaggttggccaggcgcatcacgctgcccatcatggctacgagcaccttcgggttgcggtagttgaggtcccactggaacgggtagaactgggtcatcacccacttgttcatcttctcattccaagtgaagttgccgggcgcggtgttcgggaagacctgcggcacatcccggtcgtagcggtcggggatggtgcggtccgggtagcagaagtaatagtcctgatactcgggatcgccggcttcggctgccttggcccagcggtgggtggaggcggtgtggttcatcacgaagtcgatgcacagactgatgccggcgcggcgcagcttcttggccagcgcggcgaggtcttcgttggtgccgagcttcgggtccacggtgtcgaagtcctggaccgcatagccaccgtcgttgttcgggtgcggcatgtcaagcagcggcatcaagtgcaggtaggtgagcttctgctccttcaagtacggaatcttgtcggcaagtttcttgaggtcgccggcgaacaggtcggtgtacatggtcatgccgaacatatcgccgcgcttgtaccagcccgggtcctgctcgcgggttttgtcgagacgcttcaaatcggcgggacggtcagcgtaggctgcggccatgcttgcgacgagtgcgtcgaaggcgtcgtgatcgttatataggctcatgaagagctgttcgagttcgtcttgatgagcagcaaggcgagcgttgaacacggcgctcgaagcgggacgcttggcggttgcggacttggtcgccgctgccttggaggtacgggccgaacggacggcagtcgtcgccttagtcgctgtggttctggccgtacgagacgtcgtgcgcttggttgcggttgtcttggttgccgtggaagtcgtagcggttttggccgctcgggttgatgctgtcttggcagccttcttcgccacctcggtcttctcgaccgattccactgcctgtgccgactggttgctttgagccaccggaaactcctttgtctctatccgttgcccgcgtcaatcgtttgacgctttgtattacacaagatcaaaccggttcgacaatcgcaacccaagactcgccgagccaccggcgctattccacagaaatcgtcaccaccgcggaggcaatcggaccatcgtggctcagggaaatatggatatgcggcatcgaccccgcaccgaaagccgagcgctgcgccgaacgcgcattccgccgctcctgcatcactgcataaggcccgttatcggaagcaggggaataagcagaggaatagcgagcgcctgcagccgaattcgcgtaatcagtttggaagactgacgccgtccccttacccagagacacatgcggcacaccacgggaatcatccaagatctcgatttcaggccacgggaaattatcaagcgtgaacggatagggggcatcgccaagataatcgcaccacgctttgaggaacgcctccttgcctgcccacttggcggacagatgcacggcctcgtcatcgttcttcagccgtgcacgatccgccgcctgacgtacctcacgaacggaaaacagcgagcgcatgcgcgagccgggttcagacagctgctcggcgaatgcggcgacgtcaaccacgtcatgacctaaaccaaatgtgcccatagcacctattatcagccattcaacacgttgacaacacatccagaataacgaggttcacacggaacgcggcatccacaaacggaaaccctcggccgctccgcaagccgaatcctgaaagtcaacaccaagtcaaactgttgactaacggtggacacggcgtaaaatgtcgatattccacccgacactccaatacgtaaatcgattgacgtcaaacgtttgactttttaacgcggttaacacaatgatccaatgaaggataacttcacaacaaccaaccacaaccagccaatgaagccagcaaggaggtagaaccgtggtcacgatgaagcaaatcgccaaccgcgccggcgtttccatctccaccgtctctctggtgctcaacaaccgcgatatcggccgcgtcagccccgatgtcgccgagcgagtccgcgacatcgccgccgaactcggttacctgaccaaccgtctggccagcgggctgcgcaccagcagtacccgcaccatcggattcctcagcgacgaagtggccaccacgccgtttgccggccgcatgattgagggcgcgcaagacgccgcccgcatgcccgcgttcttcgacaagcacccggatgtcgacggcttcttctgcttcaacgacacccgcgcttgggccatctacaccgaggccacccgtcgcgggctgattatcggcaaagatatcgcggtggttggcgtcgacaaccaccaggttgtggccgaagcgctggatccgccgctttccactgtggaactgccgcattacgagatgggctactgggcagtcggtaagctggtctcgctcatcgaaggcgaggcacccgatccctttcctcgtgccggatacccggtcgagaaggttcagccgccgccactgagcgagcagtcaccccagcttgaatgccagctgcgcatcaagcaatcctgggtccggccccgctcccagcgatagcctgcccaaaaatcacgcatctatcctacttgacccggtttcgactgtatatcgaaggcgctattgctgttttcgtgggtggtggttcgttgttgaaccgttgcgggagtaagagacgacgaaccgacatccacgaaaacagcaatagcgtcaaaaaacaatagggtcgggaagaacaccgtaaatgacgttcttcccgaccctaatcgcgagacactcccctcagccggcattcaccgaccgggggagccagaggggcatcaggcctcgtagtagccgtcggcgtcgaggcgggcgtccgggttgaggagcatagccttttcgacctcgtggtggtcgtagccacggtgatcctcgcggaagcgacggttgtcgatcggctcgtagagcgcggcgcgacccatcatgccttcctcaaggtgacgctggccggcggccaggcgggcgttggcacgctcacgccaagcttccagtgcggcctcaccatcggacttggccacggccgcctcgaaggcacccggatggaccagagccacgaagccggaaacatgtccgaagccgagcgaggtggccagaccggccttgaccgggcgaccagcggtctcgcgaccgaactcgtcctcaccaccgccgatgcgcaggggcttcctaacccagaccatgtggtcgtcgcgctggagcttcggatccacgcagtcgagcgccgcgttcgccggaatcacgccggacttgaacagctgcgtcagaccgttgacctggaagatgcaggcaccacccttggcgtggccggtaagcgtcttctgcgagatcacgaacagcgggttgccgtcggtgcggccgatggcgtgggccagcgtgttgtgcagctcggattcgttcgggtcgttggcgttggtggacgtgtcgtgcttggagaccacggcgatgtcgtcggctgagacgccgagcttagccaggtcgtgcacgagcttggagtccttgccaccgaggccggcagccagggcaccgaggcccggagccgggatcgaggtgtgagcaccatccgcgtaggagtggatgaagccgaccacggccgcaaccggcaggccgagcttttcggcgatgtcaccgcgggtcacgaggatcgtgccgccgccctgggattccaggaagccgccacggcgacgatcgttcgcgcggctgaagaagcgcgcgtcgatacccttgccatacatttcctccgagttggcggtggcgttcatgttgccgaaaccgatcacggattccacgccgatgtcgtcgatcgcaccggtgaccacgaagtcggccttgccgagggcgatcttgtcgacgccctcttcaagggagacggctgcggtggcgcaggcggagaccggctgaatcatgttgccgtagccgccgatgtaggactgcatcacgtgagccgcgaccacgttcggcagggcttcctgcaggatgtcggtcgggatctcgtggttgaggaagcggtcgaggtacagcttgcgcatcgacatcatgccaccgaagccggtgccctgggtcgaagccaccagcgaggggtggatggactcgaggatttcggccggggtgaagccggcgcccaggtaggcgtccacagtggtgacgatgttccacagggcgatcttgtcgacgtcgccgaccatcgaggcgggaatgccccatcgggtcgggtcgaagcccttcgggaactggccgccgactgtgcgggtcatggtggcgcggcgcggcacgcggatcatcgagccggcgtggcgggtcacgttccattcgccggattcctcatccggggcgatggtggtgtgagcctcgtccaacttgacgtattcggcggcgacttcgcgggtgggcacagagaaggtgacgtcgtggtcgaggaagacctcggcttcctcttcgtcagcaccgtccttgtagtcgttgcccatgccttcctcgaacgggcggatgccggagcgggccacgacctcgtcgtggtagcgctcggcgatgtcctcttcgggcacgaggttgccgtcggtgtcgtaccagccgggcttcgggctgtcggcccaagtcagcaggcccatgttccacgcgagttcgagcactgcgccggcgctgaggtcgacggtgccgtccgagtggatgccgagctcggcctgggcgcgcgtacgaccggagccccacgggcccagctcaccgacggaaacgatgacgatttcgtcttccggcttggcagtgacgttggtccaatcgttcaagtcgaccggagcctgcttggtgacgatcggtgtgggcagcgccttgatttgctgcccacgcgaggagtcggacagtccagtggactttccggcgacggagccatccgtttcctgagacgaggccgcagcagcttccttctcggcgtcggccatggcctccgcacgcagggccttgatgtcgatgggctcggagccgaggccaccggtcaggtccacatcgagcggggccttgagggcctgctcgcgcgattcggcagtgcacaggtcgagcagcttggccgcaatctgtgcggtggagtaggtgcggatgccgtgacgctcaacgacggcgaccagcgggtcgttaccgaccatcaggccggtgccacgcacccagccgatcttcgggtgagcgaaggtgacgcggctcgaccacaccttttcagcgcgggcacggttgacgatggcgtcaaaggcgctcttgacttcgccgtaggcaccgtcgccgccgaatacgccgcggttcggggaaccgggcagcaccacgtggagcttgtgctgcacgttggtgtcggcaccgatgtggctgaagccggcgatggcgcgttccacgccccacagcatcagtcgggcctgcgattcgaacaggtcgccggagtcggcgagcgtgccatggaccggcggagcggcgaacgggaagaacagagtcggctcccacgcgggcttcagaatcgtggtggtagcaccggaggtcttcttctgctcgtggcccacccagtcgaccagtgcgtcgacgtcgcggtagctggagaggttggccggaaccagccacagcttggcgttgccggtagcgtgctcgcggtaggcctgcttagcccaagccttaatggacggcttgaagctgtgcgaggtggccaccacagtggcaccgcctgcgagcaggccttcgaccacctgagcggcaatcgagttcgggctcacgccggtgacgatggcgatatcattcgcgtaacgggaggcgttcttgttggacgcaacctgttcgagggcctcggagccggccttctggaaggcggccttgagttcttcgctctccgactcgttggcgaaccactgggcttcggcggcgatggtcttgccaaggccgatgaagctgccgttcaaggcggcgggatcgttgtcgtagtaggcgcgggcgaggtcttcacgggcggaggcccaccgatcatcgaagaggatggccttgttggcgtcgaagcgcggagcgacctgcttgggccagtcggagccaagttcggcttcaaccgcggccacgacggcggcgttctcgtcctcggattcttccggagccggagcggccacgccgagctcgttcagcacgaagcgggcggtggcggcgagcacgccgttggaaccggtgaccttctcggcgaaggcgtcgagcgcggcggaatcgaccacagcgccaccagcggcaccaccggcggacggcagggccacggcaacacccttgagctgggcgacgacctcaacggccgcatcaatcagcttgtcggcttccggcttgttctgcacggcggcggtgggcagcttggccaggtcgccgccacgggagctggcaccctcgcgagtgtcgagcagcagtgtggcgagcacgctggccacccaaccttcaccgagctgccatacgttggtcacgcggtcgcggatgtactgctgcttgacgccggcggcaccgaacagcgagcgcaggcggtcgcgcagcgcctcggatagcacggcaccgaacggcttgtagttcggggcggccttgttgacgatttgggcgagcttgtcgagcgtcgcttcagcagcaccgtccacgctggcgactcccagctcggaactgatgtccatgagcagctggttgcggcgagaagagacaccgttagtcagggtgtcggtggtgtcgttgctgccgatctggtcgatgcgcaccttggcggagtaggccatgagcacgccgatggcatcggaagccttgaagggcaggtcggcgacggcggcaccggacggcgcgccggccgcggcctgccctgattgcaggccgcgtgaggagtcggacagtccagtggactgtccggcgacggagccatccgttgtctgagcagcctcagtcacggcatttgccggagcggcaccggaaccgagctcggcaacggcggaaccaccggcaggagcggtttcgaccggggccgaggccgcagcctcttccggctcatcgtcgggaaccagcgaatcggtgtcggtcatgtagacgcggccttcatcgcggccgacgttgtagacgaccgtatcgttgccggcgaactcgggcagatgcagggtcttggcaccgaggttggccagggtcggggcgttgccgaggccgacttcgacgtattcttccacgccgaggccgccctgttcgcgctgaccgaagagcagcgcctgggtttcaatccaacgcaccggggaggcgaactgccaggagagcagttcggtcaagagcagacggccgagcttctggtcgtcatcggcgtaggaatcccacacggccgggtcgtcgagcgcggccttgatacgctcggacggcacgacttcgaggatcttggcggcgaattccttggtcatctcgaacggggtggccaccaggttcgggatgtagcggtccaccagacggccacggtagtcgatgtaagcgggaagcagcgcgtcgagcttgtcgcggaattccggcacgcccttgcgcagcagtgtggagtggaacggcacatcgatgccgggcaccagcatgaacgcgggcttgccaccgaatgcggccacgcggcgggcggaatcggccttcagagccttgagtccggcgatcgtaccggcgatggcgtactgctggccggcgaggttgtagttcacgatctccaggaattcgccggacgccttggccacggattccacgtattccttgacgtgcgcgtcgtccacaccgaactggttcgggcgcagggcacccatgcggtagttggagcgaccctgtgcgtcacgctcgatgaggtggtgcatggtggaaccacggtggaacacgagctccagcacggtttccagcggaatcacgtcggcgaacgcggacaacgcgttgtattcgccgagcgagtggccagcgaagtatgcaggccagatatcggcgccggcttcgcgcagacgggcggtctgggcaaaagcaaccgtcgcgagcgccacctgcgtgaactgcgtcaggttgagcaggccttcggggtgacggtaggtcacgccgttggcggtgagctccttcgggttatcgcgcacgaggcccaggatcgagaagccgagcttggagcgggtgagcttgtcggcgcgctcccacacgtcgcgggcggcggcggacttggcacgctcgtccagaaccatgccctgcttctggatgccctggccggggtagacgaaggcggcgcgcggtgcgcggaccagtgcggtgccgcgggagacgagctggccgtcgatacggcaggtgacttcgagggtcatgccgccgtggcgcaccttgccgacgcgctcgacggagatttcgacggtgtcgtcaagctgaaccatgccgtacatgttgtaggtccagccggcaatctcgtagtgggcatccttctcgtccagcgcctgcacggcgtgctgggcggtggcggacagccacatgccgtgcacaagcggagcggccaaaccggagatgcgagcgccacgagtggaggtgtggatcgggttgaagtcgccggaagtgcgggcgaaggcggtcatgtcgtgtggggcgacgaccttcacgcggcgcagcagacggcgcggcgtgggcgcgatctcctcgtgctcggcgtcgccgaactcgggggcgtctgccggcaaagcatcggagtagacgcggccgcggatcgcgaaacgctcggtttcgcgggcaagcagcgtgccgtcggcagcggtgtgggtcacgtggatggtgaccacgcggccggaggcggactcgaagtaatcctcagcccaagacttcagggtgatggtttcaccggtgtgcttaagcaggtcctcctcgttcacctcaagttcgatgaggtggtcgaggtggacggcgttgagcaggccttcaatcaccgggtagcccttgacgtacacggagccgagcgccgtgtaaatcgccggccaggccgggccgaccagcgcatcgggagcgatgcggctgggctgcagggtcgtcggcagagcggcgccggtggccgcttcgtggtcgaagccgaggttggcggagagggtgtaggcggcggtggcggtagcaaacggacgctcgtcagaggtcttgccgtcaagctgcggcatctcggtgagcttgtcgccggtgatggcggtgttgccgatgcctgcggtggcggcgagcatcgcgtagacgtccggaatcaggcgttcgcggtccacgaccggcacacggccgggctcggtgccttccacggtgagcgggatgacgatatcgcgcacggcgtgcttggaggtgccgccgtccgggtcgttgtcccagtaggtgtcgaggtggatgtccagatcgtacttgccggccgcggcgtcaaacgcgcggatctcgtagtactggtcgcccagggcggtgccgtaggcggggttgtcggtgatgtggccgacccaggagatgttcggggacttgcggatgaagtcctcggcgctggtggcctcgccgagtgcggcgaaatcgtcgttctcagcggcatcggcggcctgctgttcgtcctgcacgcgcttgatggcggcggtttcgaagcggccgaggatgtcggcgatcggctcgtcgatggtggtgatgccggccacggagatcgggccggggatggcacgcacggaatcggcggagtagcgctggtcttcggactgccagagctggtcctgaccccaccaacgcagcaggtcgttgtcgatgacgggcacgaacggcatgggcttggggtattcgcgcacgagcaccgggaaccaagccacgtcggccggaaccaccttgagttcggcggtctgcgggtaggccagtgcgagcttttcgagtgcgggggccggatcggcgagaatgtcgtcgtgggtcagcaggtcagcggcagctgcctcttcagcagaaacgccatcagcggtgaacagcttggaggtgaattcgccggagtccgtgtcgttcacacgggcttcgatgcgctgcagtaggtgctggaagcggtcggcgtaagtcgggtcgacccacgggaaggcgagttcggcgaagcgctgcgcccactcaaggtaggtcatggaggccaggtctccgaagtaaggcttggcggtcttgttcagggcttcgatgatttccttgcggcgggagtcgagctcttcggggtgcttcatgacgcgcacgagcagacggccgcattcggcggagtcgttctcgagctcgtaaatgtcggcgtgcaggtggctcaggccggaggacatgccgccgacggacttgccggacggcacccagtgggcggcctgcggggcgaacacgtcgtcggacttggcgtcggccggaatgccgggcgtcttgacgagcagctgcttgacttcggggctggtgtgagcctccttggcggtcatcgcggcggtgccgataagcacaccgtcgaccggcatgtcgggcaggccgtaggcgtgggcccactggccggaaatgtagtcggcagcgcgttcaggggtgccgatgccgccgccggcgaccagcacgaggttgtcgcaggcgcgcacttcggcgtaggtggcggctagcaggtcatccagcgcttcccagctgtggtggccgccggcttcaccgccctcaacctgaatcatgatggtggtgggggccacggccttggcgatacgcacaacctggcgaatctggtcaacggtgccgggcttgaagctcacgtacggcaggccgtcagcctgcaggttcttgatgagctccacggcttcgtccagctcagggatgccggcggagacgaccacgccgtcgatcggcgcgccggatgcgcgcttcttgggcacgatgcgggaggagccgaactgcaggttccacaggtaacggtccatgaacatcgcgttgaattcgaccgtgcggccttcctccagctcgtcttcgagggcagcgatgtggcggtcgaatacttcggcggtcacctggccgccgccggcgagctcggcccagtagccggcgttggccgctgcggccacgatttccggttccacggtggtgggggtcatgccgggcagcagcaccggcggcttgccggtgagcttggagaacttggtgaccagcttggcgccggccggggtgttgatgacgcgcggggcgaacgccttccagttctgggtgcgctcaggctcgctttccagcatggagagcgtggagcgctcggccagcgtggtggcttcgaccacgccgatgccggtgccctgcaccacgttgccgatcagcttgccgagcgtgttgccggggccgaggtccacgatccacagcttggacgggtcggcgtcgtcgaacagcgccttgacgcgggcgttccagtccacgtggttcaggagcacttcctcggcgagtgcacgggtgcgcttctggtcgaagccgcaggcgccggcccaggccacggtctgttcgacggcgtcggccatgagcggcgagtggaagggcagggtgacctcaaggtattcgagggtcgggttgaacacggtgccgccgtggagcttctgctcgcgcagcttggcctgatgctggtgttcgcgctcggcttcgagggcgaaagcggccaggtcttccgggtagccggacagcacgtggtggttgtcggagttggtgacggcgatggagatcgggccgcgagcgttgttgacgcgggccaccagcgcctcgacctgggcgcgggtggcgcccttgacggagagcatcgggctggcttcgccgtacttggggttcaggcccagttcgcgcacgcggcgggttccggcggcgccgatcagggcggccacggccagaatctcgtcaagcgtggtgccggcggcctcgatggagccggcggcctcgatggcgcgggtcatgtgcacggcgagcacgccctgggagtggccgagcacggcgagcggcttggcctgggccacgctgtagccgaggtgttcgaggtcgagcagggcgccgagctgggtcagcgccacgccttccacggacgcggtggcgtcggctgcggcgccgaggcgtgccgggttcggggcgaagccgaacaggtcgaccggacggccggtggtggccagcaggtcggcggcgaccggggtgagcagtcggccggctgcggcgacgtggccgcgcagggcctcgtcaaggctgggatcggtggtctggtctgccagggctaccggccacggggtggactggccggcgaaggcgagcgcatggggctcggcggctaggcgattgaggaagaaggtggtcattgctttccttacttgtgtttggttgacgtcttcaaaaatcagaggggctggttgccgtggtgtttggtggtgcgcttgacgcgccgcttggtggcgagcgtggccagcgattcgacaatcacctcacgggtctgttcggggtcgatcatgccgtcgatctgcccgatttccagtgacaggttcgcgttgacggtgctggtctcgtactccttgatgtacttggcccgcagcgcatcgacgtcctgtccagaggccttggccttggccaggtcgtggcggtggatgatgttcaccgcgccggccgcaccgagcaccgcgatctgggaggagggccacgcgaagttcaggtccgcgccgatggccttggatcccatcacgatgtacgcgccgccgaacgccttgcgcaacaccacggtcaccatcggtacctgtgcgttggcgtaggcgtaaatcaccttggcgccgcggcggatgatgccggcgtgttcctggtcggagccgggcttgtagccgggcacatccacgagggtgaccacgggcaggttgaacgcgtcacacagacgtacgaatcgggcgactttctcggacgagtcgacgtccaggatgccggcgagcacgttcggctggttcgccacgatgccaaccggcttgccgtcgatgcaggcgaagccgacgagcgcggaggcgccgaacagttcctgcacctgcacgaattcgccgtaatcgacgatgcaacgaatcacttcgagcatgtcgtaaggctgacgttcgttggtgggcacgatggtggcaagtcgcttggcggtctcgcgttcggcgcgggtgacggcgtatgcgtagaccggcggcttgctttcgctgttggacggcaggtaggcgagcacggtgcgcgcatagtcgatggcgtcggattcgtcctcgccgaggtagtgggccacgccggacacccggttgtgcacttcgccgccgccgaggtcggccatggagatggtctcgccggtcgaggccttgaccacgtccggtccggtgacgaacatgttcgagttctcacgggtcatgatgatgaggtccgtcagggccgggcagtagacggcaccgccggcgcaggggccgagaatcaggctcagctggggcacgaagccgctggcctcgcaagtcttgcggaagatgcgaccgtactgggtcagggcggccacgccctcctggatgcgggcgccgccggagtccacgatggccacgatcggcactttgaggtcgatggccatgtccatcagtcggcagatcttctcgccttcggcggtgccgagggtgccgcccttgacggagaagtcctgggcgtagacggccactttgcggccgtagacctggccgaagccggtgatgacggccgcaccggcgttgccgccggcgatattgccgccctggaagcggccgatctcctcgaacgtgccggtgtcgaagagcaggtcgaggcgttcgcgcgcggttttcttgcctttggcgtgctgcttgtcgcgggcgcgctcttcggcggcgcgggccagttcggcggccttgaccacagcggtgcgcagcggctggtgggccgaaggctgggcggcgttggcggccgaggccgcagccgcggccttcacggcctgcgaatccatgatgtcagtcattgccaccctccttcttggcgtcggtggccttatcggctccttctgacgagggagctgtcgacgcagccgcctgagggagagatcccggcgcagccgcagcagccttggccttgccggcgttcacgtccagcgtgaccagcgtgtcgccggcctccacgccgtcggccgggccaacgaaaatcttcttcacttcgccggcggccggcgcgtacacgtagttctccatcttcatggattcgagcaccaccagaaggtcgcccttggccacctgctggccttcggacacgttgatgcgcgtgaccacggcctgcatcggggaggcgatgacgccggatttggcgccgtcgttggccgcggcggcactggaggccacgttgtgcagtcccgcaccgcgcaacggctgggtgggtcgcttggcaccacgggcgcgggccgagccggtgatgttctccacgatgtcgagtggcacggtgagcttgacgcggcggttgttcatctcgatgacgaacgtctccgacttggacttgtcgggcgcggccggggcagcggcacccggggcggcggccaaggaggccggctggccggaggcggcggaagccggtgtgcggttcaggtacgtgcgctccagccacttggtggacacagcgaacgggtggccatgctcggcggtgaagtcgtcgttgcggaagatttccttgaacagcggaatcggcgtgggcacgccttcgatcacaagctcatcgagcacgcggcgcacacgggccacggcgtcgagacggttctgggcggtgacgatgaccttgcccatcatcgaatcgaacttcggggagatggtgtcgccctgttccacaccggtatcgatgcgcacgccggggccggccggccactggatcttctccaaggtgccggagccgggggtcaggttggtggccgggtcttcgctggtgatgcgcagttcgaagctgtggccgcgcagttcgggggcgcgggtgagctcgccaccggcggcgatattgagctgttcgcgcaccaggtcgaggccgctgacctcttcggagacggtgtgctccacctgcaagcgcgggttgacttccaggaagtacaccttgccgttcggggtcaccatgaattcgcaggtgcccaggcccacgtagccgaccgtggtgaacaggcggcgggagtattcctcgagcgtgctgatgatttcctcggacaggaagggcgcgggtgcctcttccacgagtttctggttgcggcgctgcagcgagcagtcacgggtggagtacacggtgaagttgccgtgcgagtcgcgcccggactgggtctcgacgtggcgtgccttgtccacgaacttctcgatgaagtattccttcagatcgccgccttgcagcgcgtcgtggttcatgtagaagcggcgcagctcctcgtcgtcatgcaccacggtgatgccgtggccgccaccgccatcagtgcgcttcatcatgatcgggtagccgtgggtgtgtgcgaagtcgagcagcgtgcgcacgtcggtcaccggttcggacaggccgggcactggcggcactttggcgcgtagggccacgcggcgggcggtaatcttgtcgcccaaatccaccagcgcggtgtggtgcgggcccacccagatggcaccggcatcctcgaccttctgcgcgaagctcggcacttcggaaaggaatccgtagccggggtgcacggcatccgcaccggtcttgtgcaggatgtcaatcagcagatcttcgttgaggtacgtgtccttgtaggtgtcgccggagagcaggtatgcctcgtcggccatgtccacatagcggctattgcgatcctgttcggagtagacggccacggtggagatacccatctccttggccgtgcgcaccacgcgaagcgcaatctcgcctcggttcgcaatcagcagttttttgacgatagaagccatagtgtcaaattgtgctctccatatagaggagagggcaagccgcgttcacacaaaagctttcacgcccttttgtaggctacgaacaaacgcgcgcgtaggttccggcaacgtaaccgttggcgccggccatcaaaaacgttgcaaatccgccgattgcacatccttgcgcgccggctcaagaagttgacgttacggttgcgttcgtcaacttatgacaaatcgaaatcgacaattttgtaaattggtacgaaaccgcacgaaatcgaacacctctacgatggcaaccgtaagttcgggggaaggctcatctgcgggcgaacggaaggtgaccggaccggcatcggtccatcgccgcacgattcgcccgcacagggtcggattcatttgggaccgtccaccatatggacggttcggactgtcggggataccgcacgacccgccggaacctcccctcatccatcgcataccgcccgccgttcacggcgatatcacgcaacataggggtcattgatatgcagacttcacacaccaccgcatccgctgcggccaccacatcgctcgcccgtcgtatcgtcgccgcatcctggaagccggtgctgttcgccgtgctgatgtggctgtccgcggccgccggcgagattccgattccgggcacgccggtgccgatcacgctgcagacgttcgtggtgatgctcgccggtcttatgctgccgtggcgtcaggccggcgccgccgtcgccacctatctggcggccggtgcggtcggcctgccggtgttcgccggcggcacctccacgctggccctggtcggcccgagcgccggcttcctcttcggcttcctgccgggtgtggtggccatcgccctgctgcgcggcaagtccgacacttcgtccttcgcggccgccgcgcgcaccgcgggccgctacctgctggccgcgctggtcggcggcgtcgtggtggtgtacgccttcggcttcgtcatccagtccgcgctgaccggtgcgccgctcgccgccgtggccctggcctccatgggcttcgtggttggcgacgccatcaaggccgtggtggcctctctggccgccgccggcctgtccaagctcggtcgctgacctgagctactagctagctactggccggctattacagcactcccacatcggcggtgcggaccgtatggtccgtgccgtcttgtgttctcaggatcagtgaggcgtcttcgttgaggccgatggcttcgccggtcagcgtggtgccgtccgtgaagtgcgcctcgacctgacggccgcgcgcccagcacaccgccttcacctcctcgcgcaacgactcggcctggcccttcgggtcggcgatgaacttcaccaaccgctcgcggaagccctcgacctgacgttcggccaccgcatcgcgcatctcgccgaacgacggcagcccggagacatgcagctgcagcgaggtcgattgcggcgtgggcagccgacaggcgcccaaggccaggttcaggccgacgccgaacacgatgacgacgtcgtcatcggcatcagcatcagtaccggtaccggacgacggcggaatcaccagttccgagagcagcccgcccagcttgagcccgtggcagaacacgtcgttcggccatttgagttccagcgagcagtccggctggttcggcgcggcaccgtattcctcgatcatgccgttcagggcgtccagcgtgaccagtccggcgatcatctgcagccagccattgacggattcgtcggtggcgatcgcgcgcggaatgcgcacggcataggacatcgtcgagcaacggccgggctgactgacccacttgtgaccattgcgcccacggccggcggtctgccggtcggcggccaccacggccaccgccagttcgccatcctggtggtcgggcaacgtcaacgacccgtcgccaatcatctgtacggccagcgcgttggtcgaatcggtttcgtccacggcgaccacatgatctgcgacggctgtagttctgggtagctgcggcgttgcagctttcaacgcaatcatcatgggcactacgttacctcgattttggcgcgatatgcccgcgttattccatggaaaagcgcgcaaaatcaactattttcacccacatagcccatgttaacgttcacaacttcggaaattccgcattcgccgaccccacgcatgcacccggccgtcatattggcttgcgaacaatggcgatgcccggcagacatcgaatatcaaccgttgacctgtgcggctaccatatattgtcatgacgtcaccagccaccgcgaagcttgccgccgtatccagccgccagtcccacccgcatcttgcgcgcgcgggcgctgccgcgcgctggacactggccgtgctggccggcctgtggcttgcactgtgcacggcggtcggcccgctgtactgggacgaggagaacggcaccctcgcccattggaactgggccaataccgcaatattcgtcgtgtcattcctgatatatctcggaatcatcacgctgatggtgcgattcgcagcaggccagcgcatactgccgagggctatcggcgagcgactacgtcaacatcagcggattagcgaaacatcacggcccgccgccgatcagcaggccagccaaccagccaagacccgtcgtaccgttcgcgctatcgtcacgtccaccgtcactgttctggaccgctggatcacacgcggcacgaaccggttctggaagcttatgctggtgttttttgtcggctggctctgggtgccgaccactctgctggccgcattcggtgcggacctccgctcacagatccgtgaattcagctgggcctggaaccagtggaccggcctgaaacagccctatatcggcttcttctccttcgtgccgatggacatctaccccactgcgcactacatgtggccgtccgatcccacgtatctgaccgaccagcacaatgtggtactcactgtgttctatggcgcgatggtcacgtttgcgaggcatctgaccggctcaaacgatgccggtatcgtgacgttggctgccctgcagacgctgttcgccgtgttctgctgcgctgccgccgccaatcgattcctgaaccggccttggataggaaaaacggcaacggattccgccgctcccccacaggccggaggattggctcgattcctgattctgctgttctttatggtctgcccgctggccgtgttttccactatctccatcaccaaatcgccgctgttcgcgttctcgttcgtctggtggttcagcgtctggtatgaactcgtccagacctggcaccccgccggcacccgcaaacatcctcagacccctgccatcgccacgcccgtccacttgccgcgtcacagtttcatcgcctttatcctggccacgtcggtaatgctgatttccgcgaaatatgcgtggtacatcatcgccctacaaatcgtgctggctctgatcgccgaccgcaagcgctgggcgacttacgtcgtggcgctgctcatccccaccgtactgattcacggcggcatctccttcgccatctcctctggcgcgatcatcggcggcgacccaatcgaaagccgcggcgtacagctgcaaatgatcgcccgcgtggcccagcgcaatccggacggcatttcagacgaagccaaaaagaacctcgcgcccgtcttcaatctcgatcagatggccgacgcttactcccagcaggacgccgacccggtgaaatcctccggcattcaggccaagaaggtcagctacaagtggcgcacggtgacgcccgaggatatgaccaatttcaacaaggcatggttcgaaatcgtcaaggacaatccaatcatcgcgctggatgcgttgctggccaaatgcttcggatacttcaatgtgaacgatcagccgtacgtatcgatggattattacgtgaccagcgattacgtgcagaaaaactccacatggatcaaggattacaaccatgactggcgtgagcacatcgccggcttcactcgcgtatggggcggtattcccgtactcggctggcctacgcacggcaatttctacgtggtgatgacattgctgatcggcgcggccgaggtgattcgccgacgttggctcaccctcatgacccatattccgctgctactgctgatgggcgtgatgatcaccgcgccggccaataatttcgagcggcacatgttgccggttgcgtttgtattcggattcgtggtgctgacgtattggcgagagtctttggctgaaaggcaacgccaatcagcgacgctacactagtgactatgtcagattttctcgaacttcttgctgccgacgttgccgattcgtccgcacccggcatcgccgcgaccaaccgcgtacgcaccgtgctgttcgagtgcctgttcaatcatctggccgacgaacgagtggagtccctgttcaccatcctcggcttcgagcatgacttcgattgttacgccatcgccggataccctgcccggtccgccgcacgtacggccaaggaaatcgagaaaatcgtagccgatttcggcggtgtgtgtctgaccgccaagcgcccgatcggcaacagcaccgccgtagtggcgttgattcgtccggtcggtgcggccacgccggaaatcatctgcaataccatcgacccgtcgttcgccgccgatcggccaatcgccttgggtccgcagcgtaccggtgccgatggcgcgatgcgttcgattcaggccacgctttactgtcttcaggccgcgccggctctggccgccaccgtgcagccatcgccgcgcccgttacgcaccgacgacgccctgcccgaacgtgcgttgatcggcgacgcggacgcccgtgacgaactggtccgcgtggtctacggaagcctggcagcagcaggcccggatgatccgacgctgctcaccgtctccacattcctgaagttcggcggttcgctcgagaccacggccaaggagctcaacgtacatcccaatacgatccgctaccgtttgaagcgcgccgccgaatccaccggctgggatgccaccgacccgcgcgaggcgtacgtgctgatcaccgccatcgcgctgggtcgtgtggccgaagcgcagcggaccgcagcgtagtcgggcagaagcataaccagcagaaccgtagccggcaaaggccatagctgaccgggcataaccgtccagcccgacagcctagcgggccgaatcaggctgcctgaatctcgtgtacgccatcgtgcagtaacgcggccaaggattcttgagtggctaacacttcgtccacgaatccaccggcggacaggctggcgatcacgcgaccggactcgttgtccacaatcggtacaccaacggcaccgacacccaacgtcacatcctcatccgacagtgcatatccacgttcgcgagtcaagcgaatatcctcgcgcaactgttccacactgaccagcgtgttctcgttatatgccgggaacggcgctcctgcaagatagcgttcggcatcggcatcctcgaaatacgccaaggccacgcggccggccgcgccagcatgcagaggcagcacgcggcccgggcgcaggatcagcgaatcgatggcatgaccttgcgcgcattccacgcataccaattcagtgcaggagaccacactgaggaatgaggtcatgccggtttgcgcggtgatggcatgcatgaccgcaatcgcaggctgccattcggtacgagacgtgcgagcggcatcagccaatcgcagccagtccagtgataatgagtagttgccatccgtatccgttacggcccaccccacatcgaccagtccatccagcacgcggtatacggaggatcgcgggatatcacaggcgtcggcgatatctgccggagacaggccattctccgccgccaatgcgtccatcacacgactcgccttgtctaaagcgcgggtcggttcacgtttgtcttccgccatcgccgacgttccttccccccctgacttatccctgactcatcgtattcaactgttcaggccaagataatcaccactgtatccaaggcctcgcgacacctcgcggccggcagtctgcaccaattgcaccatgtcttgagccgatgccgttgccggtttcccatctaccagacaggccagctcaggttccaaggagcgggaaaggctactcagggcgattgccgcttgaatctctccggcgtgattgaataccggtacgctgatagtcacggagccggccatggtctggccgacgtcataggtgaagccgcattcgcgtatatgacgagcctgtcccattgctgtggcacgcatcgtggagaatgtgccgccgagctcgttgttataggcatagtgttccaacagctgctcgtagcgagccgggggaagccaggccgtcagtacatgagagggagcgctcatgctcagaggcaagctattgcccaccagctgtgcatagctttgcaatgcctcacgggtgcgtgtctcgatacacaccgtgcgcaatcgcctccgaacgaacagaccccagatgccgaactggccacgatgggcgcggaaggtacggcgagcgatctgctgaatgtccagtctgctttcgatttggccgccgatacgtacgcaatcgatgccaagccgatactcgccacgattgatgccgcgttccacccaaccgactgcggcgagattatccagcaaacgatacgttgagcttacgggttcaccagtacgttcgcttatggtttttgcagtgcttggtcccagttccgccaatacatcaagtactgccttggatttcaccaatgcatctacgctacggtcatcacggcttggcgccaccatgcgcgtcacctcctggcctgtatgttgatacctcagccatcttaccgggtattcagcgggttgccgcccaaaacgcactgggtcccggcaggagtatcccgtcggggcccaagaggtttctggctcccctctttgagggggagccgtccgcgcggcggaccgggggaggtccgagacgctaaggcccaaggacgcgagaaacaccccgacgcgcgggtgtcctgatatggggaaagccccttggggcgtgtgctccgaggggcttcctgtacgtgtggtgcggcggcgtgctactctcccacaccctgtcgggtgcagtaccatcgccgtgccaggccttagcttccgggttcggaatatgagtacatacgctggtacaaccacgagcgcatcaaacagtcgcttggttggatgagcccggtacaataccgtcaaagccaaggaatggctgcgtgattatctccaagaaaatgtccgcagccccttatccattgccgttctgggacaggctgtaacggatcgccacctaggtcacgctctcatcgtccgcgtcggtcatgccattcgctgtaggaaatccctaacgattgaatcccactgcgcgtcggtcagaatgctttcgcccgcgcgtcatatgagccattaggccgatatactctgagtataccaattccatgaagtagcgaggagaacaggtcatgccgactttggaatggatgggaaagaacaaggtggtcgcctaccaccgtcaggtgccgtaccgtgttcttgaccgcgttcctgaaaaaagcgtcctggattcacgtggatccgattgcggtatattgttttttggtatttactgatttcagtatttccgtattccggtattgcttatttgtctacatttttttggtaaacgtagacttcgtcattaactggaatgtatcccttcaggattttatccttacgaatttccttcccgattatcttgggcgaataggccagtagataatcaagagtcgcctgatacggttcgagtatgaagatgcatcggctcagcgactccaagtaatgaagctgctttctgcattccctcttattgaaccaatggcgccatcttatcgagaacttcttttgctcactctgtgaagagtcatagataagcggaaatggtaatggtttcaaacctggttcagccattccgttgcgaaaatacttatgccacttgcgcgacaatgaggggaatctgattttaatccatgctctttgtgcccaggttggggatacgcgtgctgccggaagcgttataaaacattcatcgtagaatatggaattcttatatatggcttcccatatcggcatacgtccttcagcgtctttcatggtctgattaactcggtcagcccatttgcggaatttctcatatacagaagaggccaacccgaggaagaaaccaaacagtgcgctgaagaaattctggaaaaccggattcgaatcatctggaatcaagaaaatggcaatcaggcaaatggcactcagcccgacggcaatcgcggccgtcctaatgcggcggatccgtcgtctatagaaatccggattcatattcagcaacttgcccaagtcgttaatcaaacatcccgaagcggactcaggatacacctttatatcgctggctgaatccgcggtttggtttcctccatcggtgtcatgtctatcgaaaccgtccatgccgaatactgtcttgtatgggatgggattctccttaccgagataaataagcgaaaccatcatacataactttctgattgacgctcattccgtccaaaacgatataagcagtctcaaagcgcgatcaccatcggttcgcgggtcttctcgttcatcggtttctccttgtctcggttttccagtgtttccatatcccggtttttcggtatgtagttctttcggtatttcggtttttaggtaaaacggtttcccggttttcaccggttccggtatcccgctccagcaggatcttcctgagcctttccacctcgtcccggagcttgccgatctgatgctccttctgggcgatgacggtgcggtggcgtgcctgacgtgtcatgcgtggcatctggcgaaaggattgcgactggaatgaaggactttaggagcggaatcaggcgcggctccgtctaagggccgtcggttttgctagaatctaaagagaaaaggaggtgcaatgttcggaacgatatctgaatccgagatgcgccgccgcacggagaacgtcggactgtcggtgcagtccgtgcggctggaaggcggtgacgtgacgagggccttcatacgcgatgccggagaatatgcgcgggggagcatcggcagcgccgagcttctttcccgcacccgtcgccgttacggattggagtgacgatggagcgtgtcttcgatccctacctgattccaggaacgaacgtgctgcggaactttgtgggcgccacggacgaggatgcgttggcggctgcggagaacgatctctgctccgcccgtgccgccattctgagagaggatctccctcctgcggaggggacgctggaacagcttcgccgcatacaccggttcctctttcaggacgtgtacgactgggcgggggagatacgaaccatcgacatgggcaagggcgagggacttcccttccagccattggagctgttcagcatgggggttcgctactccgaggaggtgcttcgcgccgacgatcttctcaagggtctcggccatgacgaattcgtaaagcgtctgagcgtcagctacaacaacttcaacatccttcacccgttccgtgagggcaacggacggacgcaacgcattttctgggagatcatcgcgcgcgaggccggctggcatttcgactggggactcatcgacaaaaggacgaacgatcaagcctcgatcgcggggatgcagcgaaacgatctgcgtcctctcgaggatatgttcagaagaatcgtcaagccgttgtcagaaccgttaaccatgtcgaatgatctggcccatcttggtgaatatgcgcaaccggcgaacacggcatacgacatgtctcccgcacagagacaacatgtgtgcgagcattactcctatcagcgtgccatcgttcctccagggcaggaaaagccgaaactcaggcacaggtcgagatgattttcggataacgcctcacgtatctaagtgttgcgacggcagatgccgcaacgcttagatgcgtgggcctgttccgtttgatgccggtctccaccggttttggtttttcattatttcggtttttcggtttttcggttttgggtatgcttatccggactggctccgcccgtctccgtcgtcttcgagctcttccagtcttcttcggagtccggcgacggtctgtcgcagctggtcgatttcctcttccttctgggctatctgcgccttgatgccggccggatccccggcggggagatattcgagcgccagtcgttcggcgacgtcgcgcctgtgtctcggcaccacgcgttggtagcatcggacggccacgtcgacgtccacatggccgagctcgtccatggtctcgcgcagtgtgccgccctggatcatgaacatcgtcgcgtgtgtcgcgcgcagggagtggaacgtcacgtcctcgcggttgattcttttcctcgcggtgcggaactgccgttggatcgtcgtcgggttcaggacccgttccgggtgcctgatcgcgtggaagagcatcgtgtcgggatccctgtcgggacagaacctgtcgatatgttccctgatgagacggcagaccggtgcggggatgggtacgactcggtggctttccggggtcttcgtctcgtcgagccggtattcgcccagatcgtccggaccttgcgtcacggaatgccgcacgtacagcagtctgtggtcgaggtcgatgtccctgagttgcagtccgcagacctctccgatgcgcagcccgcccaccagcagcgcgagatggatcgacaggcggtagtattccgggaagccctcgaccagcgtgtcgatctcctgcctggtcatcggcgcctgctcgcgtcttttggacggtctcttcctcgtgacgagattgcatggattcgaggacaatagcggcggacctccgtccggctgccgctcggtcgcggccctcatcaggcgcttgagcagccagaccgcgtgctcgagcgcggagggacgcacctcgtcgcatgccttcgcgtaccattcgttgacgaattcctcggtgatgtcgcacatgggcgtctcgccgaaccaggggagcagtttgtccaacgccgccttctggatccgcttgcttctgccgctcagctccgacccgtccttcttccgcaggttggcgacgaaacgcgtcgcgtatgaggagaacaggaccctgccgtgcatcgtccttgcagacgggtgcgtccacctgcggattccctttttatggtcgatgacgagcgcgtgctcctcgtcgagccagcggtacgcctcggtctggaattccaatccgaatcggcggtagattctttgcctgggattgacgggactctggtatcgggcctgccaggagacgatccttccgtccgcgtccttgcaggcgacgacgcatccccatttccgtcttttcctgtctccattggacatcggttgttttgtctttctctacttcttgaaaaaccattagaagaaagagtaattgcctacgccggtgattttgaataaggtgctatccttcgaccgtggggattctatctttcgggaaaatcgggattgttcagggctcttggagtggttttgactggaatttcaacaatcttcagtgatctgtttcctgatgtcacatcccaaagaagaagcatcatgcgcatgtcaccttcggacatgcgcatgatgatggtagtcatggctccaagtgtctcatgggcttgagaccgggcggtgggtgcatgagctatgctccttgtgggacctgcccggttgtgaggactactctcgggagagacatgatgttcggagcggttatttccagttgaatgtgtagctttggtccggctgttcctcaccatgggtggtgacggtcgggatgttgccgtgccaggtgacggtgaagttgcccgagcctaatgatttgccgtcgttgtgcagatccgttttgatttccgtgacgttctcggaaccgataacaccgggatcggtgtcccaagagactttgaccgtgatgctgcttggaccgaagaatatgggcgagccgagttcgctgatggtcacttcgcaggtgccgtcagcggatttcgcgttcacgatgcgatgcgacatatccgtttgcatccatatgagagtgcagcctccagcccagatcagcgcgattgcgagaatgatatgctcaacgatgtgtgccgctttatgtgagtatccttcggtcataaattcccacgctcgtgtcatcatgccatagccttcaaccggagccttttcatcggtcgttgaaaagatggttggcgatatcgccccgaccgccgaagccggacggcacgtcacccaaagagttcttagcgaagtcgaacaatcccatggtcatgcctctttacctttgggaaaccaatatgactaccgtatcagttgtcggcgtcatcgccgaggcttgcgatttgcggaagtggcccatatccatgcatcgcgtcatgaaacgggacgccgtctcgcgcgtaattcgtgcctgtagaatctttaaagaccaagtttggagggagcggaatcatgccacgcaagctgatcatgtgcggggaccatccggtccttgcgttcgaatacgatcccgagtccggtcgcgcgtgctcctctggcgaggtccttgaccatgatcgtctgcccctggagttcaccacgcacggcaagagcgcgctgtatgccaagaggatcgacgaatggtggaggtcccgcgccatcccctccacccgcgacggcatccgccgcgtgctcgaatcgcttggcgcggcatcgaccgacgaactgctcgacaggacctacgggctgagcctgtcggaccagtactgggtcagacgcgaggacgacccggccgaatggaaggacgtcaacttcttcgacaattccttcgacgaggctctgggcgagatcctgctcacctcgtactcgtcgtcccatgacatcagcctcaacgtccccgacgtgtccactggcggcgatcttcccaaacgctggacgatcgacagggccaccggcaggagactgctcgtcaagtcgggccgtactggccaagagccgatgaacgaggtcatcgcctcgaggctctgcatgcgattgggcgttccggccgtccggtattccctggcacgcaacggcaaccgtctggtgtccacatgcgcggacatgctctccaatcatgaggagctggtctccgcctggcaggtgctccaatccgtcaaggccgtcaacggcctcaactcgcatgaccagtggatccgcgccgccgtcggcttcggcgcagacgaacgggcggttcgtgacgccacggacgattggctcgtggtcgactacctcatgcgcaatacagataggcattacagcaacttcggtctgatccggaacatcgagacccttgcggtccgtccggccccgatctacgacactggcgcgagcctgtggagcggcgagctcgacgtggacggccgcgactggttcgccaagccgttctacaccgcgaccggcaagccctcggctttgcggcagctcagactggtggaggattggagccggttcgacctggatgctctgtcggactggcccgacgaggtggcgtacgagttgtcgcgcatgcgcatgttcgcgcccgaacgcctcgacgccatccgggtacagttggtaaagcgtatcgggatgctccgcagaatcagcgaaggtgaggtccttcgtgtttctgacccgattcgcaataaaacggatttgatggacagattcggcgagacgttgcggaagaaccttggacaacgggacggggatgccagaagcgtcggaaccggaccggatgcgttgagccgtcatctgaaccgctagcgcaacgaatcactactggaataatggactttgcaaccggaacacgaaaagaggagcatgatggccaatcccgagctgtcacggcacatccaggcccttcccgacgagctgaacgcccttgaagggggacgggagatttccgaacacctgcggagggtcgacgcgctgaaggaccgggcccgctcgctggagccgttggacggtgtcgaggacatggcgttggcggattacgaccgcgactggctggtgcgctacacctacaactcgaacgccattgagggatccacgctgaccctggaggacacgtcgctggtgttggagggcgagttcgtcccatcggactcgccggccagatacgtgttcgcagcgcgaggggtcgctgacggcatggcctacgtgcgcgaatatgccaaggaggggcggaagctgaacgaggagctgatccgtcgtctacacgaggtgaccgcattggatctccagccgttcgcccgcggcacgttccgtccttatggctatttggcgcggatcaccgccacccgagtcaagaccgcggacccgctggagatccgcgacgacctgcgatccttgatcgacgggttggatggctgcgcagcgcatccgctgctcagggccgccggtttccacgcgatgttcgagaacatccatccattcatggacggcaacgggcggaccggccgccagctgctcaacttcgtgctgctgcggaacggataccgtcccgtggccatcaaatacgatgcgggtcggtcatacgcgcgaggcctggaggcatggcaggtggacggcaagccggattcgttctgctccattttcctagactgcgtggaacaggaggaacaggcgctcgtcgatctgatcgagcggcttcgccatctgagataggtcgcaggaacactcgcatgcttctttcgtcgtcggtaagccgctgatatgcacagaagaatgagattattcttgggtgcctgtaggtgcctcgtggaaaacgagcgtaaccggcaggtttcccaaaaatcgaaaaccttggaataaagcaaaaaacagttggctaggattatcatgcggggtgcgcatgatgatggtagtcatggctccaagtgtctcatgggcttgagaccggggaagagacgtgattgcgggaatggcgcggagagctgggaatgggcgtgggcaatagccgggacaacatgccgcagcgtgaagcgtcatacgagttgtctcgcgatggccaacgcgccggcaacgaccatgagcgccgagaagacacgcagaagagtccttttgcgttctcttcccggtttttggatccgatcacgacggatatcaggactaatccgacggccagcggcaccaaggccagcggaaacagcggtttttccatggcatctcatctcgaacgctgtggctcagatttttcgatgttcggtttttctgcgcttgctgacaagagccatggagcagcatgtcgatacgcacagattcactatgcaggtcgctgctggcagtagccgtatgaacggctgactgtagaaatcgaggacatctggatccatagatcctgagtatatttcaaaaaccggatatgatgcgagagccggcgccgaactcacgaggaacagtatccaaatgacgggcaatctcaggatggatactgttcggcctttccgatggacttctttcgagaacatgaaaagagcccaagaggtcactgcgattaatgcacccgcgcaatacaacagaccagggaactcgctacgcatgattccgtcctcacttcagtcgcaggtaatttggcttatcgatcttctggctggttcgagattaccatacctgacatggcagtcgaattgcccgttgtctattggcagagcatccgactgttaatcggacggtcgctggttcaagcccagccgcaggagccagacaaaaacccggaacttcggttccgggtttttgttacccgccccccgaaactcctttatcaaggaatcatccataagggatgccgcagcagacggtctccaaggcgtactacaccgtgctcatccccatggacgacggcaactggcacgtcaccgtgtactgtcccgcctcgctggacggcccactgctcgacaaggattccaacgaattcgacacggacgacgtgaaacccggcgacaagtcgtacaccgttgccaatccattccacctggatcacgcacccggaacagacggtttcatcttcggccctgacaccctccgacgatagcgatggactaaccattcaaccgcacgcgtaggaggagcgcattccaaccatgaatgaatgacatatagacgtcaagggcttgcggacatcgtgtccgcaagcccttgacgtctcaatccaacgaaatatcgacttttacccgtttgtcggattcaggctttcgcgcaagtccggcgatgaggagggccaccagcagggggatcgtcgtcagtgtaccccaggaaatcgagaacgtgtcggcgatgtagccgcacagcggggtgacgaccgcggtgaaggccatcaatacgagcgatcccacggagaacgcggtcgcgcggatcgaatcgtcaatgctctcgtgcaagctgctggagatcgtgttcgccacgtacatctgcgcgcaggagaacacgaagaacgccaggatcctcaccgccggcatcggcgtggccgcaagcaccaccgccgacacgatgagcacgaggatcgcaatgtcgccggaacgtggatgcagccgcagcatacccagacgactgccgacgatctgcgcgatattagtgaacactaggccggcgaactgccaccagaccccggtctggtggcccatcagcagcagctgccagaacgtcagcaccgacaacgtacccagattgaacaccaccatattccatatctccggcttccgcagcagcacggccgcggccgccacggtctgcctgacatgatccaacaccgtcagcgaggtcccggactcgcccggctcggcggatccatcggattcgacggacgcctcggcctgccgttccgtcgtcccgctcccatccgtcgctgcggccttggtgcgcgacccggccctcatcagaccgagaagcgggatgatcgccaatacgtagaacaccgtcgcgcccagccagatcagctgggagtcaagcaggaacagcacggcaccgaccgcaccgccgcatatcgtgcacacaccgatcatcgccgacagtcttgacaccaaggtcttcatacccagcgagggatcgtgcttgctggcgtattcgatgtacagcgaggacgccgcgccgctttcgaccgcggccccgatgccggccagcacgttggccaggcacagcacggcgaagttcgtggaccagaacagcatcaatatgaatcccgcgacgcggcacaacacgccgatgatcagcgtccgttcccgggaccaccggtcgaacagcacggacgtgggcagctcgctggccgattcgctgacgtcgaacaccacattgacgatggagatcagcagcaccgacaggcccacatcatgataggccaccatatagtagaccgaaaaacatccggcaccaagataaataagcgcattatacaaacaggcaaaccgaaccatcaatcattcccttacataaacaaagaaccggtatacgtgggactgtctctcgaagtgtgtaactggccttaactggccggtcgtgtggccggtcggaaaggctggtggacgatgtgtgctgggacaaggggaaacatgacaccgacgaagaagccggacgcggaaaaacgcaacgccgagcgggaggcggcgctcacattcgtgcgcatggccaaggaaaaaggactggacctgacagggcccgacggactgctcaaacagttcaccaaaagcgtgctggagacggccctggacgaggagatgaccgagcacctgggccgcgccaagcacaagaaatccaaggacggcagggccgcgaacacgcgcaacggcaccaccgccaagaccgtggtcaccgattcggtaggtccggtcgggatcgaggtgccgcgagaccgcgatggctcgttcgagccggtcgtcgtcaggaaacggcagcggcggctgcccggggtgggcgaggtggtgctgtccctgtatgccaggggcctgaccaccggcgagatcagcgcccacttccaggagatctacggggcggacgtgtccagggagaccgtcagtcgcatcaccgagcgggtcgtggccgagaaggacgaatggtgctcgcgtcccctggatcgtgtgtacgcggccgtgttcatcgacgcgaccgtcgtcaaggtgcgcgacgggcaggtcgccaaccgcgcgttctacgtggccgttggcgtggatctggagggcggccgcgacgtgctgggcatctggacgtcgcccgccgccgcggcggcggcccgcgacgcgatgctggacaagtgggaggcgagatatcccgcgatccgcaggctgtggatggacgcgtgggaacggttcataccgttcctggactatgacgtggagatccggcgcgtgatctgcacgaccaacgccatcgaatcgctcaacgcgagattcaagcgctccatccgcgcccgcggccacttccccgacgagcaggccgcgctcaagtgcatgtacctgaccgtccgctcgctggaccccaccggcaagggacggatacgatggagcgcgcgctggaagcccgcgctcaacgcctttgccatcaccttcgccgaccgctggccaagcgagggaacacaacaatgaaaacgccagttacacacttaacgagacaggcccgcgtctgggccggtggccggcgatccgctggtgccgctggtgccggtactggttgaagtcgatcccgatggatctttttgcgtcgagccggtgccggtgccgttcgaaccggtctggctgccgccgacgccttggctggtcgggtcttcggtggtcggattctttgaggtgccggtgccgttcgaaccgttggcggtgccgtcggttttcgaatccgaggcgccggcgccggtcgaacccgaggtgccgttggcgtcgaggtcggtggagggggcgtcggttttcgaatccttgctggttcccttcgaatcatcgccggtgcccgtctggggcagagcgttgttctgatcgggggtgcccgttcgcgtgccggtgtcgttgcgcgcgggcgtggtcgtggtgggggatacgagattgtccgtgccgcgtccctgcgtggccagcatcacgacgccggccgtcaccgccacggcgagcaggccggacaccaaggtgacgatcatggcggtgtgcttcgaagcgcggaagcgggacttgcgcagctcatcgaccgagtacgtcctgccgttcgcccggctgaacacgatttcacgcggtctgcgtgtggaggaagcatcatcggcggtcacgcccgtcgccgtatcgggctcgtcccgaacgtcggtccggctgccggccgttcggggggtgccgccatcggcatcgccgttctcggcgtccttcgtgatcccgttgccggaggacgaggccgattggagtttttcgccggaggcggtgagcacgttctggtagatcttggtggccacggcggagacgacgtaactggccgccgctccgatcaccgaaccgccgatgccgatcttcgatgcgagcaggaacgaggtgacggcggcaagggtgcccgccacgatggatgagagggagattccttcaaaaaacttcttcacaatgcacgaccgtagggtgtcgggctgacaggttgcctgagactcgatggaagcggggcgaggcctacacgagaccttcaaaatcggccttcgtacaggtcggacacgccctgcggcgcacacacgtgcgtttcgcgtcgccgcaggccgcgggacatcgtcaattacgatgcagcgactgcccggtcggtctgattaccgacatcagcacggcgacgaagatcagcgcaaagcccaccagcgaagtccacatgattgtctcgccccagaacagcgcggagaacgtgacagcgaacagactttccgtacacatgatgattgacgcctgcgaggcaggcacgtgagccagaccgatgttctgcatgatctgggcactcatcgtggcgccgaggaacagatagagcacgctggccactactgagggtgccagccagctggcgttcggcatgggttcggtgaacaacgcgccgatgatgaacaatacgccggcaacgccgaactgcacaaaagtgacggcgatagggtcgaagcgtttggtgtagacaccaaggcaggtcagattgaacgagaagatgaccgcggtggcgatggtcagccagtcgccggcactcagcgacagcgaaccgcccggcttcagcgagacgaagccgacgccgatcagacagatcacgccggcgacaagattgatggccttcggacgggtttttgaaataatccacgtggcgaacggggtgagtacgcagtaggcggccgtcaggaacgcgctgcggcccggttcaatggtctgcaggccgatggtctgggtgaccatcgttccccagtaggtcaggcccaccacgagcgccggcacaatgattttcggcgtcagatacggcacgatgtgcttatggaacaaggccagcatgcacaggcaggcgccgatcatgcgcagacccatcagccattggggcggaatcgcctccatggcgaatttggcgagcagatagctgccaccccataatgcagcgcagcccagcaacatgagtcgggcgagattcgggggaaagctgcgggaccagcggctgcgcagcttgttgaaacgttcgatcaaacccatggtgcacctcaggacagttaggaaaacttgtggctctctcggctcacagattacgggaactaccggccaaaatcgaccggtcgatgggcgtcgggtgtgtgacaggtgcgcggccggggcgcggccggggcgcggcatcgccaagcagataagaaccggatgaaagctgtgcgaaggtgaggttactcacagcgaacatccgggctagtcgcgctcgaaaccggtactctggaaagagtaaaaatacgttgtccatagcaatcatgaaaggattcgacatggcagtcattactccggaaatcaaggaattcatcaagaacaacctcggttggatcaccaccgtctccaaggacggcgaactggatctcggcccgaagatgtccctgttcgtgctggacgacacgcacatcgcctaccacgagcgcaccgccggccagcactacgagaacctcaagaacggttccccgctggtcatcgctttcgccaacctcgagaagaagcagggctaccgcttccgcggcaacgtggtgctgcacgttgacgacgacatctacaacgagcaggtgaaggtcgccgaggaaaagggcaccaagaagccggccgtgattccggttctcgaagtcaccgagatccaggaccttgcctccggtccgaccgccggcaagaccatcgccaaggactgattagctgacgtattggtggcttcctcgtcagagggagccattttttcgctttttagtgcgcagtactaggtgacggccttgggcgtcggtggtggcgaagaggtaggtgttgccgccgtccttgagtttgagttttttgcgtagctgggccacggttagggggaaattgcgtacggcgatgttggcgtgcgtgaggccggccaatagttgcttcagttctttcttgttcatggtggcgatggattcgatggcgaatgacctgcctggaaaatcggcaataggttcggccgccacgaacaggtggctattcgggctgatgtgatgcacggcgaagcgctgttcgagaacatcaaagcatccggccttcatgattgaggcgttgggctcgtaaaggtacttccaatgcgaggaatcgaagtcgttcgcgctttcctcagacggggagtcttcggtattgcaagtattgcgtgcagccaaggcagaatcgctgatagtggtgtgattgtcgctgttatcgccggccttgtacgacagcacctgcccgtcattgacgcataccacgagcggtgaggcgcaacggccgcgccccaacaccaacaacaattccttgcattcattcccggtggagacgatatgcacctcatgcaccgcgccggcgaaatcggcgacggtcttatgccagtcgagcatgggggagagcttgaccatgaccgtcggtgccttggccagcagcgtatccttcagggtcagcacatccggcgtgcaatcggcaatcgcgtaggtacgcgagccatgatcgtcacggcgggccggatcgaggaagatcatggagactcggccaagcgtatcaagcactgctgttgaatcatcattgatgacttcggcgtggccaaggccgagtatcgggaaattatggcgagcgataccacataaaatggattgttgttccacatatatggcatggtcaaacactcgggacatgtaagaaaagtcgacgccgaaaccgccggtcagatcgactagggatgtcggggaatcgtcggcgtcgtcgactgcttccccgtccaacaatcgctgtgctaaccgggctttgtattgagccgtgaactggctggaacattgttccattgggacttgcggcgggaaaatcagcccatcatgggacgcccagtcgggtagcttgagtgaagcgcgctgccagccggcaatttgctccagcgcgaacggcacatccacgtcgccatcatgcttggcgtgcaaggccacatcacgcacatcttcacggcggtgtttggcgatgaacgcccaagtcgactcagaaatctccatgccgccattctaggggttgtgctgagatgagtatggcaaaccgcaagagaacgaggtggcgaaaaccgatgatcgatgaagtgatgatgctgcgtcatggccgtacgcaatacaatctcgaacatcgcttgcaaggccagatcgatgtgccgctcgacatcgtaggccaatggcaggtcgaccagaccggattcgcgctcgcttcacggtattactgggccaaggtgaaccgacttgccgaacatcccgaagccatcgcccagcccggtcctgacgccgccgaacgcactgatacgcgccagttcgaggaggctcccgccgccggccggcgcatggtggtgatgacctccgacctgttccgtgcccaacagaccgcacacgccttcgccgatattttgggattgccagtcacctgtgaccaacgactgcgtgaacgcagcttcggcgagtgggaaggcatgacccgcgccgaaatcaaagccgtggcagccgacgactacgcctcttggaaacagcacactgggggcgaaaccaagcatggtgtggaaagccgtgccgccgtgggccagcgaggtgccgatgccgtgcgcgcactggtcatcgactccgcctattcagacagcacgcccaccacgctgatgctcgtcacccatggctcatggattaccgccgccatctccaacctgctcgaactcgacccggacggcatgaacgcactcggcggcatgcgcaacgcctgttggtgccggcttaaagtgcgccacagcgtcaacggcacccccaccgaacagccactgtgggagttggaggaatacaacaaggctcccgccatcgccgacagcgccgactgggagaacgggccgaccgatctgcgaggaccgcacatgccaagttggcagccaatcgtctggtgatggtcgttatgcgaaaccccgctcgcaaattcgaacggtgggtctagactaatctcggtttggaaccgtacagcgatagaacagtaagaaagcgcggaaggcgggtgagacgacatgctgagaatcttcagctcaatcaatggccaagtggagcagatcgagaaaccggaaaacggctcctggttatgtttgagcgaacccactgatgtggagctcgccaccgtcgcctcgcaaaccggcatcgacctggccgacctgcgtgcccctttggatgacgaggaacgttcacgtgtagacgtcgaagacgattacacgatgatcatcgtcgacattcccaccgtggaagagcgtggcggacgcgactggtacgagaccatcccgctgtcgatcatcgtcaccgaaaacctcatcatcaccgtctgcatgcaggacacgcccgtgctccacccattcatggaaggcacgatccgaggcttcaacaccttcatgcgttcgcgcttcatcctgcagatcctgtaccgcaacgccacgatgtacctgcgttacctgcgcatcatcgaccgcgaaagcgacaagcttgaactgaagctgcgccactccatgcagaaccgcgagatcgtgatgctcatggagctgagcaagactttggtgtatttcaccacatcgctgaaatcgaacgaaatcgtgatggagaagctcaccaccctgcaacgcatcaagcaatacccggacgacgaggacctgctcgacgacgtcatcaccgaaaacaagcaggctatcgagatggccaacatttacagcggcgttcttgcgaacatgaccgacgctttcgcctcgatcgtgtccaacaacctgaacaacgtgatgcgcatcttcaccatcatctccatcacactgtccatcccgaccctgatcttctcgatgtacggcatgaacttcgatggcggcatgatgggtatgccgttcactgacaagccgtggggtttcatgctcattatcgtgatttccatggtgctctccggtgcggttgcctggttcctcacgcgttcgcgcatgttcaagtaaggcgtttgacggttatgcaccactggtcatcgttcgccagccgtagcatgctccgcgctcgccgtccgatgcggcgcggatttcgctcccgactgatggcaggattcgccgcggcctttggcgtgatattgccattatccggtctggccggttgcggccaaattcaagtcaccaccgtctccggagcgccggaggggcccaccatcgccattggggtcgcagccgacgagccatcggtgggagcatggcatgacggcacataccagggcttcgacatcaccatcgccaaatacgtggccgccaaactcggctatgcgaacaagcagatcgtcttcaaacaggttcgccccgaaaaccggcgctccatgctggacaatggacaggtcgacatggtcgtcgcctcttggcctatcaccgatgagtccagcgcgatcgttgattttgccggaccatacctcacgaccagcgtcggtttgctggtcaggtcggatgagcgtggccgattcaccaatgacgcaggttcggtgggtgacgtaggcgacggcacggtgtgcgcagtgaaaggtgacgagacagtcggcatcttccgcggcaaccacccgcaggcccggattcaggagcgcagcagttatgcgcagtgcgtcacggccgtgcaagtagggtcggcggatgccatagcctccgatatggcggtgctttccggtcttcaagcggccaacgggccccagtatatggacgtgattgcggacaagggcgaggtcggttatggcatcgccgtgagtcaaggcaccagccaattggcgcagaaaatcgcggaagcattggaagacatggttgaggatggcagctggacggccgccaaggatacgttcacaagccaaacaaagctcacggtttcgctgaacggcgaccccaaagccatcgtctcggatgctgaataacgattgacgacgtgtccagttgcgaggctaccttgctgatttatgagtgacaacgagaagagcacgcaaaccgaagagcccaacttccgctacaacgccgcactggcgcaggacatcgaaaacaagtggcagaagatttgggacgagcaaggcaccttctgggccgccaacgtcaacggcgatttgaaggacggcaagggccgtaacgccgaaggccgcaccgcctacttcgccatggacatgtttccctacccgtccggcaagggcctgcacgtcggccacccgctgggctacctggcctccgacgtggtgagccgctaccaccgcatgaagggcgagaacgtcctgcacgccatgggttacgacgccttcggcctgcctgccgaacagtacgcagtccagaccggccagcacccgcgcgtgaccactgaggcgaacatcgccaacatgagccgccagctgcaccgtatgggcctgagcttcgacaaccgtcgtacgttcgccaccatcgaccccggctacgtgcgctggacccaatggatcttctcgcgcatctacgattcctggtacgacgaggacgccaccaacccgtccggctccaagggctccgcacgcccgatcgccgagctcgtggccaagttcgaatccggcgaaaaggccattccgggccacgagtccgatggcaagcagtggtccgacctcactgacgccgagcagcaggatatcttgaacgacttccgcctggcctacatctccaagtccccggtcaactggtgcccgggtctgggcaccgtgctggccaacgaggaggtcaccgccgaaggtaagtccgagcgtggcaacttcccggtcttccagcgtgagctacgccagtggtccatgcgcatcaccaagtacggccaccgcctcatcgccgatcttgacggcatcaactggcctgagaaggtcaagctcatgcagcgcaactggatcggtgaatcccatggtgcctccgtgcacttcatcgtggccactgccgacggtgacaaggacatggaaatctacaccacccgtcccgacacgctgttcggcaccacgttcgccgtggtttccccggaacatcacctgctggagaacgtgcccgccgaatggccggccgatgtacccgaagactggaagggcggctatgccaacccggtcgaggcggtgaaggcctaccgtctggccgccgaagccaagaccgccaaggaccgcgtgaacgaggccggtgagaagaccggtctgttcaccggcctgtacgccaccaacccgatcaccggcgcgaagctcccgctgtttactgccgactacgtgctgatggactacggcaccggtgccattatggccgtgcctggtggcgaccagcgcgattacgactttgccgtgaagttcggtctgcctgtcatctacaccgtcacgcctctgccggattccggcgacgacttggccaactacgagggcaaggcgccgttcgtctcccatgacggcatcgtgatcaactcctccgtcgaggccaccgaagccaagggcgacgcgctgagccttaacggcctgcgcgtggacgacgccatcgccaaggtcaacgcctggctcgaatccgccggcgtgggcaagggcaccgtaagctaccgtctgcgcgactggctgttctcccgccagcgctactggggcgagcccttcccgatcgtctacggcgaagacggcaccccgcacctgctgccggattccgcattgccgatcaacctgcccgacgtgcccgactatgagccgcgcaccttcgatccgatggacgcagagtccaacccggaggcaccgttgagccgcaacgaggactgggtcaaggtcgagctcgacttgggcgacggcaagaagacctactaccgcgacaccaacaccatgccgaactgggccggctcctgctggtactacatgcgttacatcgacccgaccgacaccaagcacatggtggagaaggacgagttcgactactggatgggcccgaaccacaacaagtactcgggtgatgaaggcggtgtggacctgtacatcggcggcgtcgaacacgctgtgctccacctgctctactcccgcttctggcacaaggtgctcttcgacctcggctacgtggactcggccgaaccgttccacaagctgttcaaccagggcatgatccaggcctacgcctacaccgacgaccgcggccagtacgtgccggccgacgaggtcgtggaaggcccggccgacgcctccggcgagccgaccttcacctggaacggcgaacatgccaaccgcgagttcggcaagatgggcaagtccctcaagaacatcgtgaccccggactacatgtacgagaactacggtgccgacaccttccgcctgtacgaaatgagcatgggcccgctggacgagtctcgcccgtggaacacccgcaacgtggtcggtggcatgcgcttcctgcagcgtctgtggcgcaatgtggtcgatgagaccaccggccaggcccatgtgactgaggacacgccggacgaaaagaccctgaagctgctcaacaacacgattgccgaagtgaccgcggaaatggaaggcatgcgcccgaacaccgccatcgccaagctcatcgtgctcaacaaccacctgaccggtctgaaggctgtgccgcgtgccgccgtggagccgctgatcctgatgctcgcgccgattgccccgcacatctgcgaggagatgtggagcaagctcggtcacgccgaatccctgtccgccgagccgtggccggtggccgacgaacgctacgtgggccacgacaccgtgaccgccgtggtgcagatcaagggcaaggtgcgcgccaagctcgaagtgccggtcgacatcgatccggccgatctcgagaagcaggcgcttgccgccgtcgccgaccgtcttggcggcaaggagccgcgcaaggtgatcgtcaaggccccgaagatcgtctccatcgttcccgcggagtgacttgttgcgagccagctcccctctttgaggggagctggctcgcgtagcgagactgaggggagcgtcaaccgcccacctcaattgtggataacttcataagctagaaccacataccccgtttcagctggacaaacgcccatgaatccatcagcgtggatgcatgggcgtttctcataaccatcgcgcagaccatgccgccaaccgtttgcgcgcattcagcaggcagagcgcagccatgccccaaccgcgagtggaacggcccacgacgcctccgccgcctcccggccatgcacggatccgtccggccggccacccgccccaaagggcgcagagcggcctgcggcaggcgacccgtgacaaacgtgcgttatcggatctgattggcgtacgttccgccgatgccgtcggcgaatcagccagactcacccgggatcagccgcgattgtcgttcaccattgggcatgccttggccgtgatattgctgctgatcgtcgcccttggcatcagcttggcattgctggtccaacagtcgatgaatatggccatgctgtctcaaccgaccgccatgcagaccacgggcggctccgctggagatcagacgatgccatcgcagaacaccacggacgagaaacgcacggatccgcagcagtcggagcattccgatgccacagcgaaccccgaatcggataccacgcaatctccgcacatgcagacggacggcagcgatgccggcgcttccacgcatggtctcatcaacctcaacacggctaccgctgaggaattgcaatccatcaaaggtattgggccggttaccgctcagcggatcattgatcatcgcacggcgattggcgggtatacatcagtcgatcagctgctggatgtcaaaggcatcggctccaagacgttggagatcatgcgagggcaggtgacggtcggatgagcagggattggatactgcgcgagcaggggagccgcgattggaggatgctgccgatcgccatagtgatgtgggcggcgagtctgggagcgcacgcattattcgcatggaggatgtctgatggactcggcactggtcaggcaaaggccgatgccggagctggcattgacgtcaccataatcggcatggaatggcctgtcacacgaatattgcctataacagtggcgtcatgtgctgccgtggcggcgatgatcgtggtgtctttccgcctgcggatccggtggacgggaacattgaccgtatgcgttgcggtggcgtgcatcggcagtatgacggcaatcgcgtcggacaccattgcctggcatgatcctgcctccgcacaagctcgccaatccagttcataccacgaagtcatggccacggtgacgacgcccgtgatcgcttcggaccaacgcacatacgattgtcagacggacatacggctgagcggcatcactgtggatggtacggatgtacgttccacggtcgctgtgcgtgtatacgccgacgaatcgtattgtgggcagttgcgtcgaggcgcggtctatctgctgacaggcgtattgcagcaagcgcgatatggacgcataccactatggctgctcttggaaggaaaacagccggtagcacaggtgcgggctccgccgtggcatctcgccgcgattgcgcatgtgcaggaggcgtttttcaccgtgaccgaacaattgtccgatcaggggcgtgtgttggtgccgggattgacgatgggtgtgcttggccaggattatatcggcggcgagaccggtccgatgccggtcaacagcacgtatgcgcaaacgttggagaatcagttccgccagtccggcatcatgcacctcatggccgtatccggtggccactttgtactggtggcgggattggtgcgccggttatgcatgtggatgctgcttgatcggcggctgacggcgttgctggtctctggagtatatgtgctgctggcattggcgatgttccccagtgattcggtcacccgcgcgttcatcatgggattgataggtgcgttgacgtatgcgatggggcggcgtacgcaagcgttgagcgccctgtgctggacggtaatcggtgtattggcggtgaatccggatatgtcggccagctacggattcgccttgtcttcggccgccgtactgggtatcgtgctgtttgcggagcggctggccggtgcctttgagcgagcgatgccgcacggcatcgccgaaatgatggcgatgaccgtggccgcgcagttgttcaccctgccgattcaggtgttgatggaaccggagttgccgttgctgtccgtgccggcgaacctgttggtgtcgccgtttgtgggattggccacgatggcgggattgatggcattggcctgcgcatggtgcgagccatggctggccggcgtattcgcgtggatatcgtcatggggcacgctggtgatggaacgggtggcgttgtggctgggtggcagcacgatggccgtcatcccatggaaagacggcgttacgggtgccgtgctgattgtggcggtggaaatcggtatcggcatgctactggtgttcgtcagccgttgcctccagcatgtccgtcgttatgaggccggaatgcctggcgtgcgcttcggttccgcttggcgtgtccgcctcagtctctggtgcgaggagacgagacgtctctttacgcggcggcaagccgaatagccaatgcggtattcggtgcagcaaccatcgcaatagccagccgaacctatgcgataggccgcgcggcataaaccatcagccggcaaaactgcgatacagttgagaccagttcaaccagctgcatgaaggagtgccggcgatgatgttgtctcataatccgatagtcgaaccattcgcattggcccacgccaccatcgtcaccggagataaagccggaaccatactgcgtaacatgacgatcgtggtcggagccgacggacgtatcgaacaggttgcacccagcatcgaaaccagtatcccagccgaataccactatcttgacggcaccggcaaaatcgtgatgccggggctgatcaatgcgcatacccatctgttctcccaaggcaagccgctcaatccgaagctggcgacgcccaaaggccaacgtatggtcgccacattcgcgcattcgccattgggcaagccgtacatggccgcaaccgtaaaacacaacgccacaacattgctggagtccggcgttacgacgatccgcacgcttggcgacgtgggatatgaagtcgtgacattacgcgatcagattgatgcaggccaaatcctcggaccgcgtatcttggcgtccggaccgctgatggcgattcccgaaggccatggcgccccgcttatcgcactgaccagcggcaccccggaagaggcgcgtaccgcagtcgcgcagaatctcaaggctggcgtcaacgccatcaaaatcgccgcgaccggcggcgtaaccgatgcacaggaaatcggcgaggccggcagcccgcagatgaacgtggaacagatgcgggcgatttgcgatgaggcgcatcagtacggtgttattgtcggcgcgcacgcgcaaagcccggaaggcgtgcggcgttcgctgctggccggcgtcgataccatcgaacacggcagcgtgctcgacgacgaattgatcggcatgttccggcacaatccgaatgcgttgcgcggatactcggcattgattccgacactgtccgccggcctgccattgaccttgcttggacaggacgcgaccggcatcaccgacatccaattggagaattccaaaaacgtggtcggcggcatggtttcaggtgcccgtcaagcgcacgaggccggattgatgataggcgtcggcaccgatacaggcatgacattcgtgccgcagtacgccacatggcgtgagctggagctgctggtcgcatacgccggtttcagcccggctgaggccctgcacgcagccactgccgtcaacgcctccattctcggcgtcgatgccgagaccggttctttggaagtcggcaaatccgctgatttgcttgtgctgaatgccaatccgctggacgacctgcgcgcgttggaacacccggcactggtcatcgcggccggtcacccggtatggcgtcccgctcccaagcgtttcgcggatatcgacgccctgttggatgaggcatacgcctaatcgcggagtgctgccgggccgttatgccggcaggtcattgtccaacctgtgtggcgagatgggggcatggcgaaaacagcagcgaacgtaccggtaaccgtggtgcccggaggcgactcgtatttgaacgacgcgcgcaccaaggcactgtgcgcacaagcgttgaaggcgcgacccgacgccgaactcatcgagctcgacgccacatcggccgaccaatatgccttcgatgaagccgtcagcccatcgttgctttccgacgttgccgtggtcaaactcgtcaacctgcagaatgccgacgaaaagctcgccgaagctctggtgacgtacaccaagcaggccgccaaggatccgaacggctccagcgtggtgatctgccagcacgagggcggcgtcaaagggcgcaagatcatcgaccaactggtgaaagccggcgctcgcaaagaggacgtgccggatttgaagaaaccggatgcccaactcaatttcgtactcggagaattcgagaaacgcggtcgtagagtcgaaccgatggccgcgcagcagctggtatccgtgctcggcggcaaaaccggcgaactcgccgccatgtgcgagcaattgtgtttcgactttgacgataatccgatggggctcgaccgtgtcaaccagtatttgaccgccaatccgcaggtcaccggttttgccgtggcagacaaggccgtggaaggcaaaaccgcagaagccatcgtcatgatgcgtgcagctgtggaacaagggaccgatcccatcgcgctgatcggcgcgttggccatgaagctccgtaccattgccaaagcctcggcggtccgggccggcacgatttcacaggccgaagcgaaaaccaatccgtgggtgctgaagaatgcgatgcgccaacttggcggctggacttcggcaggactcgcgcattgcatccgtatgctcgcctgggcggatgagcaaagcaaaacgaacggcggcgacccggtatatgcgctggaacgctgcattgaagacatcagtcataaaggtcggtaaaagtcgataaaggggtatttatgagcgaacacactattgcggctcccaccagcgaggccatgcaggagctcggccgccgcgtggccggaatggtacacggcggcgatgtattgctgctctcaggccctcttggtgccggcaaaaccacattcgcccaaggcttcggcgcggggctggacattaccgaacccatcgtgtctcctacattcaccattgcccgcgaacttgacgggcatttcgccgacggcactccggctcatctggtgcatgtggatgcctaccgtctgggcggctcagcctatgcgccggggcaggacgccatcgggcgtttgttggacgagctggaatcgctgggattggacgaagaacttgaagaccccggcgagaacacggtggtgcttatggagtggggcgaacaaatggccaccgccttggcaccagaacgacttgaaatccatatcgatcgacctctcgattcctccgatgtcgcatccgctggatcagacggcgaactcaccagcaacggcactcgtaccgtcgcattcgtcccagtcggcaagcgatgggccgcgttcgacctgcaataagccatgcgcccatagactcctcgatgtacactctctagaggctttacgactaggaggattcatgggttgcacgttggtgattgacacctcattcggctcgacggtcggcattgtggggcgcgagcccattgtagagaccgattcgcgcacccatgtggagaaactgcaggtcaatatcgcgcgcgcggtcgaggaggccggcctgactcctgccgatatcgaggagatcgtcgtgggcatcggcccggcgccattcaccggcctgcgcgccggcatcgtggccgccaaggcgttggccttcgccaccggggccaagctcgtcggacagaacgtactcgacccgcaaggcgagatgatgaacttcgtgctgggtgacagcgccatgttcgacggcatcgatttcctggccgacgtgccgcgcttgagttcgcgccaatcggatggtgacgtcccggacgccgaggccaaggaacacgaactcgaccgccacgtcacgctgtgcgtcaacgatgcgcgccgcaagcagctgtacttctcgctcaaccacggcagcgtcagcctgccggacgaggacgccgccgaacgacgctggatcgagatggatatcgactacccggagcatatcgtcgaacggatgaacgcggcgctcgcggaacacggcgaacgcgacggcgtcagctatgtggtggatgtggccggccacggcgcggccaaatacgcgtccgtctggcagggactgcgtgcgctgggctccgtggtggacggatcggtattggatgccgggaaagccgggctcgccgtctttgcgaccaccgcgttgagccgcgaactgcgcggcgaccaggtcgtgccgatcgaaccgttgtacctgcgccggccggacgccgaagtaccgaacccactgaagcacgtgctcggccatgccggtgccgataaagcgtgaggcgggttgtgtccgatgattgttgacatcactgccgtaagtcgtgatcttgcggttcgttccatcgcacagttggaaggcgaactgttcggccgcggcgcatggaatgcgaacatggtgcgagaggaactggacgcaccggcccgcacgtatctgctggatgtgctgggagaggcggaacaggcggttgtccgcggctacgccggcttctggtacgacggcgaggacgccgagctcatgaccatcggcgtgggcaaggcataccagcggcaaggcatcgccgctgcgttgcttcaggcactggtcgacgaggcgaaacgtcagggcgcctcgcgcatgctgctcgaagtgcgtgtggataacgaccctgcgctggccctatatcagcggttcggattcgaacgcatgggattgcgcaaacgctactaccagcccgaaggcatcgacgcatacaccatgagcttggacctgaaacctagggtcgtgggctttgccgccccgcagacggcatcggcggacattgaagacatcaccagcaagcaaacggagaagaacggagaagcacgatgagcgaaccggttgtactgggtattgaatccacctgcgacgaaaccgcagccgccatcgtacgcggccgcgaactgctctccaacgtcgtggcctcatccatggaggaacacgcgcgatacggcggcgtgatccccgaaatcgcctcccgtgcgcacgccgaggccttcgtgccatgcgtgtccaaggcgctcgccgacgcgaacatgacgttggcggatgtggacgccatcgccgtgtccgccggtcccggactggccggttgcctggccgtgggcgtgtccggcgccaaggcgctggcctgggctgcgaacaagccgatctacggcatcaaccatgtgatcgggcacatcgccgtcactcagctgcagttcggcccgttccccaaggacacgctggcgctgatcgtctccggcggccacacctcgctgctgcacgtggaagacatgccgcgcaaaatcgacgtggttggtaccacgctggatgacgcggcgggggagtgcttcgacaaggtcgcccgcctgctcggcttcccgtatccgggcggcccgcacatcgaccgccacggccagaacggcgacccgcacgccatcaaggtgccgatgggcctgacacaaggcaaggccggtgccgcgcacccgtatgatttcagtttctccggtgtcaagaccgccgtggctcgctgggtggaaagcgagcaggccgccggccatgagattccggtggacgacgtgtgcgcctccctggccgattccgtggccaccgtgctggcccgtaaggccatgcgcggctgccggcagtacgattccaacacgctgatcgtgggcggcggcttctccgccaactcgcagctgcgcgccaaactgctcgaattcggcgagaagtacggcgtcgacgtccgtatcccgcaaatcaagctctgcaccgacaacggtgccatggtcgccatgctcggcgtgaacctggtcgaagccggcgtggcccccagcgcccccgacttcccgattgactccgccatgcccctgaccaaggtttcgatgtaagatttgcgcggtattcccaaactgatactgggaataccgtgcctctcatcggtgaattgacagtgacctgtctgcctgatgtgagtagtggtgaggtcttcgccatggatttcccggttgatgatggggtgtcgtgtctggtcaccaatgcgatgaaaataaaaaagcctcggagaaccgaggctttcgatggctcctgcggctgggcttgaaccagcgaccgtccgattaacagtcggatgctctgccaactgagctacgcaggaatattcaattttcatcccgtccggagttacccgttcaggtgagctcctgcggctgggcttgaaccagcgaccgtccgattaacagtcggatgctctgccaactgagctacgcaggaattgctccaccacctgggccgtcgtcatcggcgtggtgaaatacaactccaccgcacgctctcgttcctcaagactgaacatacgaaaatccttccgttcggtctccaagaaaacgtccgcagccccttatcaacgtgcgcaaccggcaatatccttgcggagtatctctgcataattcgtggctgtaacgatgctgccttcgaataatccgtcagaccgggtgtcgagcaacgcatccgcagcatcttcgccctgcgtcgcggccgtcatgcaagcgcgcaacgcttccgcctttgcactgagcatgtccattttctcagtatggtcaggatttaccgaatatccttgatttgcgtatgccttcagccgttttcgatacatgacagcggataaaggcacggtcacgtcgatgtaatcatagacacgaacctcggtcttgccatcattctcgcgatgaagtcgccctacatattgcgagagagtaccctcaaacgagaccggagcggcaagcagaagcgtgtcgaaacgcttctgatcgaatccttctccgatatagctacccgtagccactacagtcaggctctcattattcggcgccaaggatagatcatgctttttttggttattcgctgtttgcggtggggcgggcatgggttagtgtttcgggttcgatttcctgtcagaaaaaataatcgagtgcgggattacggccggtaaggctcctgctgtggatgcggatgcgcgtcagccttacggtgatgcttttccaaaacgcggattgtacgaggtgtgggacggcacgcggattcggccgttttccgcccgccgtcccacagcgctcgctatgaacggttgtgcataatcatggagctgcagcgagaatcggcgttattccgcggtttctacagtcgtcggtgtgggacgctacggacgttaaacggttgacttgtctgccatcccgcgctcttgagggacggcgcggacgacaaacgattgactcgtctgccgtcccacagatattgggatgtgtgcggctgcctgctgcctatagcgggtgtcggtcacccccaccgatcgcccccaccggttaccaccctgcttggcggaaatacgcaactcgactttctgtaggcatcatggcggcatggcgacggcggacagtcgaagagatccccatgatgcctcaacagccatcgcccacacacatcacagctatcaaccgcaaatatcaagaggccgaaaatctatgagacaagcaaccccggaaagcctcagaccctacaaatggctttattgcaagggtatatgccggtccaaactccactaatagaactaatagaacaaatagaacagccagcttaggcacggcgcggcaaatggcgcaaaccggccgcgatagtagtagcgtggtgcataccagtacaaccatgcgaggagaacagccatgatcaatgaggaatacaaggccatgcttggcggcaagtccgtgattcgcgagctgagcgagtacgccacgagccgcggtgccgaaatcggctaccagaacgtgttcgattacagccttggcaatccctcggtgccggctccgaaatccttcaccgacgccatggtcgacctctacgaaaacggcgatccggtggccatccacggctactctccctcgctcggtatcccatccgtcaaggacgcgatcgccgaaaacctcaacgaacgtttcggcatggcatacaccggcaaccacatcttcccgaccacgggcgcggcgggcgcgctgtcccacgcgatgcgtgcggtgaccaagccgggcgatgagatcatcaccttcgccccctacttccccgaataccagccgtacgtcaagggcgccggcgccaagctgaccatcgtgccggccgacaccgagaacttccaaatcaacttcgacgcattcgaggctgcacttaacccgaacgtgcaggtcgtgcttatcaacaccccgaacaacccgtccggcgcggtgtattcagcggacacgctcaagcgtctggccgcgatcctgaccgccaagcaggtcgaatacggccacgatatcttcctgatcagcgacgaaccgtaccgcgaaatcgtgttcgacggcgccacccagccctacccggccagcttctacgcgaactcgctgacctgctactcgtggtcgaagtcgctgagcctgcctggcgaacgcatcggctatgtcgcggtgaatcccacagccaccgacgccgacctgctcgtgcccatgatgggccagatctcgcgcggcaccggccacaactgcccgccgagctcgattcagctgggcgtggccaaggtcatcgaccagaccgccgatctcaacgtctacgagacgaacatgaacctgctctacgatgcgctgaccggcatcggcttcgacgtggtacgccccggcggcacgttctacatcttccccaaggcgctggaggacgacgccgtggcgttctgcatgaaggccaaggaatacgacctgattcttgtgccgtccgacagcttcggcgtgcccggatacttccgcatggcctactgcatcgacacggagaaggtcaagcgctcgatccccgtgttcgaaaagttcgcccacgaggtgtacggcctgtaaacacggaccgcaagtaacaaacacaagaaaggggttgccatggaatacaccgaagacgccgatcgtcgcgaactgctgctgcacagcgcctatgactccgatacggtccgggccatggagcgacccctgctggacaaaggcgtgccgctgatgcgcatggccgcccaggccgcggcccacatggcggccggtatgctggacgacgaggatctggcgctggaggacacgtcgatcgtgctgctggccggggccggagacaatggtggcgatggtctgttcgcggccgccgcgctggcccaggagggcgcgaacgtcaccgccatcgccgtgggccggtcgttgcatgaggccggattcgcctcattcgtgcgcgccggaggcaaggtgctggtgcttgatcccgcggctgatattcccggttgcgcgtccgggttttccgccggtgaggccggcgagcgattgcagaccgccatcgccatggccaggaaatcgcatctgatcatcgacgcgatgaccggcatcggcatccaaggctcgctacgcggcatccccgccgcactcgcctccgcccttggtctcgacggcgaggctcccgatgagcccgccctgccaaaccgtgagtcgtcaggcgattttccgctggtacttgccgtggatacgccatccggcgtcggtgtgaacgatggttctctgcccggcccgtacattccggccacggtcacggtcacgttcggcgcgatgaagccgtgcgcggtgctgccgcccgccacgttcgcctgcggccgtatcgagttgctcgatttcggattcgatatcgacgacaaggatccggacgtcgaggtggtggataattcgttcgcgtccgacgcggtccgtctccccaggttcgaggattccaaatactcccggggcgtggttggtctggtgaccggctcgcagcgctaccccggtgccgccgtgctcaccgccagcgccgccgcccgcgcgaacaccggcatggtccggtatctgggcccggagcgcgcacagaacatggtgctcgccgcactgccggaagccgtgatcggcaagggacatgtgcagtcctgggtcgtggggtccggcgtgcccgaggctagcgtcgagggcaccgacggcgatatgcagcgggacaccatcgccgcattgctcaagcattacgcgctcggcagcgaggatgagaacaaggacgcctacgacatgccgccaatcgtggtggatgccggcgcactcgacctgctgccggagcgtgtgcccggccaggtggtgatcacgccacatgccggcgagatggcgaaactgctcaaccggttcgaaaccgccgccagcaccgcggagcatgccgattcgcacgagccgtacaccgccgacgacgtgcggttgaacccgttggccagcgcgaagcgtgcccacgagctcaccggcgccaccgtattgttgaagggcgcggtgaccatcgtggtggatgaggaccacgtctatgcgtcgggtagcgcaccggcctggctgggcaccgccggcgcgggcgacgtgctggccggtctaaccggcgccctgctcgcccagcaggatgacgtggccaccacgggcgagaccgtggcctcggccgcctacctgcatggcctggcggcggcgatcgcctccgaatccgagcaacaaggctggcaggagccggaactgatcggccgcgagcatcgccagcgcttcatgacgctcggccacccgattgtggccggcgacgtggcccacgccatccccgaagccatcgccgacgtcatcgcatgattccgtacgttggctcccctcagagaggggagccaacgtatgaaaccccctatactaaatcgcagaccccactcaacggccccaacaacacaaggagcatcatggccaactcccccatcaccgacgtgattttcgacttctgcggcgtgctgctggactggaacacccgcgcatgcctggaaggccgattccccgatgagatcgtggaacgcatctgcgccgacgacgacccctgcggcttcttccgctacgaggaccgcatggacaccggcgaggatttcgcggacatctacccggatgtggtacgcgaacaaggccaggaactcgccgacatcttcaagttctacatcggccactacgcggacgcgctgccccgcacgcttccgggcatggtcgagctgctggcggatttgaaggcccacggctacggcgtatggggtctgaccaactggtcgcatgagaccttccacctggccttcgagaagtacccgcgccttgaacagctgttgcagggcaccgtggtctccggcgtggagaagatgcataagccgaacgccgacatctacgagctggccctgacccgtttcggcctcacggccgagcgctgcgtgttcttcgacgacaccgccaagaacatcgtcggcgccaacgaggtcggcatccacggcatcctcttcgagaacgcgttgcaggcacgcgaatcgctcgcagaactcggcgtacgtctgtaagtcgccaaacgttgcatcgcggcagttgaagtctatggacccgtccttgacgacggtgaccggccgtgtggcgaccatccctagcgatataaatagactttatgacactgctgcagctgaaatacatcgtcaaaatcgtcgagtgcggctcgatgaacgaggcctcccatgccctgtacgtctcccagccggccctgagctcgtcggtcaaggaattggagaacgagctgggcatcgagatcttcacccgctcctcgcagggcatcgccctgaccgtggacggcgcggaattcctgacctacgcccgccaagtgctcgaccaggccgacctgctcgaagagcgctacaagcacgccaaaccgcgcaagcagctgtgccaggtctccacccagcactacatgttcgccgtcgaggcgttcgtggagatgatcaactccatcaagtccgacgaatacgagttcaccatccgcgagacccgtacacgtgacatcatcaaccaggtggcgaacatgcagtccgaaatcggcatcatctacctgtccgacttcaataaggacgtgatcggcaaactcctgcgcgagaaacaccttgaattccatccgctcttccgcgcccccctgcacgtgttcatctcacgggacaacccattggccgccaagaagatcatcaccatggaggacctgaaaccctatccgttcatccagtacgaacagggcgaggaaggctcgttctacttctatgaggaagcggtctggccggaatactcccccaagcagatcaacgtgaccgaccgcgccacgatcctgaacttcatcatcggcctcaacggctacacggtgtgcaccggcatcgacaacggcgacctcaacaacgagaagatcgtcaccgtgccgctcgacaccgacgaaacgatgttggtcggctggatcacgaacgagcgttccaagctctccaaggccgccgaaacctacctcaccaagctcaagtccgtagtctccgaccacggctacaagctcattgattaggagtaagtaaaacaggcatggtcagcagtgagatatactgcgattaagccaaccccgctggggaaatggaagcaagagccggcccctgagtatctcaggggccggctcttgcgctattgagactgactggcaaaaccagtttgatggcctccgactacttggccaagattaccgacgcggcggctgtcgcggcgaagcctttgagcacctcaatcatcacgtcgcgatcttcgacatcaatgctgcgggccgcggcgagcattaccggcaacgactgcgtcacgtgcgacgtgagttcgccgaacgtgacgtacccgccggcctcgaagatggcgaacaggttttcgatgaacctgcggcgatgctcatcatcgtatttcgccatccatccgttgatcgtgcgcgccagatactgcgcactgttggcgagcccatcggcctgtacgaatcggccatgatcgacctgccagtgcagggcaaaatgctgcatgatgctggcaccgtcgctgctgaccaccgtatagccgtcttccacatgctcacgagtctcaaacagcatgccgatgatcgacgagcccggtaccgatttatgaatcttcgacgcaatgcgcgcgtacccatcctcatcgaagaacgcctcatcgaatccaggcccatcgtgcgaatatacgaccgtgatacgttcctgaatctcgctaggcacattggccgccgcatacaccgccagattgccgcctttggaatggccgccgaccataatcggcccggcccaatggccagccagctcggtcagataacgcgcggcggcctcctgcgaggcgaccgggcggcggaacgccatcatgaagtcctctttccacccgacgattgagctgtcggtaccgcgaaaagccacatagagcgtgccgttacccagttcgaacacgcaggccgagaactgcttggtggttgcagcatcgaattcgtccacgtatgcgcccacgcgtaggttcctccaacgtgggctctcgctcatcgcacgtaacagatcgacattcatcgaaggcgaccacaccttgccgaacatgtcgtcatagcattcggcacgcagcaaatcgtgaatcggaaccgtggcgatcatgccgtcggcggtctctgcattctcgtgatagcgcggcacgttatccggcatgcgagcataggccaactgggacaaagcgaggctatccgcctcggtgaacggcagttcggcgaaagtgtcgaaatgttgccgaatatcgtcggtgatgttccccatagcggccttccttgttcgaatgcaacgaacctacggtaattctacgccgagcgggttttcatcacaggcgagtcggtcccagagtttagaaccctatctcgctttcaagggagctgatttggccttctggagacatttatctccgtttcaagaggctgttcatccgtcatatcccgagtatgagcggcgtcaccccaacgtcattccgccattttcatgctgcttctacttgggcatcagcatctcggcggtcttcttcattaccttgcgacaacttgttcgctttgctgtccagatgatgctcgatgccgaagtaactgcatatccccacgagcgcaaacagccctatatcaactaaccagttcatagcacgctccttgccaaagcttttgccttaatatggtgctgctgttcatggaacgtaataaaaaaagcgggctcgcaagcccgcttttggtttttagattgaagacgatcaggcgccgtattcctcaaggtaggcggcggcgcgctgctggatgtcgtggctgagcagcggggtaccgtcggggttcttcatcttggcggcggcgtcgaagatctcgcgcacgttggcgatggagagcaccgggaagccgaattcggcttccacggccttcacggcggacatgtcggagtccttggtcttctccatgcggtccacggagagcacgagacccacgacctcgacgttcgcctcggccttgagtttggggatgacttcgcgcacggcggtgccggcggtcatcacgtcgtccacgagcagcaccttcatgccgtcggtcagcggggtgccaaccatccagccgccgtcgccgtggtccttcttctccttgcggtcgaaggtgtatccgacggtcatgttgtggccggcggtcagcgcgatcgcggtggacacggccagcggaatgcccttgtaggcggggccgaacacggtgtcgatgttgcggggaatcgtgttgtgcacgatggcctggctaatcttttcggcgtagaacgcgccgagcgcggcgatcttcttgccgtcgtcgaaggcgccggcgttgatgaagtacgggctcttgcggccggacttcagcgtgaagtcgccgaacttcagcgcgttggattccaacaggaattcagtgaagcgatgtgcgagtgtttctgccatgatgttccttacctccaagtctgtcctgcggccagtttagcagcgagttcgggacggctgtccaacaggtcgtcgagttcgcgggcgacgcgcagcggggccaccgggtcgaagagcgcggccgcacccacttcgacggcgttcgcgccggcgtacaggtattcgagcgccttctcgccgctgtcgatgccgccgaggccgatgatcggaatctccggcagtgcggtgcgcacccgatagacggctgccaggccgaccggcagcacggccgggccggatacgccgccggtgacgttggcgatgatcggcttgccggtgcgaatgttaatgcgcatgcctttgagcgtgttgatcatgctcaacgcgtcggcgccatgttccacggccgcgcgcgccggcacggtgatgtcggtgacgttcggcgtgagtttgacgatcatcggcttgtcggtcatcgggcgcagccggtccataagattggcgagggccaccgggtcggtgcccacgctcatgccgccggcggaaacgttcgggcagctgacgttgatttccagcatgtccgcgtcggagtcggcgagcttttccacgaccgccgcgtaatcgtcatcgcaatgtccggcgacattggagatgacgaacgcgcccgcggccttgagcttgggcaggtcctcggccaagtaatggtcgatgccgggattctgcaggcccacggcgttgatgttcgcggccggcgattcggcggtgcgcggcgagggattgccttcccacggtacgggcgaggcgcccttggtgcatacggcgccgagctggctgacgtcgtagaaccagcggacggcggcgtactggaaggtgccggaggcggtgccgaccggattcttccattccagaccggccaccttggtgtggtgcttccacacgtggggctcgtacaggttgatgtggttgtcgccgccctgcgcggactggttgtttgcgctcatcgtcacttcccccatccgagctgttcgcgggtgaacacgggtccgtcggagcagaccttgaggcggccgtccacggtgtcgatggtgcacagcacgcaggtgccatagccgcagcccatgcgctgttccatgctcagctgcgcggggatgccgcgttcggcggcccagtcggccacggccttcatcataggcagcggtccgcaggacagaatgatcggcttgcgatcgtaggccttcaggtcgtcgccttgttccagtttgttgagcaggtcgaccacgttgccttcggcgtcgtcgatgctccacgaccagtccgcgtaccgggagacgtattcctcggcgaagtggtcgttgcggtaaccgaatacggcggtggcaaaggaggcgtcgtgttcggcgagcttttgcgcggcgtagattagcgggggcacgccgagtccgccgccgacaagaatgtagttggcgtcttccttgaggttgaagccgcggccgagcgggccgagcacgtcgacggtgtcgccggcctgcagtcctgccaactgttcggtgccgtgtcccacgacggcgaagatcacgctgacttcgtcgccgtcgacttcgctgacgccgaacggacgcggcatgagcatgaagtcgtcgtgcgtgaacaggttgacgaactgggcgggcttggcatgggaggcgatgaacgggtcgcggaacgtcagtcgcatcacgcggtcggtcagttccgtaacctgcgtgatttcgacgttgtggcgcggcgggaagaatccggccgcagtcgcttccgtaaccacatcatgggtgggggtgaaagttgtcatttcattcctattcagcacatcaagctccccctatcaggggagcggtcaaccgcaggttgactgagaggtagttaaacacactcggctccggtttccagcccacactcacgtatagcccacagccggacaatctacctacctatatacggcaacccgcagattatcgcgcatgtcgagcgccgcctggcgcgcgctgctcgccacaaggtccagcgcctcgtcggcggtcatggattcggagtacttgccgctcttcttccatgcgccgataatgccgcgcgacgagttgacgatggcgccgctgccctgcttgtcgaacatgcctgccacgtccgcggccgtgccgccctgcgcaccgtagcccggcacgaggaagaacgtgtgcggcatacgttcacgcaacgccttgccttcctcggggtgggtggcaccgaccaccgcgcccacgcgggagtagccgtggctgccgatggtctcggcgccccatccttccacaagatcggccacgtgctcgtagaccttcgtgccgtcggccaggtcgagcatctgcagttcgctggaggacgggttggaggtgcgcacgagcacgaagatgtccttgtcggcttcggcggcggcctcgacgaacggggtgatgccgtcggtgccgagatacgggttgacggtcaccgcatcctcatgccacgggtcgaagtcgcccacgccgttcaggtggtgggcgtaggcggctgcggtggagccgatgtcgccacgcttgatgtcgccgagcacgtagaggccctgctgggccgcgtattcgcaggtcatcgtgtagatgtccacgccggcggggccgagcgcctcgtacatggcgatctgcggtttgacggcgggcacgatgtcggcgatggcgtcaatgatcgtgcggttgtattcgaagtaggcgacggccagctgcgcggattcgacttcctccggggattcgaccgagtcacgcacctcgtcggcaaagctcgccacgacctgcggcggcaccagcgcctcagtggggtcaaggcccacgacgctggggttctgagtgttgtcaatcgcttcgatcaggcgatccatgctgctccttgtgttatctacagacggctgaacatcagctgggagccgatgattgtggcgagggggcgtccggtgacctgccagccgccgaacggggtgttacgagccttggagtggaactgttcggggtccacggtccattcctcggcggcgttgagcaccacgaggtcgacattgtcggcgtcatccacgcggctcaagtcgagcagtcggttgacgccttcacgctgcggctgagcgtcgctctcccccgcaatcacgccatccggatcatccccggtgggcgcgggttcggcgtagtcctcgaccagcgcggctacgtcggttggcacatgccccatgagttcggcaggtccaacggacatgagctcgatcagacgctcatcggaaatgaagccgccgtcgacgagcaccttgtggcacacgccgtacgcgcattccagtccgatgatgccgttgggcgcctcaaggaagccgagttccttctctgccaacgtgtgcggcgcatggtcggtggccagcagatccacggtgccgtcggcgatggccgcgatggtggctttgcggtccgcttcggagcgcagtggcggattcatcttggcgagcgtgccgtacttgagcagcgcctcgtcgctcaacgccagatagtgcggcgcggtctcgcaggtaatcggcagtccttcggccttggccctgcgaatcgcctcgaacgagatggcagtgctcacatgctggaagtgcacgtggacaccggtgcggcgggccgcttcgatatcgcgggccacgatcttgagctcggtgtcttccggaatgccgggcacgccaagctcgcgggaaacggggccttcgttcacggcacctgtatcgtgatgctcgcaatgctcgatcaggtacaggtcggaggccttgacgttctccagcacctggtccaggatctccggcgtcacagcggaaccgtcgtcgctgattgcggtgatggggtgcgtgagcatggccggcgtcttggcgtcgtcctcgaatccgggcacgtacttgagccaatcggcaacgtcgcttgcctcatgaccggcgcgatccttggacgcgcacacgcacagatcgtaacgaaccggcaattgaacgtcatgcgcagtatcgtactgctgcaggaagtcgatgacgttgtcgaagccggcatccagaacctcttttgcaccggtcgcttccgggccagacacggtctgcccatccagtgccggcaacgtgttcggcatgatgagcacgttcgtgtatccgccggatgcggacgcacggcagccggagaccatcgattccttgtaggtctggccgggatcgcggaagtggacgtgtgggtcttcgaaaccgggggccacggtcaggccggtggcgtcgatgtcggcgccgtcagccacggcggaggtgtcggcgaagtaggcggcagcggtcccgggcaccacgaggtcgatgacctcgccggtgttccagaccttgatgttgcgtagggtgatgctcacagtttggcttcctcgtcgcagtagtcgcagcggtattcgagccgctcggagtgcacgaggtggaacatctgcttgatgccgggctcggcggtggtcacgcagcgcgggttcacgcaggaaatcacgccgacgatgtgctcgggcaggttcggctgcttcttttcgacgatcttgccgccgcgcaccacgtccacggtggcttggcgggccacgaagccgagcacgtcgaggtcgatgtccttgtcatcttcgattttgatgatgtccttggagccgtaacgcttggagtcggcgttcatgatgagcgcaagcttggttttggccgggtcgattttcaggtattcgagaaccttcagcgaggttccggccggcacatggtcgataatgatgccgttctgaatgctggtgacttccatcaggcctgaacctccttggggttgagcggttcgtatccgggcagttcgtcgcccaccacggtgctttcgagggccatgcgcacgagcatgccgttcttgacctgttcgaagtaggcggcacgcgggtcgtcgtccacgtccacggcgatttcgttgacgcgcggcagcgggtgaagcacggccatggacggcttggcgagctgcagcttctcttcgtcgagaatgtaggtgtcgcgcaggcgcaggtagtcgtcttcgttgaagaagcgttccttctgtacgcgggtcatgtacagcacgtcgaggtcgccgatcacggaggccaggtcgcgcacttccacgtaggagcagctgtcggtggcgttgatgcggtcgatcacgtactgcggggtcttgagctcgtccgggctgatgagcacgaagcgcacgttgccgaagcggcacagggtctcgatcagggagtgcacggtgcggccgaaggtcaaatcgccgcacagtcccacggtcaggtcggtgatgcggccgaagcgcgactgcagcgtggccaggtcggccagcgtctgcgtggggtgcatgtggccgccgtcgccggcgttgattaccggcacggatgcggcgcgggaggccaccagcgcggcaccctccttcgggtgacggatggcgaccacgtccacgtagttggacacggtcttcaacgtgtcggcgatggattcgcccttggtcacggaggccagctgcgcgccggcgaatccgatgaccttgccgccgagacgtagcattgcggtctcaaagctcaggcgcgtacgggtggagggctcgtagaacagcgtggccagcactcgcccatcgcaggtatgggcaatctctttgcggtgggaatcgatgtattcggccttatgcagcaggtcgagaatctggtttgtagacaggccgtccagcgttacgacgcttttgccgaccattggcgtttcttcagacaaggctcaccttttcgctcgtggttttcaggtggccacccttgcgtgacctaatctaacttacgccatttttcggacagccgcattcaccgagtgtccacctgaaaatccaacgaatatgctgccttatcgctgcgcgcggcgtcgatttcgttccagtcgcggtgcgatcacgtgcatacgcgggcgaggggcggtttgcggctgctgcgttgcggcggaggccgtggcggtggttgccgcagccgcctcgccttcggtcttcccatagaacaagcgctggcatacgtcacggcatttgcgcatcacggccagcaggtcgttctcgaaatgctggccgcggtgggcaccgtagccgaggtagacggcgatgccgcccagcgaatagatgtcatcaggcagaatatcggcctggttggcgcgcccgctccacagatagctgccgttgcgggccgcggtgcacaacgtccatgccttgcgcagctgaatcgcgtcgatagcgctgatgagcttcttggcttccagcacgtccaatgcctccagcgtgccgttgacgcgcagatctttgatatcgccggcgtgctggagctgcatgagttgcacggtccattccacgtcagacaagccgcccttgccgagcttcagatgccgttcacggcgcacgccgcgcggcagacgctcggcttccatgcgggccttgagcttgcggatgttctgcaattctgcttcagtcagttccgtggtcgggtagcgcagcgggtcggcgatgttgatcaggaagtcccgcgccagttcagcgtcgccggccgcgtaccgggcgcgcagcagcgcctggcgctcccaggtcgaagcccaggattcgtagtattcctcgcaggaggcataggagcgcacgagcgggccgttcttgccttccgggcgcaggtccaggtcgagttcgatcttgggttccagcgtcgtcggtccttgcaggatgttgcgcaggtcttccacgaccttcttggcgaaggcgttggcttggccgtcgtcggcatcgtcggccggacggtagatgagaatggcatccgcatcggagctgaagttcacttcgcgcccgccgtaacggcccatggcgatgacggtgatgccggccggcgcggtttcgacgccgaactcggcgatctggtggcgcacggcccaggtcagggaggcatcgatgatcgcgtcatacacgtcggtcatggccttgagactgtcggagtcgctgatcacaccgctcatccaagacaggccgatgcgttcgatttcgtggcggcgcatggcgcgcatggaggtggcgaactcgttgatgttcgagccgaaacgttccagcgccgagccggtctgcacgtccaaggcctcgcgcgtgcgggcctgcagattgtcgtcgtcgccaagccagctgatcgattcgaccgacttgttgagcgcgtcgcccaggaatcgtgagttggacaggatgtggcacaggcgctgggcggcggaggtggagtcgcgcaggaagccgaggtagccggattcggtgccgaagttctcctccagtttgcgccagttgagcaggcccatgtccgggttctggccctcgcccagccactgcaagacggcgggcagaatgatgcggttgattttggccgcgcgccccacgccggcggtgagcgcctgcacgtggcggatggcggcgtccgggtcgccgaaaccgatggattcgaatcgttcctgtgctgcctcgacgctcaggacgatctggtcgttctccatctgggcgttgaccggcagcatcgggcgatagtagatgtcgaggtgcaggtggcgtacttcgcggcgggtgtcgtcgtacttgtcgacgagttcttccgggtgcaggccgaatgcgcgggcgagtcggcgcagctcctggttctggttgagctcgtccacgtcgatgtcgcgcttcttttcgaggcctccgaccgaggcccggccgaggtccgggaacaggtgcgtgcgcttcagggaccagatctgctggcgatgttccatcacgcgctcgaagcggtagtcctgggacatgcgcacggcctgcttgcgcgagacatagccgccttcggacaggcgctgcagcgagtcgagcgtgttgctggtgcgcagcgattcgtcggtgcggccgtgtacgagctggagcatctgcacggtgaattccacatcgcgcagaccgccgcggccgagcttaatctcgcggtccttcaggggcgcgggaatcaaatcctccacgcgcttgcgcattttctggcagtcgtagacgaagttcttgcgcttggatgcgctccacacgaacggccgggtcatgtccatataggcctgaccgaggtcggggtcgccggccaccgggcgggccttgagcagcgcttggaactcccaattctcggcccactgctcgtaatagttcttgtgcgaggagagcacgcgcaccagcgcgccgtccttgccttccgggcgcaggccgccgtcgatctgccacagcggctgctcggccacgcccatgatggcggactggcagacgcgctgtaacatggtgcccatcttggtgcccacgcgaatcagcgtctgatggtccacatccttgtcggccggttcgaccacgtagatgaggtccacgtcggagacgtagttcagttcctgtgcgccgagtttgcccatgccgatgatggtgaagcgcacgtgctcgctgccctcggtttcgtggcgggcgatggccagcgcgccttcgagcgccgcgtccgcgaggtcggacagttcgcggctgatggtcggttggatggaggtcgggtcgtccgccacggcatcctgggcgatgatggcggccagttggttccggtagctggaacgcagggccgtggccgcttcggccagatccttggaggcgacgggcatggccggttcgtccgggtccgcgccgaccgccttgagcagacgtgcacggcgttgcgcgtgattgaacagatggctgttgcagttgtcgactgctgccgcctccacaagctgcggcttgaagcgcatgaacttgcccatcgcgtcggagacgccgagcaccgtgaccagacgcttcagggcgtcgttgtcggggatgacgtgttccagatcgcgctggctggattgcatcgcgttgacgatatccacgaaattgctcaatgccatatcggggtcgcaggcgtgggccagcgcgctcagcagttcggcgcatcgctcatcgggaatgtcgtccgccttgagctggtcgaacaaggcgcgggccttgtcgaggtcttgcagacctgccctgatgaggtccatggagctgggtttgaagatcgacgattccataagattccactatatacgctcatgccctccgaatggggcatgagccgggaaggagtcatcgggcgacgctgatgagctccgaggaatccatatcgtaatcgaccatggcgtaggaacggatggcggggtcatcataggtgttcatgtaataggtgttggtcttggacgaatatccgctggtgaacagcgtgcgttcgaactggccgtcgcccatcttcgccatgccgtccatcatctgcacggagccgagggtgtggaacaggcgcgacacattggtggcttcatcgttctgctgcgggtaatgcgcgttggtgtaggccacacgaacgaagcgcgacggggagctcacgtcgcccgggatgccatgcatgcccacacccgcaccccaggcggtcaaggaggccttgccccatgaagtcggttcggccatctcgttgctgacgcacatgtagttgcgcagattttccatatggaagtcgaatgtcggctgattggtcagcacatcgacgtcatcatgatgcacgtgcatgccatcggccatctgctcgacgacgatgctgcgcttgccgtcaccgatgaaccagtgcagcagagactcctgctgtcccggcacgatctgggagacgagcgtcacgttcctgagcgcctcctcgacctcgtcgacggagtcgaaattacgcgccacccacagcggaaattcgaacgtggcgacgttttccgtgccttcgaccggttcgtggacgaacgaggcgtagccggggaaattcaagccggcgatggccagaccatgttcattggcgcagtcgaaatacatcggcctatcggccatgaccacgcccacgccgatcaccgcgttcggcttctccttgccgcccgcaccgaacaccgtgtcatagtggtagccgcgcggagtgaccaggatggtctccccatatgagaaactccagtcgagattacggccgaaataggtgttgccctcatcatcggaaaaacggacgccggtgcacataacggacttccttccatcgctttggttggcttgcacgttcatgatacccatcggccgctgggggaactctgggtttcgccagcagattaacgtgcggcgcggcgcattgagatgcgccgcgccgcgatatgcatcaaccttgcgtaccgaggaacaacggttccacattgcgccagatacggcgcgtagtggcggggtggttcatcgaatacaggtggacgccgtccacgccgtgggccacgaggtcggcgatctgctcggaagcgtagaggatgccggcggtacgcagggactggatgtcgtcctcccacttgttcagcagggtgttgagcttgtccgggatgcgcgaggcgttgcgctcggccatgcgacgcacggacttggcgccacgcaccggcatgatgcccgcctcgatcggcacggtgatgccggcggcgcgcgccttgtcgaggaagcggtagaagtcctcattgtcgtagaagagctgggaaatcaggtgagtgacgccggcatcaaccttgattttgaggttttcgatgtcctggtccagcgagtcagcctgatagtggccttccgggtagcaagcaccaaacaccttgaagtccggcttcacggagcggatgtatgacacgaggtcgctggcgtggttgaactcgccgaccagctgctcgccgtcgatgtagtcgccgcgcagcgcgagcacggcgctcacgccggcttcctcgaacatgtcgagagcctcatcgatcttggccttgtcggagtagagcgcggtcaggtgggcgactgcagggatgccgtattccttgctgatcgtgtgggcgatgcgcgcggtggcggtgcggtcggaatgggtgccgtgaccgtaggtcacggagatgaagtcggggttcagcccttcgagtccgtcgagggtgtcgtagatggtgccgacaggcgcgttgcgcttcgggggaaagacctcaagggtgaacatcggggaatgcatgctgatttccttacataaacccgagctccctcatccagagggagctcggtgatttccgctacttgtcgagcttggcgcgcacggccttggcggcggcgaccaggttctccagactcggccaggtctcggcgttaccacgggtcttcagaccgcagtcagggttgatccacaccttcttgacgtccatcttgtcaaggatctcgtagatacgatcctcgatctccttctcggaaggaatacgcggggagtgaatgtcgtagacgcccgggccggcctcggtctcgaagtgcgcgtcatgaatggcgtcgagcaccaccagatcgccacgggaggcttcgaaggagatcacgtcggcatccatcgcgtcgatgtcgcggatgatgtcgttgaactcggagtagcacatgtgggtgtggatctgggtggtcggcttgacggcggagtgcaccagacggaaggccggaacggcccagtcgaggtacttgacgtgccagtcggacttgcgcagcggcagcttctcacgcagggcggcctcatcgatctggatgaccttgataccggcggcctcgagatcgagcacttcgtcgcggatggcgagggcgagctgcttggtctgctcctcgtgggtgatgtcctcgcgcggccaggaccagttgaggatggtcaccgggccggtgagcatgcccttcatcacatggtcggtcttggactgggcgtacgcggaccattccacggtaatcgggttggcgcgggaaacgtcgccccagacgatcgggggcttgacgcaacgggtgccgtaggactggacccaagcgttcttggtgaacaggaagccgttgaggttctggccgaaatattcgaccatgtcgttacgctcgaactcgccgtggaccagcacgtcgaggccgatctcctcctgcttcttgatgacggcgtcgatctgggctttgatgaactcgtcgtaggcttccttggtgacctcgcccttgcgcagcttggcacgctcggcgcgaatctccttggtctgggggaaggagccgatggtggtggtcggcagcagcggcaggccgagggcctcgcgctgcagggcctgacgctcctcgcgggcaggctgacgcacgtagtcggcgtcggacagcttgccgatgcgctcggcgacggccgggtcggcggccacgcgggtgccgtcgaacagagcctggttggcggcgagggcggcggatgccttcttctcgtcctcggtggcgtcggccagggcggcgacttccttgagctcgtcgagcttctggacggcgaacgcgaagtgcttgaggtcttcggccgggatgccggtctcgccttcggtgctgaacggcacgtgcagcagggaggatgcggtggagacggccacgttggcggtgacctgcttcagggcgtcgaccaggccgagggaggtggcgtagttgttgcgccagatgttgcggccgttgatcacgccggcgaagatggtggtgttggaggccacgccatacttggcgacggcttcgaggttctcctcgcgaccttcgttgaggtccaggccgatgccgtcgaagccgagcaggttgacggtctcgtacacgtcggcgatgtggccgaagtaggtgttgagcagcaccttgacattgcccttggcggacaggatcttggtgtacagggtcttgaagagttcaacgtcgcccggctccttgtcgagcacgaggtacggctcgtcgagctggacccatgcggcgccgagctcgttgaacttggcgagcacttcgacgtagacggcggccacggcgttgaccaggcccttgtcgagctcgagttcggtggcttccggggtacgggcgagcttcaggaacgtgtacgggccgatgaacacgggcttggtgtcgatgcccagcgccttggcctcgttgaactcgtcgaacggcttggtggagttgagcttgatctccgcggccgactcgacttcgggcaccagatagtggtagttggtggtgaaccacttcttcatcggcagggcggtcacgtcgcccttgtcgccctggtagccgcgggccatggcgaagagcgtgtcctcctggttgtcgaaggagagacgtgcgtaacgctgcggaatcacgttgagaaggatggcggtgtccagcatctgatcgtagtagctgaagtcgttgctgggaatgaggtcgatgccggcggcctgctgcagcttccagtgcttggcgcgcagttcggcggcggtggccttgacggcggcgaggtcgttggcacccttccagtagccttcgatgatcttcttcagttcgcggttctgcccgatgcgggggaagccggagacggaagtcagagtggacatgaatcctccaatgtatgcgttcgtaacccgacttagggtagcaaaacatccggattccggcccttataaatggccgcagagtgtcgttatagatggaatttatatccgctttagtcgaagtctttcacattgatgaccgcgagcagttcgccgctgtgcacctgccattcgtcgaacggtttgttcgatcccatgatcacgatggatgcgggcgaaagtcccaaattcagcaggtcgagtcgttcgccgtcggagtcggcggaggcgagccattgggcgctgatcgacacagtcggctcgtggcccacgatcatgaacacgcgattcttggccttgacgtgggcgagctcgtcgaacaccgcctgcactcccccgtcatacaggctgatgcggtagtcgacgatcggcttgtcgccaaaggtcttgagcatgcggtccagtgtctggcgcgtgcgggtggcggacgagcaggagatctggtcgggcaccagtcccagcgactcgatgcccttgcccacggccttcgcctgtttcagacctttgtcggtgagctcgcgctccgagtcacccttgtcgccgaacggctcggccttggcatgcctcatgatgatgaggatatggtcgtattttttcgctgctttggcgactttgctcagcttgatgcccatccgtggctcccttcacgaaccgtctgcccggtgtggcggtgtggcggtgtggtattgcttccagtatagaggtgtgtgagcgttcacaaactcatcgtttggcggttattcatgcgtgttgccgagttctcccacctgacggtcgaggtcgcgcaacaccttacgtagtttgtggtcggagatgtcgcgcagttccagttcctcgatctgcgcctcacgctgttcgtcggtgagcgagtcgatgtcggtctgcgtgtccttggtcacgcgatcgcgctttctgagcgcctcgaatccggaggccatggcgcgcgagataacaaggaaaccggtatggccgatcatctggtggtcggggcgtacggcgaggccttgggccttccatgtgcgttcgaacgattcctggatctgcggctcggtccagcaaccggccgcgcgcagggcttcggccagtcgactcatctgcgtggtggtagttacgtaactgaccaacacgccgccgggggcaatcacgcggtatgcctgctcgagtctgttccacgggtcgagcatgtcgagcatgatacggtcgaaccagtgttcgggcagttcggcggccacggagtcgaagtcgccggttttgagatcccaccagctgggggcttcaccgtaatacagcgtggcgttggcctgagccactttggcgaattcggggcgcagctcgatcgtggtcagatggccgcgctcgcccacggcgtccagcaggttcacgctcatcgcgcccgagccggcaccggactcaagcacgcgcatgccggaacggatgtcgccgagctggacaacctgggcgatgtccttcggatacatgatctgcgcgccgcgcggcatcgacagcacgtaatcggccagtcgcgggcgcatcaccgcatattcccagccgccgatggcgcgcgacgacttccacggcttgttcttgtctttctcggggtagacctgattgacctgcgcctcgcgcttggcgtgcacggtgaggatcacggtgccttcggtcttgccgatcacatcgtcatgcagaatcaggccatgctcggtctgcgtggagccgccggccacaagctgatcggtgatcttcttgcccttgcggtcggtgaactgcactttctcgcctgcggtgagaggcccgcgcctcggctccataacttgctccttgcgtgctcggtgggtcaatcgctacaagtctaatgcatgtaagctcgttggtgaggtgatgacgatgcgaatgcagatgacaagccagatcgatgccggcggcaatgaccccattttcctgatgttccacggttacggcaacgacgaaagcgagatggtgcggattctcgacgccgtatatgcgccgacgcgagccgatgcggccccgtccgcaattgccgccgtacccagctatatctcgttccgtgccacctacgcgaggccctatatgggcggcaattactggtatcccgacggctgcggcgtggacgagcgccaacgcgaatgcgcggcggtcggggatgcggtggcttcactgctggatgcctcggcattcgcccatcgcaggaagatattgatcggtttctcccaaggcggttatctgtcgtatcgtctggtcaaggcgcatccgacgttgttcgatgccgcgatcctgctcagtccttcgttcatgggcgaggaacaggcggcgcttgactcccctacccgattcttcctggcgtatggcgcgcaggaccgcacgattccgatgcccgaccagcaaacggcccatcaggtccttgaacgggccgggcatctgacctatcgcgagtattccggcatggcccatgccatctgtgatgaggaaatcgccgatatccgggatttcctacgtgccatatgatgccggaatagcttcaatatggaatatctccgttcaaagaggtaccggtccaagtagaagcggctcaacaatggcggaatggcgttggccacgcccattcatcgcgcgatggttctgcgatcagctcaattcccctgccggctgatgccgcccttatgaccggtggccttgaatggcgtggcgcgtgccgtcaccttcggccccggcagattcgtactggtattggatcgaccgcggagcccggcagccggctgggactcggagcgtcgaccagtacccgtgatgttggtatgccgtttgccgtcgtgcgcccgtttctcaccagcaccttcagcctcgtcaatatcaatgcctttggcgcgcaaagcacgcgcccaccgctcatccatcgaactcctcacacatcccattcgggtttccacgtgtactgcatgtcgtaggcgctgggcgaacggcggcaggtggttcagggtgatcggaccgaatgcggcggcgtcaaaagacatcgtttgctcccttcgatggtgtttggccaacaggttccaagggtcaggcacagcgcctttctcaacccgttcgccgccacgatgaccggcagcttgcgttcacgggttcccctgcaatgcgcctcattatggcaacacgaaccgacaggtgccggctgcgcctaggatgggaaatcattgctacacgccgaaaggggaaggcgactgtcatgaggtatttcacgaccgacacgcatttcgggcatccgctggtcacggtgttgcgagggtccacgacgttcgatccgacgcgctcgcgctatgaggaggtgctgcgcgcgcatggtcgcaagaccgccgaggattgggccaaggaggagacgttcggcgcggggctgacgtttcgtcaggtcgccgatacggatgcgcatgacaaggcgattgtggatcatatcaacgctgtggtcggcccggatgacgagctgtggattctgggtgatatcggtttccgcacatcgctgacccatctgaagaactgcctgcgagcgctcaattgcaagcatctgcatggtgtgatcggcaaccatgatgactggtggcgggaagaccgccccgcacttaacctgttcgaaagtttggagccgcacgatacggttgagattgagggactcggtacggtcaatctttcgcattacccgtatcgggaggatctgacatacagttggcccgatgatgtggcgaagttcagcggcaaggcgttgccgtttaacggccgcaaactgctgtatggtcatacgcatcagctttcgccagatggtgcacgcccggaggcactgaatgttggcttggatgcttgggatttgatgccggtgagtgaaacacaggttgtcgagtggttccgcaatcacgatgtcgactcgcccgtgaacgggaccagtaaggccgatgattcagttccctcgctcgatataccgtcgttctgatgtgattcgcggaatgttcgtgtcgttgttctcgtcgtgggtggattgacacagcattaactgccgttgagatgtatgcacgctgaacacgcgcctcaacggcagtggtctcgtcatctctcgctcacaccaacggattgccggctgcctgatacagcgaccaccagtcacggcgttcgagttcgatatcggcaccggccgccatctggcggatgcgctccggtgtcattgagccgagcaacggctggataccggcgggatgacgcagaatccaagcgacggcaatgccgttgggcgtggaaccgtatttgccggcaagacgggtcaattcggcgttcagctcggggaaatgctcgttgccgacgaacggaccgtattccgtgccggattggaatgggcaccatgcctgaatggtcatatgcttcagccgtgaataaggcaggatgccaccggtgcgatcggctgcgggatcgctcgccatattgaattggatttcagcgtcgagcatctgtgtatgcatcaggccgaactgcagttggttgatttccaatttctgacgaaggccgctttgcaatagttcgatctgccacgggcccatattgctgactccgaaatgacgcactttgccacttgattccaacgcatcgaatgcttcggcgacctcgttcaactcaaacagcgtgtcaatacggtgcagcagcacggcgtcgacgtaatccgtctgcaaagcctcaagctcgtgatcgagtgcgtcaatcagatgcttggcgctgaagtcatacccgtttgcgccgccatcgttttcgccgaaactgtagtcgatgccgaacttggtttggatgaagatggtgctgcggtcgagtcctgcgtccttccacgcttggccgaaacgcttcgaactggcgtgcgcggcatgatcatggaatccatagatgtccgccgtgtcgaaatagtcgatgccagaatcatgggccacggccacggtacgtgccgcatcggcggcatccaacgcgtccatgcgcatcacacccagcgccactcgtgacgcaatcatgccggattgtccgatttcctgagtcttcatagtgtctcatttctgttatcgtgaatcggcgaacgggcactgtccgcctcgttgccgggcagcaatctccattgccgcggcttatgtcaccttatcgcttgaagtgcacttgaaggcaactcgcaggcaggcagcgcgcgctgccgggcgcgtcttcgcgccttcatgtcttcgctgtgatcgagacatcgttgtgccgtgatcatgcctatttcttgtatgatgacctctatagcaacagagctagggggattccatgaacactaccgattcatccaaagtcagtgatgccaacgccggcgcaaacaatgtcatccatatcccgcacaatcccacgcttgccggattggccacgctgacccgcaacgtggcgtacaagaccggggccgataacctggtgatggatatcatctcaccacaatccaccggcgatgacgatgaccgccgctaccccaccgtggtattcgtgcaaggcagcgcctggaccacgccgcatcgcgactacgagatcccgcagctctcggctttggcccgcgaaggctttgtggtggctacggtgaatcatcgcgatgcctcgagcgacccccacgacatgttccccgcatatctcgaggacgtcaaagcagccatccgctatctcagggcaaacgcacgtcaatggcacgtggaccccgaccgtctcggtatctggggcacgtcgtccggcggcaacacgtcgctgctggtggggttgaccgccgacgatccgaggtatgaggatggcaccaatgccgatgaaagcgatgcggtgaagtacgtggtcagctgcttcccgcccactgacatgcttgaagctgtcgccgcattcgacgatgagaccaatccattccggctgtattatttcggcccgttcgcggccgtggtgggtgcgacccatgagaccggcatcaatgccgaggtccgtcagcgtgcggctgatatgagtccctacctgcaggtgcgggatgaccagcagtatccgccgatgctcctgttgcacggtaccgccgacaccgtggtcccctatcatcaatccgtcaagatgcgcgaccaactggtcgagcacggcgtggacgcgcagctggtgctagtcgacggcgccgaacatgagtacgatttctggagccagcaggtcttcgacgtgatcttcgatttcattcgtgagcggagctgaacacatcatgcttttgggcagatagtgcgacccaaacatcccgttgtctacttagaagtgcaacaccctttaaaaaggatgttgcacttctaagtagacaacgggccgcgtgggtcgttcgcccggctgccctacgatagagggtgtcgccgtattcccaacggcgcagtccgtgcccgggacgaggggctcggccgaatggcgcgacgatgcgccttgaagttaaggagtcatgatgaagtcatggagattcaccggcaccaatgaaccattgcagctcgccgagctgcccgagccgaccgccggaccggggcaggtcgtcgtcgacgtgaaggcggccggcatctgccacaccgatgtgggcattctcaccgatccgggctggatgacgatgctggcgcaggtgccggtcacgctcggccacgaggatgccggcgtgatcagccaagtcggcgagggcgtggacgattttcaggtgggcgaccgcgtggcgatatgcccgaccacgccggccggctgccccgggtcctccttcgacggcggattcggcccgaagatcgtggtgggcacgcaggcgctggtgcgcattcccgacgaggtggatttcgtcaacggcgccgcggccaccgatgcgggcatgacctcgtacgcggccgtggtgcgccgtggcggcgtgaaggccggcgacagggtcggcatcatcggattgggcgggttgggccagatcggcgcccgcgtggcccatctgctgggcgccgaggtgcatgtggcggagatcaaggaggatatctggccgctggccaaggaactgggtgcggtggacgcgcgccagtccatcacggactatccgaagggattcttcgatgtgatcgtcgacttcgccggattcggcgacaccaccgccgacgcggtggacgtgatcaggctgggcggcgtggtggtgctcgtcggcatgggccggttggaaaccaccatcgatgccaagtcgctcatcgtcaaccagtgcgatctgcgcggatccaacggcggcacgcccgacgacatccgaggcgtctacgagctgatgcgcaccggcaagctcacgccggtcaccacgaccgtctcgttcgacgaggtgccggaggcgatcgaacgactggagcgcggcgacgtggtcggccgtctggtcatcagctacgagtgagggatggattggcaacggtgtgttggactgtttctagagggtgtttccttgtttggtgaactccacggggctcatgtatccgagggtcgagtggagccgctggtggttgtaccaccatacgtaccggttggcgtccgagcgcagtcgttccacgctcgtgtagacgttgtcgcatatgggttccttcttgacgagccttatacaggcggcggcaccgatgcctatcacatcaccgggaaacgatgacgacaccggggaaaaccatcagcccacactacggaaaaacactgccgaacctgtcgaacaaacattgaagcaaaacacgccgaatggaccgtggtccgtcagggtggtccgcgatgccggccctcacatgggctttcgcgtgggccgcatgatcggtccggcatgtggaccattggcccattcgcatgatgtggtccggaagcgcgcagggcatgctgatggcccacacgcatcgacgtggcccattcggcctcctggtccttggtccacggtcctggatgccggccatggcccacacggcgtgggcatgatcgtggaccgggccggattggattggatgggtccacggtcgatgccgccctccgtgcccgatcggcccgtccggccgacggcaaagggggcggagccgtcatcggactccgtcccctttatcgtgtgcgactatgccaggtccttttttattcttcttgccgctttcttgtagacggtgttgtcgtcacgaacggaaacgacgacgaccatcattcgaactccggaacatagccgtcatcgacgggcttgtagtccttgccgaacacgtcgtccatgccgagtcttgtcccgtcgtccctcttcattcgttcctcggcttcgaggtacagggcgaagtcctcttcggcctcggtgagtcggcggtaatcgtccgggctgatgacgatggcggccggcttgttgtttcgcatgaccacgatggggttgttgtcccccaccctgctgagcgtcttgctgacccctccgtggctgagttcggacacggacacgaggttgtccaatgtgatgtttcccgccattcgccctgctccaatcggttcaaaaaatagctattatcgtgatgataattgcattcacgttttgctggtcggtcaagggaggacagggcccgcccggccccgccatccccagccggtcacttggccggcgcccaagggtcgattccggcctggggcttcggtgcctggtatccggcggcggggaagtgtccggtgttgcgtacgtagttgacgaggtcggcggtcgcgatgtccgcccaggggtcgtttgcggtgttgtcgagggtcttggtgttcatcttcgttttcctttccggttggtgacgaccgctctttgccgcggtgcgcgtcggggcgtcaatgggacgcgcggggcccccgcaggggtcgcgtggaccgttgacgtcccggcgtgcgccgtggcatgctgcgtcaaggaaccgatcgggaggggaaaacgaagatggacgccgggacccgggccacgtcatcgtcccggcttggttggatggatgccgtctccatcccggttcgtggatggcgggcacgtcgatgcctgcgtcgaactgtccggattgagatggctgtatgtttccacgtccacggctttggctggcatccgtcgcctcgttgccggggttctggcgaacatggattcggcgttcggccgtctttgatggacgtcacctgttcctgtctggaatgcgaaggcggggcctccggcttatggatggccccgcctgtttgtttccctgtggttttctgatcactcgtcgtcgggtatggtgtcatggtcgtagatgccgaccatgcggatggtgcgtttcgcctcgcgtctgaagtagaccacgagcacgtcgtcgtcgaaggtgtggaactcgaagtggtttccgtccccgaacgggctacgctcgagcaggtggtcgcgccatccgctctcctccacgcgccccttggccgccagttcgcagatcgcctcccttatggatcggatgatggacgcgaactgttcgtgggtgtatttctccttgaggggcagcgcggtccgccagaagtggggcgaggccttgacgttccagttcactggcctacctcctgtgcggtgaggcctagttccccgagcacgtcgtcggggatggttcgcgcgtcggtggcgtcatcggcgatcagcccgtattcctgggcctcggcgagcagcatgtcgcggcgtacgtcctcgccgagttcgcgtgcggacggggaggagaagacgccgtcgaacggcgtgcggttctcgttggcgacctgggtgaccatcatcttcatggcggcgggcgtggtgatgccgttgcgcgcgaaggcggcgtcggcacgcgctttgacgtcgtcggggacgttgatctggatcaatgccatggtaagcctccttctccttatgtgttttccatataatatcataatctgcttggtgttgattcgggaatgataccgataccgttcgtccatgtctcggcccatgccgtttatttgaatcgttcctggatgggccgcagcgccccggtggcggcgagcaggagcgcggcctgcgcctgccgtcccgtgcggatgccgtcgagccggtatcggcttgtcgccttccatatctcgttttcgcgtttcacgtcgatcaggagcatgtcccgtcggatcacggtgccgtcgatgctgcggacgctccatgtgcacagccaggcgtggatggcgccggcctcgatggggcagccggcccgctggcatgcgtccagggtcgtcctgctgggggtgatctggcgtggctgcgcgccgatgggcgggcggatccgttcgtccatcgagtcgaacgccttcgccgctccttcctcgtcgccggtgtcgatccattcgtccatggcatgtcgccgcatgttggcctcttctccgggtgagggccggcccggcgtatgtgcgggccggccttggtcatgtgtggtcgtcgtcagatcgccggctgctgggatgccgcgggcgcgaacccgtcggtgaaggcgggctgcctggtttgggctcccgtggcgttccacgggtcgttggcgggcatcgtcggctgctggggctgcggctgggccatgggctggctcgactgtggagtgcgtcccgcgaacccgttgtcgcgcggcgccttgttgtaggcgacggtgccggcgcgcaggctgacggcgaggtcggtggcgcgcagttcgaggatgcttcgtttcgctccctgctggttcgtgtattccctttgcacgtagctgccggtgacgatgacgggcacgcctttctgcttgccgtcgggtccggtcggcagcatgctgtgctgcaggtgttcggccaggtatccgctggcggtgcaacggatccatgtggtggcgccgtcctcccattggccggtctgcgggttctgggtgcggctggtctgggcgacgtcgaacgtggcccatatgccgccgtcctgtcgggtgtggaattcgatgctgccggtgtttccgctgatggtcagcgtgacctggttgatggtcgccatgatggtgttcctttccttgcgggttatggctgttctgttttcgggagacggcccgtgccgtcttccgtgtgggtcacctgttgccggcgcgatagcgtcggcctgcccggctcattggttggtggacaggttgatggtgatgacggggttggtgatgtcgggcatggagtcggctggcggccagtcgtcgatgccggcggcctgcatgatggcggcgaggcagccgctgtgggcggcggcgatctcccattgccagcattgcctgttggacagggcgatgaggtggtcccacatggggtagccgttttcgtcgagcgcgggccggccggcgttgagcaggccgatgagttttctgacctgggcgcgcaggcgttcggcttcgcgtgcggtgacggtgtcgacttgttgccagatgcggcgggtggtctcgtcgtcgatgccgttcgcggcctgttcccatgcctggttcctgaggtcggcggcctcctgggtttcggcggggtcgagggtgaggcttttcctccaggtgatgcccatctgccatgcgccggagtcggtggcctgtgtctggctcatgatggtggccgttatcctgtactggctcatgatggtgtcctttcctgtgtcgtggatcgtctgtccggctatcccctgttttttctttttggcctttcggtcaagcgcagcgttaccggccaaagcgggttccgtccaatcgatcgcgccgggcgcagcccgtctgcgtggcgatttgacgggttccgcgacgccggtatgatcgtttcggcttcagccgaaaaggccaaaagggaaacctggggccgcgcccctttgggggcgttcctttttctgatagggcttgcccgtccatcgtgtttcccgcatgtgtgcgggaaaccgatgccggtcggggccggcggctcgggccggcgcggggaggtccgggaggggcgcgtggcccttcccggccgccggaggccgtccccgatcgcctggttggcgcgggcggggactccttggccgtgggtcagccgatggggtggacgggtatcatgaacgttttgccgtcggggagcctgcagggcgcttcggggtcggcgaacatggcggcgtagcgtccgatctgctcgtcgtcgagtccgagggggccgtcctgcgggtggggtcccgtgatgacgaacgtgccgcggatgatgatgggcttgccggcgtccgcgaggcggctgtcctggctgaggcggatggtgcggttcggcttgaggttcttgatcgctccctcttcgtcgcaccagagcgtggtccgccggtcgaggggcaatggttcggcgtatccgccgatcgtcttcccgatggccgtgatgctggggtcgatgtcgcgcagttccggacggcgcaaaggttcgatgacgagcgtcttgatggtgtccatgatggtggtcctttccttgcaggggtttgcctgtcctcccgcatgggcgggaggacgctgctgttattcgtcgatgtggccggcggggatggtcctgcgttgtgccgccctgcggcggcgttgcggggtgtcgatgctcggcggggtgcgccgtctggtcttgcggccgtatatcttccagtcgatgccggcggccgtggccatgatcgctatgacgacgacgttgccgatggcttcggcgaattccgggcttgcgaggtattggctgatgaggtccattgggactccttgtggtttgtcctgagtttgtttccggccttccttggccggcatgtcacgccgtttgcccgccgatgtaggcgtcggcctcggccatggatgcgcagtagcgtccgtagccggcgtcgacccaatggccttgggccttgtggagctggtgcacgtcgtacgggcgtgcgccgtcgcccgtctcctcgacgtcgtaccggtatccgccgcgttcgatgcttttgatgatgttgcgtgccatggtgcttgctcccgtctggtggtcccttgttttttcttttcgaccggttggtcaagcgcagcgttaccggccaaagcgggttccgtcattgagcgatcacgccgggcgcagcccgttgcgtggcgcgttgacgggttccgcgacgccggtatgatccagaggcgaagccgaccggccgaaaagaaaaaggaatgggccggcccgccccttggggcgggttccgtgcgggggaatcgtgccgtgtccgcggcgtggacgcggacgggatgcgatgatggcccctttggggggccttgcaacccgggagcggacatgccggcggcgcggctccttcgtctggtagggcttcgcccgtttcgccgtcgtcccgcctggcggggcgcggcgtctgggtggggtccggcggcgtgggccggccggggtttgcaaaggggcggcgtgagcccctttgcccgccgggggccgtccccgtccgcctgcctgatgcgggcggggactctttcggatgacgggcctgccgtcggcgttttccttctccgtcatgtgagggggtggcggctggcgtcccggttcatgaggtcgcgcaggtcgtcgagcgtgtcgaggcattggcggcgggtgttctccggtgtttcgatgccgtggttggcggcgtggtggtgccagaggacggtttgggcgaggctggaggccttgtgcgccacgtcgtcgagcatttcgtcgagcgcttcggccgtccattgctcccagtgggggtcgtcgtccggcggggcggacagcgcggcgtcgagccggtcgagcatggtttgtatggctttggcgtcttcgaggagttccgcgatggtgccgggttgtcctttcatcgggctcctgacgagggctcgcacgtgttcgtcggggtcgaattgttcggcgtgttcgtgcaccgtttcggggatgggccggcccgaaggcacgtctatgatgaggtcttccccggcggggctgctggtttcgagccattgcccgccggcgaatccggtgtggagcgtccagccctgttgattggcggtggtttcgatggtgttcgcgtgcatggtgtcgtgtcctttccgtcgtggcgtccgacggcgtgtgccgtcggacgccacggctgttttctgtcggtcagcgcaggtatgcggggtatcggccggatgcggccatggcggcgaccatgatggcgaggctggtttccgggtcgtcgtccagtgcggcgagggcggcgagggtggcggccttcccgtcgccgtcccaccatgcgaggtaggcggcgagggcgtagggttgggcgacgggcccgccgtgcttcctggcgcggtcggccatcgcgcacgcctcccgcaccgcgcgtgcgaggcggggctcgtcggggcggatgtgggggtcgtcgaacgcggcgttgagcgtttcggtcagcagcgtcttgttgttgaacgagtggggccgggcggccatgtcgatgacggtcgccgtgtcgagcttgggttcgacggcggcgatgagtgcggcgtccctgatggacaggcgggccgtcatgagcgtggcgaggtcgtcgagccgttccgggtccgcatccttgccgtcgagggcccgcatccatgtctcgagcgcggggccggcgatggtgcggacggcttcgcccgccccctgttcggttgcggcccgcttgagttcctcgatgatgttccgggttgtggcggtcatggtgttttctcctttttgcgtcttttgttttttgaccttcttcggtcagcggatgcgtaccccgcgtaaggcggttccgtcatgaggcgacgccccgccgtccggcggcgtgtgcggcggcgttgacgggttcgccgacgcgggtatgcttcgatgggccgaagaaggccaaacctctgtgtttttgccgtgcccgcccttggcgggctccatgcggcggcatggccggcgggcgcgcggcgcggtcggccgggcgcgcgggcatgggccccgtggggggccgtgcgcgtccgggcggcggcgaccgcgcggtcccgccggttccgtttcccttcgccgtcgccccgcgtcgcggggtgcggcgcctgggtgggctccggcggccgggggccggcccggtttccaaagggcggtttgagccctttggcctgccgggggccgtcgccgcccgcccggcgcgggcggcgactctcgtcagcggcgcggtggcgtgtagtcgagcgtcgtcgcgtatccgctgtcggcggtctcctcgatggctgtttcgtatccggcttcgagtccctgctggtacgcctcctcccacaggtcgtatccgatgaggccgtccgtgtcccagttggtgttgctgacttcgatggccccggtgccgcccgggatggtctcgtggtcggcggtgagccattcgagcctgccgttttggtcgatgagcgcgaacctgccttggcttccgtccgcgaggtcggcctgtccggcctgccatgcgagtatcgcgttgcggctgtcggacgcgtgtcggccgcgcgtgtacgagtgggcgatgccgttgtgggcgatgaagccggtgcggtcgcctttggagaagcggaacgggtgcgtgttcccggtgcacaccctgccgtgggtggcgaggcggaagtgcaggaggaacggggaggtttcgaggctctgccagtggtccatgatgaacgcgagcgtcttcatgttgtcctcgttgcggtagcggtggaggcgttggccgtcgtgccatgcgatgcccgccccgtcggggttggcgtcgctcatccgggcgagctgggtgaggcttggcatggtgtccgcctggctggtgacgatgacgcacatcagattcgtctccttcccgccgtcgtggcgctggcgtcgttgatggcctgtgtggcggcgacgcggctcatggcccggatgtcgcgggtcttgagcttggggacggggaacttctggaagaaccgccacatggcgtgcatgtaatggacggcggcgtcgagtcttccggcggtgtcgtggcgccacgggccgaacgtgcggaattcgatggtgtggcggtgcgtgtcgttgatggcggtgtccttgccgcagtagtcgccgtggatgagctcgcaccagcgggtgtcggtcatgtggcgcatgttcagcgcctcgcattgggtctcgtcgagcgcttccagcgcccagtaccagcgggccggggtctgccggccggtgcggctgatgtgcatgtgcccgcccgacagcgtgttgtcggtgtcggtggcgatgcgttcgacgagtcggcggatttccgtgagttggctcatggtcatgggttcgctctggtattcgagggagccgtcgtggtggaggctgccgtccgggcaccagccggcgatgagcctgtggttcctgagcatgtcggtgtcgtggttgccgtccacttcgatttccagtccgaaggtgaacggctcgcggacgggccgtccctcgtacgggtcccggtagcaggggtcctgcgtgttcgcgcaggcgtgccgttcgtagcagtaggggcagtagcgttcgtcgcactgctcgcagtattcctggcagtccgagcacaggcggtcgtcgcacatgcggcaccggtacccgcagtcctcgcacaggctgtgctcgcagtgctcgcagcagtatgtgcagtccccgcacaggctgtgctcgcagtgctcgcagcagtatgtgcagtccccgcacatccgcgaaccgcattcgttgcatgtgcgcgcgcagtcgtcgcatacagtgttgccgcacccgcattcgacggtttccgtccccgcgcagtcctcgcatagccatccgtcgcagtcgcggcaccgtacggcgcactcccccgactggcgttcgcagtgcctgcaccgacggtcgtccccttggctggcatggttgtttccggtcatttgtcacgctcctatgtcgtcttgtcttccggacggtgcgcggcgggaccggatggccgcggcgcggcgcaagccgcgtggccggtcggcccggtgccgggaccgccttcggcggcggcaccggccggcagacacgcggacgcttgcgacgcgccggacgtccggtcatgctgtgtgccggccggccggacagggtcccgccttcgatggcgggcccccttttcgacgtgctcccgccgtatggcggggcgcggcggcggatccgcgagcccttcgggggcgagctccgttttcggcggcgacccggatccggctggacagggattcccaaaacaggtatcattgtttcctatagtaggaaatcgaggtctggagggatcatggacggttcgttgtcgcggatgcgcgggaaggcggacttccgcctgatgcgggagctgctgggcctgccgcaggagtgggtcgccaagcgcgtgggcgtggacgcgcgcaccgtccgcaactgggagagcccgaggtatttctacccgccgaagcgcgaggcatgggacctggtggagggcctgtggcggcgggccgacgcgaaggcggccggcctggtggagatcgcctcgtcggcggcccgggtggcgcgggagcgcggcgtcgagccggcgccgctcatgctggcgtactggcgggacgcggcccagtgggcgaaggcacatccggaggacgaggatgcgggcatgtggcggatcgagaacgcggcggcgcgcctggccgcggaccggctgcacgccatgggcctgccggtcgcgatcgcgtacgcggagcccgaggcgtgacggacaccgtaggggttatttgacttccatgattcgactgcatggtttggaatcaaggcccgcatccgccgacaggcccccgattgacacttacgtacaaacgccgtacaattatggcatgacggaaaccaccaacaaggccagccgcttcgagatgcggctcacgccatcacagaaggaacgcctcgaccaggcggccgagatcagggggctcagcacctctcaatgggcgttgaccaacctgctcgtcgccgccgaccgggacatccgggagtctcatgtcctccatttggacgacgaggcgtgggattcgttcgtccgggcactggacgggcccatgccggaggagatggtccggctgctcgagagcgagccgatctggaaatgaccgatttcaccccgccgcggcgtctgaccgccgaggacgacgccgacggtttcgactgcggccttcccatcgtgaacaactggctccacggacagctgcggaacgcgggcaagcagcatacggcggtcgcctatgccacgttctgcgacggcgcgctggccgggttctacacgttgagcgcgtacagtatcagccatgccgaggccaatggctggctcaggaggaacagcccggatccgattccggcgattcttctgggcatgctcggcgtggacatgcgctaccagatcatgcacgtgggagcccagctgctcagggacgccgccatacgggcgatgggcgcggcggagatagtcggcgcgaaggcgttgctcgtggaaccggcctcggacagggccacgcgcttctacgagcattacgggttccgccacatcgaacgatcgggcaggatgttcatcccgctccgcccggcgtgaacggggtcgctccccatgggatgaaggaggcggggaaggccgttggaacggtcctccccgcctccttgttttctctcgagccgttttcgtcggtccgccgttcatttccttggcgggcgcgctctgccgtccgagtcgaattgggcgagctgtccgatggcgttgccggtattggccagggctccggtgagcagtcggatccgttcgccggtgtcggcggtccggagggcgagtctgagctggtcgatggccgcgttcacgtggttgcggtagacgaggtcgtcggccgtggccgaatgttccgttttcgcgggcttggggtcgttcatgcgtggttttccttccggtgtttggtccatgaggtcgagcgcctggatgccgagacctgcggcgaggtcgaggatgatgcggctgcgtttgctgccggtggcccaccggcgggtctcgatgcctccgatggtctgcgtggtctgtccggcccggatggcgagttcggcctggctgagcccttgtcgcgtccggtgccaggcgaggcgggtgccggtccatccggcgggcggatcgtccgtggcatggtccggttcgggccggccggagagcttttccatgctggtgtcgagcgcgatggcgacgcgggcgaggatcccggcggccatgttcgcggtgtcgcgttccccggagtcgtattggcgcaggctccggtatggcacgttcgcgtgttcggcgagctgtgggcagctccatccccgttccgtgcgcatcctccggatcacggtggtcccgtcctcccccgtttggggcgtctctccggtgaggcgggcggggttgatgccgagggtcttcgcccattgccggatctggtcgggttcgagcgtggtcagcggggtttcgcctttctcgatccgttcgatggtcgtcatatcgatgccggtgagccgtgcgagggtctgttcgaggacgctttcccgttccctgatcgcgcgtagttccgccgctccgatgggtatggtcctgccggtgccgctcatctgtcgcctcctgtcaggtagatgtcgaacaggggtccgggttcgacgaggccggtgcgggtgtcgatggcctggatggcctcgagggtgccgatcatgttacgtactgcgggtctgctgcgcgtggagaacgcgccgtgcccgtcgatgagttcgagtccctgttcggtgacgctgcggcgggtggatccgtgcagggcggcggcgagcacgcccggtctgacgccgtggccgagctcgcgttggatgttcgcgatgtaccggcaggcgatgcggatcgattcgcggcccatgggctcgccctgtccctcccccgtttccggtgccgtccgccgccggcggtacgggttcgacgccggttttttcacgatctccctaccgtcagcctggcagttggagcagttggagcagtcgtcgcgtctggtgccaggcgggtcgaacatggcgaggatggtccggcgcaggcatcggcgggtctcgcagtatgcgctcatggcgtcgagtcgggagtccatgagctgcgcggccctgatgcgtgaggggtcgccggattcctcggcgcggcttttcgcctcccatgcggcgtggcgcagccatcgccagtcgccggggctccagtagaggaccgcgtcggcaggcttgccgtcccggccggctcggccggcctcctgccagtaggcttcgaggcttttgcacggcccgtcgttgaggacccatctgacgtcgggcttgtcgacgcccatgccgaacgcgctggtggcgcagatgacgcgcggatggccggcgaggaacccgtcctgcacccgtttcttgtccgcgtccctcatttcggcgtggaacgccatggcgtcgatgccttcggaacgcagtgtctcggcgagccgttcgcagcctttccggttctccttgtagattatgccgctgcccttgtgccgtttcgcccaggcgatcatggcctcgaggcgttcgccgggcctggcgcggaccaccgtgaggcgcaggttcggccggtccgcgtcggtcgtgaccgtcacggggtcggccaggtgcaggagttcgcggatctccccggcctgcgtccggcttgcggtggcggtcagcgccatggtcacggggcgcggggacagggagtcgatgaattcgccgatgcgcatgtagctgggtcggaagtccgatccccagtgcagcacgcagtgcgcctcgtcgacggcgagcaggctgatgcggatgcggtggctgaagtcggcgaagtcgggcgcgtgcaggcgttcgggtgcgacgtagaggatgcgcagttcgccggacagggcgcgcccgtacacctcggcgcgttccttctcgctcagcccggagtcgatgagcgcggcgggtatgccgtgtgatcgcaggtgccgcacctggtcgcgcatgagcgccctcaatggtgtgacgacgagggtgaacgtgccgggcctggcggcggggagctggtagcacacggacttgccgccgccggtgggcatcacggccatgacgtcgcggcccgagatgatcgccccgacggcctcctcctggccgggacggaacgagtcgaacccgaagaaccgcttcaatgcggccagcgtgtaatccccgttaccggccattccgtttcctttcttttcacccacaagtttaacaccctcaagtatagcatacttatttattccatggcgtttcaacgaaagcggcggaatcaccggccgcagggcatagattgtttatcgaccgcccagcgcacaaggaggaagccatgcaatcagactcttcaaaggcatatgagaacgcgagggcggaatacgagcgcctgtccggccagccggcattcatccgcctcatccggaggaaaaagctggacgaggccgaaacggacatgagagagaagcacaatgtctgggtcagcgaggaggtgagcgccctcgccaatgcttggaccccggagagacttcctccataccgtatgatggcggaactcgacgcccggttcggtacggacaggggaacggtggagaccttgttacgcagggaatacgatcgctcctatccactgtcctccttccattggccgatgtcccgagttcgcagcatcctgcctgccgccctgagggcatgcgaggaatcctacgaatccgtcagacaggcgggactcctcacgcaggaggttctcgacgcagtcgaccagtggaggaaatccgacggccccacctccgatttccgtcgcctagaggcattgcctccctcttcgaaggtattcgctaagctcccgtcgggccttcgagtctggcatcgaatgcctctgtcccggccgaattctttcttccctgaggattcccgatgccgggcgatgtccggccatgtgctgtcgctgcgacaaggggattccttctctctgatgcacccgttgtcgacctcccccatagcggattggtggggtgccggaacgcccgccgacctgtcccttgacgagccggacaagggaagcggcatcatttgggagatggtcgttttgacgggactggtctggccgaccgacgcctatctgaactatggcgcgcgtcatgcggattctctggaggtcataatcccggcccagacgacctggattgtggacgggtggagagacatcatttacacaaaggagatgacggggttccgcaaactgtcccccgcccccgatgtccgtttccgcacgctgatggttcatcaggtcggtttcaccagaatcaacgtcatcgacgacgatccggcacctgtcatctgacccttgaatcggcgccggcaccatgtcacccgggtgtatggggcggaagcggggtggtatggtgatcggtccggacggttgcggtttcgatatgcgttcgccttcggagatggaggcggatgacgcgcggcgggagtcgtatgaggcggcgcatgcgcctcgtatggcggtcacgtcgcgtatccgccgggtggtgcagccggaaggcgggtatctgccgttgtccctgttcgacgaggtttgtctggctgatccggtgccgttgtttgcgttcgaggatgtcccggccgatgtgacgggcctcgcggtggattatctgtcccgtgtggcgcgtggcgtgccggcgcgggatgcgttccgcgtgccgttggcgggggcgcgtctggtgggccgttctgcggatgcggagcggctgctcgccatggtggacgggttctccgaccgttcggtgcgggccgcgtgcctgctgtgcgggttcgacgcggcgtcgcgtcgggggccggcgaggtggagggcgggcagggtccgcgatccggggccggccacggtgcataacgtgcggcgcatggtggcgcgcacgttgcggttcatggaccggatggggccggtcgtgtgggaggggttcacgttcgacggcggatacacggaccgggtcacgtccggcgacggggacctgctcaccgccgacggcctgtgggatctgaaggtgagccgttggccgccgaacccgacgtacacgctgcagctgctcgtctattggcggctcggcctgcattccacacatcccgagtatctccgtgtgcggcgtctgggcctgtacaacgcgcggtcggacacgatgtggagcatccccgtggcccggatcggcgccgatgtggtccatgcggtggagcgggatgtgatcggctatgcggacggtctctgactctcgcgccggccggcggattctattcgcgggggttcgtggcggggagttccggcacggggcgggcgagcctggcggccgcgtcggcgagcagccggcgggcctggtccacggtgcgggcggcctcgcgttcgcgtcggtcggcgtccgcgacccgtgtcttggtttccgcgtcgaggcgcgcggccttcgcctcggccgctttgaggattttgtcggcttccgtgttggcgtcggacaggagcttctgcgcccgttcgcggctttcgccgattctcctgtcggcttcctggtcgatctcctgtttgcaccgcgtggcctgttcgacctgctcgtccgcttttttcttcgcctcgccggtcatggcttcggctttggcgtgcgccttgccgaggatggtcttggcttcggtttcggccttgtctaggatggccttgcgttcggccttggcgccgttgaccatgttctgcatgtcgacgccgatgtgctcgtaggggttcgacgcctggtattcgagcttcttgttctgctcctgcagcatggtcagacgctggttgagctccccgttctcggtctgccgtccgtggttctcgcgtttgagccggatgatctcggcctggtcgagcgtgcggcgtcgttcgagttccgccacgcgtcgctccacggcgtcggcccggtatccgccgatcgtggccctgggcaggtcgagcggtttcgcctcggcacgcccgtagtcgcggatgggttggatgaactgggtctcctcaccgtcggatcgtctcgtctccgcgccttcggtgtctgtcatgatggttcctttcctgtcggccggcgctgttcgcacgggtcacccgcgccggccgcgataatcggccttcagcgcgcgcagcatggggttatggtatggttcggtgacttccatgaggcgggtcggccgcccgtagggtccgtaggcggtgatggcgggttcgaccgggcggatgatgccggcgcgttcgagttcgagcagcgggtatgcggccgacgggtcggggttcgggtagaacctgccgtccggtgggatggccccgtcgggttcccaggagacgtccagcttcccgccgggtccggtgacggtcagtcccatgccgccgccgtggtggcggccggcgagcaggtgccaggtttcgagcgcgtccgtatccccgccgtgtcgggggtcggcgtgccagggtctgccgcgtgtggcgagcaggtggcggcgttccccgtcgaacctcgccgcatccagtcgcctccatgtccaccggtcgacctcgaagcggatgccgtgtcccctgatgagaggcggcacggccccggtgacggggttcatttgcggtctccgcggatgatgtgtctgacgcacatggcgagcaggacgaggtcgagggcggcggtgacgatccacagccatcccatccgcggcatgatcgcgcattcgatgatcaggaggatgaggatggcgaggcatgcgagggcgaggaggatggccttgcggcgttcgtcgtccatcattcccctccgtccgtctcgtcggtccagtattggtcctcgaaccagtggtcgaagcgcatgtcgcccgatccggtggcggggttcgaggcgagtgtggcctcgtcggccgccgggtcgtacaggcggtctatgtcgaggtcgccgagccagtcctcgagccatgcctcgagtccgctgccctcctcgttgtcgtcgtcggcgatgagccggatggccctgctgatgaggatctcctcgatgacgctgtgggccgcatggttcgcggtcgggtcggcgaggcgggcgcgcaggcgtattgcggcgccgagcatgcggtagaggaattcgcggtcataccggtcgaggtaccggtcgggcaggaggtccgtgacggggttcccgtcgtcctggccgaggtgcgtgccgcggggcatgcggcccagacgtctgatctcgatcctcgtcatggtctcgatcatggacaggttctcgtcgaacagcctgcgcatgcgggtgcccggcatggggcggtcgccgccggtgtcgttgttcatagggtccttccgtacttcgtgtatctcgtgtattccccgtggcgggtgccgatgagcgtgatctgcgcgtccacgatccttttgcgccgttcgagctcgcgtatcccccggttcagccaggcggacagttcgacgcagccgacggtggccgcgtcgcaccggcgcaggtctcgggcgattccctcgagcaggagtccctggaccgcgagctggatcacgccgctgttcttgaactgcttggcggcctgttcgagccggtcgacgggattggccgggcccgcgctcatcgggcggtcccgtccgccatgctcagttcgagccgtcgcagccgttcctcgagtgcgttgatgcgcatggtctgggcgagcaccacgctcatcggcgcgggtcttccctccctgccggcgtcgggggccggggcgtgcgggcgcgtcgtcccggcgtccggcggttcgcgcttccaccgggcgatgcaccgttcgatgcgtttgttgccgatgaggcgcgggtcgagtcccgcctcgcggaagatcctgacggggctttcgccccgacggtagcgtgtgacggcctcgcgtttgaacgagtccgtgtaggtgatgcgcgtgcgggtgacccatgccacggcgtccagtccggacagcaatgccatctcggcgtccgagaaacccgtcatgcccatggcgtccccgcctccggtgcggtccctcccgggattccggagactcgtccggccggtctttccgtcctgtggtcctgcatgtgcggctccttgcctctccggggccctgccttgtggccccttcgcccatgccacccgtggccccttctatatcgggggattcctccgccgcgcaagaccgatctttcttcgtgtccgcagccccaaaacaaaatgttgacaatgacaataaacaacgttattgttgtcaccgtcagcaaaaatattgctgacggctgatagtcgaaggattatcgcagataaaggataaaagaacagagccgctccttgagaagctcaaggaacagggatggcgcatcgaagccaagaagaaaggctggatgtgctacccacccgacaagtcgaagccgggcgttcccatacacaagacaccttcggatgccagatggtatgagaattgcttgaaatacctgagacgcggcgggttccaagagtgagcggtcgctaatcttgcggagacgaagtttcctaggcttgtcaccgcaagattagcacaccctctgttcccccatcaaccttcgaccgctagggcggctggatggcgtgcgcccatggaggcatctcccggcgcacgccatgcaatacatcggataggtgaaacatgacgagagcacgagaatggcaggtttcccttgacttcaaggcgagactcgacgaggacgcggcgttcgacctcatggaagccctcggaagatacggggcctcggtggcggtcgaccccgggcacacgggcggcggactgaccctcgccgtcgatgccccggacggggagacggcgctggccaaggcgcgcacgctcctcgaagagaacatgcccggcgcatcggtgacgggactcgaggcgagggaatgggccgacgccgtggcgcggaaccgcgagcccctatacccgccggtggtgggctacgccgagatcgcgcgcatgaccggcgtcaccagacagagggcgtacgcgtttcccaggatcgaatcctttcccaagccggtgatagagacctcacagggccccctctattccgaggacgcggttcgcgcatgggcgcagacccgcgagctcagacccggacgtccgaaagcgatggaataggaaacgatgcgagagccccgcggccgcacggcgcggggtttattttttacaaggaggaagcggccgttccccgatggattcgtcgggaagggaatcggctgtcaccaggtccggtccggttggatcacgggacgtgtggcccggtccctgagccggaatgattgggtcattcgcgcatgggctccctcgagcatcacggtccaggtcgtcggggacacggtcctgagcccgatgccgttctggaacgccaggatgaggtcgttgcggaccggtgtctggcccttgttccggttctccacggtgtagcgcacctcgagcaggtccttgtggatggcgtattccacgtccgtcaggagcagcccgtcatgttccccgtattccaatggataggatatgaattccttgccccgtggtacgtgccattccctccattccagatggtcttccagatgcatgcacagccaggtggcgagggatagacctcccagcacgatgatggtcacgaataggatgactttcataaaggttcctctttttaggagattcgagcgacatgagcgaaaaagacgggaagcgggttctgagccccgaggagaaggccgaggcggatgccccgaccaacaagcaatggctcgataccatcggcggcccgacgggaagccgccgatgattgtccgattccgatgaccgtcggcattgttttattgccgatatcgggctgatggcggataatcgggatcatgaaggatggaatcaatcaatgcgggggttccggcatcgagtccgttgatcatttcgacggtgtcggaatcgtcaggatcagaccagtggtcaataaggtggagataaagagggccaagcgtctgattgtcgaacagatccctcatcttgccgatatagaattcccaaagcggccggtcgaggatgacggcacgttgaggcctctttttataggggcgttctccaaggacggcctcataggcgccgccttcgtcacgccaggaatacaggcagcccagtcgttcctcgggtatttctccgcgtcggccggagcgtatcagtgcgcggagcttgtcaggcgtacggtcgccgaagtcgaggggatcgcagtcgtcgacgagtacaggcgcaggggcgtcgcactcgccctgaaaaggtacatcgatgcctgggccgccgatcacggcgcttgtctcgtattgtccgtgcccacgaatgaggcagcgcgtggcctcaacgagaagtccggccaccgcgtcctggagcccgatgtccttctcatgcttcaggtcgaatatgccgacggcggtccctgctcccttccctttgctttggaacgtgggcaggaggcaggatacagttgctgggcattccttccaatcgccaaacctggcgggatgtccgtcagggcgggacaatgcccttccgtcgcttcctctcctggagtatccggtgaggaatacttcgccgtcaagtgggagacccgcgacggtgacgggaattggatcgccacgaccagccgtttgaggggcgtacgcgccgacgtcatggactgatgccattccatcaggccccatgcctggcgcttcggcgttcttgtcttcctgatgattcattcctcgtccttcccctggcgagcggccatgcatggactcatggattgggcacgagtccgcgtgttcgggtgtcttggttgagcccgtcattctgcctgctccagttgccagttgccggcgaagcagctgccgccgtgcgaggcgcggtagtcgtggagttccctcgatcgttcgctctcccggcgggattgttcggcccgggttttgcggccggcgcggagcgcgagctcgatgtagcgtgaggcctggcctgggtccgggtcggggtcgaggcgcagcctgtcggcgagggcgcggatggcggtggacgcgtcgatgtcgtcgccgatgcggtcggcgagcatgcggcgcgcccgggtctcgtaggattccggttccgccggccggctctcccccgtgtcgcttccggtgggttggctggcgtcggcatgctccctgcgtcggcgttcgagggttcgctggtcgcaggtcaggtcgtcgcgcagttcgtcgaacaggcgggcgaagcggcgtcccgtgtcgacgcgtttggcctggaacccgttgtcgagcgcgtggtcgaggacccgttccatgagcccgctcgtgtcgggttcgccggcggcgtcgagccgttcgacgagccgagtgacggcgtcggtgtcccgccggcctgccggtttcggggtcaggcccatggcggctcggcggttttcgagccggtcgaggatccatctggcgcgtatcccggcggggacccgctcttccggttcggggccggcgtcttgccagcgttcgtcgtcgggctcacccatagggcggttcgcctcgtccggcgcggatgcggcttcgatgatgtgggcggtttggtttttcccgtcgcggctctccccggtccggggagatgcctccgtaggaggcaaaggggatatttgtttagaagtatttgttcttactataggggtgtcactggtgacacccctggaggtgtcaccagtgacacccctggcttccctttccgggtttagaggtgtcattttgacacccctagattttggcttgtttccgccgttttccagaggtgtcattttgacacctctaaatctgtccgctttcccggcctgttcggcattgccgtcgccgtcacgttcggcccgttcggcgcgttccgccctggcctgtcgtccgggtttctcggacacgtgctcgagggtcacgttcatgcagcattcccagacgacggaccggtacgggtcgggcacgtagttgccgtgctcgtcccattgggcgagcttctggttgccccggcggatgcatcccgtctcctcgagcgccttcagggcacgtttgacgcttgattcgctcgtgtgcgcctcgagcatcagggtgtccacggtgggccatgcgctgcgtccgtcgggctggcagcggtcggccagggcgatgagcacgagtctggccgtggccgtaggtgcgggcgcctccctgagcgcccatgacgtgcattgccagctcatggtcttgcccctttcgtttcgcgttccttcttgtgttcctgcatgagcctgtcgaacgccttgctggtgggttccaggcttccgtacctggctcccgccgatgcggcggcgcggcccatggcttcctcgttcctgtcctcgtgtccgtcatcgcgcatcgccggacagctccttccccgtgtcggcgtcgagggcggtttcgagggcgcggcacaggtcgagcgcctggtcgaacccgtcgagccatgcgcctacccagtcctgggcgtccccgcccccggccggcgtcatgtcgatggtcttgaggcgttccacggccatggcctgccggtcgatcctgccgtgtccgtcgatgatgatccgcatcgtcttccgttcctttcccgtcgcctcatcgggcgagctcttgcaccgtcatgcccaatgtcgtccgggtcgggtcgtggcgtttccgcaccctgtcgcacagggagggcgagggcatacgcgcgaacatgccggggtcgagctcccggatctctcgttcgtgggagacgagcgcgtcgatgacgtcctgcacgcgtgcgcgcagcagatcatgccatctgccgggccatgtctcgcacatcgcggcgaagcacaccatggcctcgtcgcccgcggccttgatgtaccgggtgtgcgcgggcagggcgaggatctcctggatccattgccagtcgtcgccgcgggcggcgtcgatctcgccggagagcatcctccatgcgtcgaacgtcgcgtcgagcatgatcgacgcctgttcccatgtcatggggatcgcggggatctgcagggtgacggcgtcgggttcggcccctgccggggccgtcatcatcgtggtcatggtcgttcctttcgttcctctatggttcgcgggcctcgtcgtccggcttcccgttgtcctttcgtttgttctttcactcgtccatcgccggttttcggccgattacgggcgcctgtgccggcgcatgccctgaggtaggggtagcggtccagtctcggggtggtcccgttgtggtgggcttcgagccagtggcggatctccctgagcaggggacgggcgcggttcgaggtcatgcatcgggtcaggatccgtttccatgcggcgagtccccattcggcctggaccgcgagggcgagggcctccatgtccgtcttgtatccggcgtgtgttttagcaagttggcgtccgctttgtgagcggtgtttttccgcagtgtaggcagcgggttttccgcagggtgtgcggtatcggccgctgcctgtctgcgttgtgttggttatttggtcatgaggatgctccaccacctgggccgtcgtcatcggcgtggtgaaatacaactccaccgcacgctctcgttcctcaagactgaacatacgaaaatccttccgttcggtctccaagaaaacgtccgcagccccctaccacgatattcttgcgcaattcatcacgatgcacaacaagaagtcaaacgtactgcttatctggtcgggtgactggcccacctacagcagcaattccgacaaatactatgtgattcttgccggtgagggcttcgactcgacggatgaggcttggaattggtgcaaagccaacaattacggtccgaacgactgcatgcctatagatttgcagtaacaagtggaatgtgaatgtcgctacgttgctgggtctcctgagttacaagacgtacaatcgggagcatggccaaggacgacgacagaaccaacaagcctgaagaggccggcaagtggggtacagccggaaaatcctcaggaaagaacaacaagaacggcaagggaaaggaatacaaaaccgatcgacggatcgacaaggtattacagctcgcggcggatcgcatagacaccatcgactccagtgccagcgtgcctgaacgactggcacgtgcggcgaaatccagtgaactgctcagcgccgtatggtcgttgccgcccgctcaacgtcttatgttccaccacggcatgcaggtcactgatgtcgaaggcgattccactcccggattcgacggcaataaagaggacgccgaggagttcatttcgatcagctcctccgaaatcgcccgataccagcggctcatgtacgcgaatggcgtcaaaggctcgacacggcggctgctcatcgtgctgcaaggcatggatgcctccggcaagggcggcatcgtgcgtcacgtgttcagccaaggtgacccgatgggcatccattaccatggcttcggcaagcctgcggccgaggagctcgaccacgacttcctctggcgcgtgaagcgtgaagtgcccaaggcggggtggattgccgtattcgaccgttcccattatgaagatgtggtcatgccgcacgtctatggcacctatcccgaagacgtatggcgtgcccgctacgaccagatcaacgatttcgaacgtgaactggccgccagcggatgcgccatcctcaagatcttcctcgtggtaagccaggaagaacagaaaaaacacttcctcgggagactggacgatcccaccaagttctggaaattcgacatctccgatctcgaggcccgcgaccgctgggatgagtatatggccgcatggcaggaggtgttcgagaaaaccagcacggccgccgcaccttggtacctcgtaccggccgataaccgctggtattcgcgagcagtggtctccgaactgctgcgcaccaccttgaagaacatgaacatgacctggccgcccctcgaacccgaggtggaccccgacgaggtgcgccgccggttggcgtgagcgatcctcccactggcggagccaagcgcatggcacggctcttcgcacggctccgcccgctggcgggaggcgtcgcatagcgacggagggtggctcgtgccgccggaataggccactgggtagactgagcattatgactgacgagaaggaatacggatccctggggcggctggcccccgaatgggacggtgacgagcgtgaacggaatcttacggccgatgacatctacgaacgattcttcggctgggtggaagacatcaaaggcatcgaaccatggccgcatcaggaagaggccattatggacctcttggccggcgaccatgtgattttgaataccccgaccggttcgggcaaatcgctggtggcgcttggcatgcacttcgccgccctgtgcactggccgccgctcctattacaccgctccgatcaaggcgctggtgtcggagaaattcttcgacttggtcgaagtgttcggccgcgacaacgtcggcatgatcaccggcgacagccacatcaacgcggacgcgccgatcatctgctgcaccgccgaaatcctcgccaatcaggctttgcgcgaaggcacccatgccgacgtgggccttgtggcgatggacgaattccattattacggtgatccggagcgcggttgggcgtggcaggtgccactgctcacgctgccgcagacccagttcctgctgatgagcgccacgctcggcaatgtggacgccattgccgacaagctctccgatctgaacgacaccccggacgtggatgtaatcgccgacgcgccgcgaccggtgccgttgagctacgaatacacgctcgatccgatggaaaaaaccgtggaactcgccttccgcaacggcgaaaccccgatttatgtggtccatttctcgcaggacgccgcgctggagaccgcgcaggcgctcgcctccaccggcgtgtccagcaaggaacagcgccaagccatcgcagaagccatcaaaggcgtcaaattcaccacagccttcggcaagattctgcagcgactgctgcgcaccggtgtcggcatccatcatgccggcatgctgccacgctaccgccgcctggtcgagcagctcgcccagcagggtctgctgccggtgatttgcggcaccgatacattgggcgtcggcatcaatgtgccgattcactccgtggtgctcacggccctgaccaagttcgacggcaccaagatgcgccgcctgcgcgcccgtgaattccaccagattgccggacgagctggccgtatgggattcgataccgagggactggtgatcgccgaggctcccgaatatgaaatcgaaaaccagaaggccatcgccaaggccgggggagatccgaagaagctcaagaaggtcaagcgcaagaaggctccggaaggttttgtgacctggaaccagagcacgtttgacaagctcatcgacgctgaaccggaaaccctggtcccgcacctgaaaatcacgcattcgatggtgctcaatgaagtggcgcagggcggtgacgcccgtgcccgtatcgacgatctcatcgacgattccgcgcagacccccgaccagaaggagcatctgcaccagcgggccgacgagattttccaaaccctgttcgataccgaagtcatcgaaaccgaggaccgcaaggacggcggcaaggactactacatgacccttgatatgccggacgacttcgccctcgaccagccgctctccccgttcctgctggccgcgctcgaactgctggaccccgagtccgacacctatgcgctggacgtgatttccatggccgaggccacgctcgaagaccccaagcaggtgctgcgtgcccaggagcgtcaggcccgagacaaggcgatggccgatatgaaggctgacggactcgactatgacgagcgtatggataagctgcaggagattacgtatccgaagccgctggaagacatgctcgaagccgcgttcgatcagtaccgccacgatgtgccgtgggccaacgactactggctgtcgccgaaatccgtggtgcgcgacatggtggaaaccgcctccgacttcaccggatacatcacccgatacaacatcgcccgctccgaaggtaccctgttgcgctacctctcggacgcctaccgcacgctggcgcgtaccgtgccgcccgaaaagcgtgacgagcaactcgaagacatcatctcctggctgcgcgtgctcgtgcgctccatcgactcctcgctggtggatgaatgggagaacgccggcgattccgccgaccagtccgaggcggcggcctccttggcggcgccgggcaagaagaacgcggtggtcgaggaccgacgaggccttatcgtgctgatcagaaacgccatgttccgccgtgtgcagcttatggacctcgaccagccggacaagctcggcgcgctcgacaaagactggggctacggtgtgcacgaatgggaagatgtgctcgacgactactacgacgagcacgagtacgtgggcatcggcgccgaagcgcgctcgcccgaactgttcatgttggatgacaagcacgagaacgacgagcatacgtggaaggtgcgtcagattatcgatgattccgatggcgatcacgattgggccatcgaaggcatcgtggacctcgacgccacccaagacaccggcgaagtagtcttccacgactacaaggtgagtaactgattcctttcttggctcccctctctgagggaagccagggtgcagctcgaacgtctgttcgaacactggggtactataggacgttatgagtgagaacgatttgtttggggcggctgatgcgccggagtcgatgacgcggccgttggcggtgcgcatgcgtccacgcactttggacgaggtgattggccaaacgcaggtgttgggccagggctcgccgctgcgccgcctcgccaatccggccagcaaaggcagtctcaccgcgccgagctccgtaatcctgttcggccctccaggcgtcggcaaaaccacgctcgccaccatcgtggccggccaatccggccgcgtgtttgaggaactctccgccgtgacatccggcgtcaaagacgtgcgcgacgtactcacccgcgctcacgaacggctcgtgtcacgcggccaggaaaccgtactgttcatcgacgaggtacatcgcttctccaaatcccagcaggatgcgctgcttcccgccgtcgaaaaccgcgacgtgacctttatcggcgccaccaccgagaacccgagcttttccatcatcaaaccgttgctctcccgttcggtggtcgtcaagcttgagtcattggagcctgatcagctcatcgaactggtgcagcgcgcgctgactgatgaccgcggtctcaggggcgaggtcaaagccacggacgaagccatcgccgacatcgtgcgcatggccggtggtgacgcacgcaagagtctcacgattctggaggccgcggctggcgcggtcactggcgacgaagcccgcaaaaagggcgcacgccgacccatcatcacccccgaaatcgtggctacggtaatggacaccgccaccgtgcgctacgacaaagacggcgatgaccattacgacgtgatttccgcattcatcaaatccatgcggggctccgatccggatgccgccatccattatctggcacgcatgctgaaagcgggtgaagatccgcgcttcatcgcccgtcgcatcatgatcgccgccagcgaggaagtcggcatggccgccccgcagattttgcaggtcaccgtggccgcggcgcaggccgtggcgctggtcggcatgcccgaggcacgtattattttggccgaagctacgattgccgtggccaccgcgcccaaatcaaacgccagctataacgccattaaccaggcgctcgcggacgtggatgccggcaagatcggcgctgttccgctgtatttgaggaacgcccccaccaagcttatgaaagagtggggcaaccacgagggctacaagtatgcgcacgattggcccggtgccgtggcgccacaggaatatatgcccgaagagctgcgtggcaccgagtactaccatcccaacgatcgcggctacgaacacgaagtcagccagcgtcttgccaagattcgcccgatgttgcatggcggggaacccgaacagaaatgaacataggggagtaaagtgtaacgcaacaataacagtgggaaagggaagacaaacaccatggcgaccatcttcatcgtggacgacgatcaggccatcggcgaaatgcttagtcttgttttggaaaacgagggattccagaccgtgacctgcctggacgggctgagggctgtggaaatattccccatcgtcaagcccgatttgattctgcttgacgttatgctccccgggctggacggcacgggggtggcccgccgcatcagagctacctctaatgtgccgattatcatgctcaccgccaaatcagacacacttgacgtcgtggccggcttggaagccggggccgacgactacgtgcccaagcccttcaaagtggccgaattgctggcgcgtatccatgcacgcttccgcatcgccaagccggccgccgaagacggtgccaccggtggcgcaagcggtggcaatgcaaacgtcaaccatctggaacgcggatccatcgtcatcgaccgtttggaacacaccgccaccaaggatggcaaggacctgaatcttactccgatggaattcgagctgctgttcatgcttgcggccgccgccggcgaggccatcagtcgttccagcctgctcaagaatgtctggggatacgagaattccggcgatacgcgcctggtcaatgtgcatgttcaacgccttagggccaaagtggaggacgaccccgagaacccgcaaatcgtgcagaccgtacgtggcatcggctacaagttcgtcactcctgaacaatgaacctgcgccctcgattcagcctcaaacgcttgctgcgccacggacgcgctgaagttcgtcgctcgctgcaggcccgcaccgtggccctcaccgtgattcttacactggccgtggccatcgtcttctctggcgtatcgatggtatcagtgcgcgcctcgctgcttacccaaatcacttcgcagtcgcgtgccgactattcaaacatggtgcagcaggcccaaaccagtctggacgcggccgatgtctccgccacagtgcagatccagcagctggtcaatgacttggcgtcctcgttgcaatccgaggggccctccaacctgataggtgtgtatttgtggagtcgtgataccaactcgcgtgccatcattcccgtatccaccgaacccagctatcaaagtctgatttctgatgacatccgttcgtccgtggcttccgacttggatgacatcgtgttctatcagccggtcgaaattcccggtgattccggcatgtcgggcagcgggacgcccgcagcggtgctcggcaccgtattggactttggcgtggccggcaacctcgaattcttcgccatttattcgtacacgttccagcagcagtccttgacgcagattcagctcagtctggtggtcatctgtgcgttgctgtccatcgtggtgggcgtagtaatctggctggtgattcgtggcatcgtgcgcccgattgaacgagtggcagcggcctcggaaacactggcctccggcaatctcgatatgcgcgttaccgtgaatcgtaaggatgagcttggtgtgctgcagcaatccttcaatacgatggctgatgcgctcaaccagaagattgatgagctggaggaagcaagcgttttccagaaacgatttgtgtccgacgtcagtcatgaattgcgcaccccggtgaccaccatgcgtatggcttccgacctgctcgaaatgaaaaaagacggcttcgacccctccaccaagcgtacggtcgaactgttggccggccagatcagtcgattccaagacatgctcgccgatctgttggaaatctcccgctacgatgccggttatgcggcacttgaccttgtggaaaccgatttatgcgaaccaattgaaacggcagtggaccaagttgccggcatcgcccaagccaaacgggtgccgattcacacgtatctgcccaatgtgcaggttttgactcgtatcgattcgcgtcgagtgattcgcatcgtcagaaatctgttggccaatgccgtcgatttcgctgaggaccggccgatcgaagtgcgtgtcgcggccaaccgcaaagccgtggccatcagcgttcgcgactatggcgttggtatcgacgaagacaaagtcgctcatgtattcgatcgattctggagaagcgacccttcacgttcgcgcgttaccggcggcaccggattgggcttggccatcgccatgactgatgccttgctgcaccacggtactatccgtgtacgttcggcagtgggggagggcacctggttcttggtattgctgccgcgtgaccccgaccaaggtgaggtggcggacgctgaactgccggtgaattttgcttctgaaacgcccgatgacctgcgtattaccggtgggtttggtgtggccaccagccaagtcacacatgattatcatgaggttcgccgcgacacgatgatggggaggccgctatgagacgagtgaccagaacgattgccgccgcaggcgcggccatagtctgttgcgtcacgatgacggcatgctcaagtccgttcggtttgccgattagcggctcggtgcagactctggcaccggtggaacagcagactcagcgtgtttacaccaatcctcagggacctgcggacgatgcgcagccggaaaccatcgtcaaagggttctatgatgccatgcctgccggcgtacagtccgatggctaccgtgtggcccgtgagtttctgaccggttcggcgtcggccggatggaatggcgattcctcggcactggtctacagcggtacgccggatttccgccgccgtgccaatacgatgagtaccccgcaaggggcggagagctcgctgattgtagaagtacagctccaagtggtcggctctctggactcgcatggcgtgtatacgccgacagatagcagcacgatcagcaaagttccttatatcttgattaaaagaagcggccagtggcgcatctcctcgttggagaacggcgtggtgatatccaccgccgattttgaacaagtcttccgccaagtatccgtgtatcaggtgagcacatccggcaaacagctcataccggatgttcgatggctgagctggcgcaactggcgcacccaggcagtcggtgaagtactctcggatgcaccctcctggttggaaggagtgctgcgaggcaccggcttgcctaccatcaaactcgcggtcgacagcgtgccggtgaagaacaatgtggtggagatacaccttaacagcggtatcaatgcgttgaatgaggaagaacgaggcctgctggtacatcgcatccgtctgactatgggcgacggcaatgccgaatacgcgctgaagattaccggcgacggagtggactattctgatgccgacgcaaatgtgaaacttactaccgagcagccgacagcgggcgtatacacgttgaccggtgggcatatcgtttccctggccagctccagtccgttgcgtgtaggggaggcccccggatatgacgatgctcggggcttcgttttttcctcatccggcggtgcggtgttgcgtgcggacggtgtcgtcgaatgcctgaaatctgatggtgcgtcctgtggggtgatgttctccggcgagtcgatgcgatcgattaccgaaggtctggatggcgaagtatgggctgtatccgagaacgggcgcgaattgcatgtgtcagatgggggtaaggaaaccgatctgaagcttgattggcttggcgctgccgacagcattgtggcattggcggtttctccggaagggtgccgattggcgttggcagtcgagggcgaggacacgaacggcgtgatgatgaccggtgtggcgcgcaacggtgataaaacactgagcggtctgagcaaagcggccacccaagtgagtgtgctcagacacgtcaccatgctcacgttctacaacgatctgaatctggtgtacgccaccacacctcctgagggaaacagcgaacaacaagaggcatggcgtcaaatggcaccaggcccggccaatgcgcagcgtctgcctaatggaaccataacgtcgatggcatcggggcagattagcctgtcccgtcgcctggccattgtggacgatttgggtattgttcgctccgtttctggctcactcgacggttcctggaccatcgccgatagccaggtcactgccctcggtgcgcagtagatggtataagaaaaacggtgttcataataacctttcttgttgtatgaggcaacggctttgtcgctcggctggcgagcggcattgccgctgcgcaaccaatcactattactattattggtctgttatcaaggcaaaacagtgttgcgacgccatttttgaaccactgttattaatttgttataaacctgttatcaaactgttatcgcatgcgattgaacatttggcctgtgagcgtcatactagaggctgtcgatgacgaacagtcaccaaacaggatgaaagatcatccaaaaaataaacactgctcgaggaggagtatttatgaagaattggaagaaggccattgccctcgttgcttctgctgctgcgcttgtcagcgttgccgcatgcggttccagcaacgcaggtggcagctcggactccggcaagaagacggttggcttcgttgctgtgggccctgagggcggcttccgtaccgccaacgagaaggacattcagcaggcattcgaggatgccggctttgacctgacctactctccgacccagaacaacgatcagcagaagcagattcaggcgttcaacaagttcgttaacgacgaagtcgacgccatcatcctgtcctccaccgaggattccggttgggatgactccctgaagaaggccgctgaggctgagattccggtcttcaccgttgaccgtaacgtggacgtcaaggacgccgaggccaagaaggccatcgttgctcacatcggaccgtccaacgtctggtgcggcgagcaggctgccgagttcgtgaacaagaacttcccggatggcgccaacggcttcatcctcgaaggccctgccggcctgtccgtggtgaaggatcgtggcactggttgggacaacaaggttgcctccaacgtcaaggttcttgagtcccagtccgctaactggtccactgatgaggccaagaccgtgaccgctggtctgctcgacaagtacaagtccgacaacccgcagttcatcttcgctcagaacgacgagatgggcctcggtgccgctcaggctgttgacgccgccggcctcaagggcaaggtcaagatcatcaccatcgacggtaccaagaacgctctgcaggctcttgttgatggcgacctctcctacgtgatcgagtacaacccgatcttcggtaaggaaaccgctcaggccgtcaaggactatctggatggcaagaccgttgagaaggacatcgagatcgagtccaagaccttcgacgccgcctccgccaaggaagccctggacaacaacacccgcgcctactgataagtctgctgcgactcattgataactggaccaaataattgatgtgatggtgtgagaaggatgttccttccacaccatcactcatgtgtggctcaaatatcacaaaacgataacatttcattctcgtttaaggcaaagacatgacagataaaaaccccatcgtcgtaatgaaaggcattacgattgaattcccgggcgtcaaggccttggatggtgttgatttgactctctacccgggtgaagttcacgccctgatgggtgagaacggtgcaggcaagtccaccatgattaaggctctgaccggtgtgtacaagatcaacgccggctccattatggtggacggcaagcctcagcagttcaacggcaccctcgacgcacaaaacgccggtatcgccaccgtgtatcaggaagtgaacctgtgcaccaacctttccgtcggtgagaacgtgatgctgggccatgaaaagcgcggccccttcggcatcgactggaagaagacccacgaggccgccaagaagtatttggcacagatgggcctcgaatccattgacccgcacactccgctgagctccatctccatcgctatgcagcagctggtcgccatcgcccgcgctatggttatcaacgccaaggtgctgattctcgatgagccgacctcttcgctggatgccaacgaggtcagggacctgttcgcgatcatgcgcaaggtacgtgactcgggcgtggccatcctcttcgtctcccacttcctcgatcagatttatgagattaccgatcgtctgaccattctgcgtaacggccagttcatcaaggaggtcatgaccaaggacaccccgcgcgacgaactcatcggcatgatgattggtaagtccgccgccgagctgtcccagattggtgccaagaaggctcgccgtgaaatcacccctggcgagaagccgatcgtcgatgtcaagggcctcggcaagaagggcaccatcaacccggttgatgttgacatctacaagggtgaggtcgttggcttcgctggcctgctgggctccggtcgtaccgagcttggtcgactcctgtatggtgccgacaagccggattcgggtacctacacgctcaacggcaagaaggtcaacatctccgatccgtacacggctttgaagaacaagatcgcgtactccaccgaaaaccgtcgtgatgagggcatcatcggcgacctgaccgtccgccagaacatccttatcgccctgcaggcaacgcgcggtatgttcaagccgattcccaagaaggaagcggacgccatcgttgacaagtacatgaaggaactcaacgttcgtcccgccgacccggatcgcccggtcaagaatctctccggcggcaaccagcagaaggtgctcattggccgttggctggccacgcaccccgagctgctgattctggacgagccgacccgtggtatcgatatcggtgccaaggctgaaattcagcaggtcgtgcttgacctggcttctcagggcatgggcgttgtcttcatctcctccgagcttgaagaggtcgtgcgtctgtccgacgacatcgaggttctcaaggaccgccacaagatcgcagaaatcgaaaacgacgacaccgtctctcaggcgaccatcgtcgaaaccatcgctaacaccaacgtaaacaccggaaaggaggcatgagatggctgaaaaggcaaaagccgagggcaacaactttgtcaagaagctgctgagcagcaacctgacctggtcgatcgtcgcattcattcttctggtcatcatctgcaccatcttccagcatgacttcctggctctgagctggaacagcaacaccggtggtctggccggcccgctgatcaccatgctccaggaatctgcccgatacctgatgattgcaaccggtatgaccttggttatctccaccgccggtatcgacctttcggtcggttccgttatggcagtggcaggtgccgccgccatgcagaccctgtccaatggcatgaacgtgtggctctccatcctcatcgccttggctgttggtctggccattggctgcgtcaacggcgctctggtttccttcctgggcctacagccgttcatcaccaccctgattatgatgctcgccggccgtggtatggccaaggtcatcacctccggtgagaacaccgacgcctccgcagttgctggcaacgaaccgctgaagtggttcgccaacggcttcattctgggcattcccgccaacttcgtcatcgccgttatcattgtgattctcgttggcctgctgtgccgcaagaccgctatgggcatgatgattgaggccgtgggcatcaaccaggaagcctcccgtatgactggtatcaagccgaagaagatcctcttcctcgtctacgcgatttccggcttcctcgcggctatcgctggtctgttcgccaccgcatccgtgatgcgtgtcgacgtggttaagaccggtcaggacctcgaaatgtacgccattctggcagtcgtcatcggcggtacttcactgctgggtggtaagttctccctcgccggctctgctgtcggtgctgtaattatcgccatgatccgcaagaccatcatcaccctgggcgtcaacgccgaggcaactccggccttcttcgccgtcgttgtgattgtgatctgcgtgatgcaggctccgaagattcacaacctgagcgcgaatatgaaacgcaagcgcgcgctcaaggctcaagctaaggcggtggcagcatgacaacagctacggcaaacaaagtgaaggctcccaagaagggcttcaagctcgatcgtcagatgatcccgaccctcgcggccgtggtgatcttcatcctgatgatcatcatgggtcaggcgttgttcggcacctacattcgactgggcttcatctcctccctgttcattgaccacgcctacctgattattctggctgtggccatgaccctgccgattctgaccggtggtatcgatttgtctgtcggtgctatcgtggccatcaccgcagtcgtcggcctgaagctggcgaacgccggcgtgcccgccttcctggtcatgatcatcatgctgctcatcggcgctgtgttcggcctgctggccggcaccttgatcgaggaattcaacatgcagccgttcatcgcgaccctgtcgacgatgttcctggcccgtggtcttgcctccatcatctccaccgactcgctgaccttcccgcagggcaatgacttctcgttcatctccaacgtgatcaagatcatcgacaatccgaagatctccaacgatctgtccttcaacgtcggcgtgatcatcgcactggtggttgtggtcttcggctacgtcttcctgcaccatacccgcaccggacgcaccatctacgccatcggcggctcccgttcctccgcggaactcatgggtctgccggtcaagcgcacgcagtacatcatctacttgacctctgcgactctcgccgccctggcctcgatcgtgtacaccgcaaacatcggctctgccaagaacactgtgggtgttggctgggagctcgacgccgttgcctccgtggtcatcggcggtacgatcatcaccggtggcttcggctacgtgctcggctccgtgctcggctctctggtccgctccatcctcgatccgctcacctctgacttcggtgtgccggctgaatggaccaccatcgttatcggtctcatgatcctcgtcttcgttgtgcttcagcgcgcggtgatggcggtcggcggagataaaaaatagcgggcttgcccgctcggtctccgcaccgaatacgacacacaccataactgaataggcgggatcagcccggctgctgtgatggcaaggtcacagcagccggcactgcccgccaaagctttctttctccttttcttcctttcgttagcgtgtggggcgtgccccggggttctcccggggcacgccccacacgtgtttggaaagctgggactctattgatgatcggatttatgcacgcttacgtgccgcgcgaatgcggaacgcggtggccagacagcaccagccaatcaggcagataaccgtcatcgtggcaaacgtccatgtgccgccgacggcagtggcgtgagcaaactcagcggtgccttcttctcctgcgccggcctgagccacggaaagaatcgtggagaacagtgcggtaccggcagcgccgccaaactgaagacacgtgttgaaaatggcgttgccgtccggcttgaactcgggagagacctccgacaggccactggtcatcacattcgcattgccgatggaatagaacagaccgaaaatgaaatagaatccggcgagcagcaagggcgtaagctgcatcgagaacaccagcataagcactgggcccaaaatagcgatgccgatcggaatcagaatcggcttgaccgcgccgaacttatcgtagaaccagccgccaagcggggcacagacagcgccgaccagtgctccgggcagtaccagagagccggccacaaatgccgtggtaccgagcgagagctgtgccacattggtgatgacatagccgtagccgatggcgaccaatggcagcagcagatatgcgcaggcgtgtaacagtacggcgggatccttgagaatgccaaggcgcagcagcggggagaaggcacgcttggaactcatggcgaacacgatcaacaaggcgaggcccgcaatcagactgacaatggcgataatgccggagcgtgtggctgacttgccggacaccgccgcactgatggccacgccaccttggttgagcgccagcaccagaccgaccaacgcgacaacaatggacccaagctgaatcgggtcaagataggcagcctcggtcggtgtcttctgctcaatgcacttcatgccgatgcatgctgcgattagcaccagcggaatggcgatgacgaaaatcgcgcgccacggcagcactgtggtcaccgcgccgccgacggtcgggccgatggccggagccacggtaatgaccagcgatcctacgcccatcaatcggccgatcttcgaacgaggagactgctccagaatgatgttgatcatcaacggcgtggccacgcctgagccaatgccctgaataatgcgggcgacaatcagcagcgggaaggcttgggcgacgatcatgatcagcgagccaacgatggccagaatcacagccgcaagaaaaatggttttcagtgcgaatcggcgcttcaaaaacgagctgatgggcatggtggcggccaccgccaacagataaatcgtggtaatccattgcacagtggccgtgtcgacatggaattcgcgcatcagtgcggggaaaagcacggtcatcacggtttcggtcagaatgccaatgaaggcaagtgagccgacggctacaatcgcgccgataagacgtgtgggaatcttctcgttatcaatatgctgctcaggcatacatgctcctaaacgttcggttgcaatgtatggaatgtaaggtttaccaaccggcgtaggtacctgtgcgtgcggataaaccggcaatcgtactgccttggctgcacgctatggaatcacaaaaccacctgcgagtgtacggttcggggcggacgctacggtcgatgcgcaatgggctgtcccttggtttggtggggtttgatggggcgggttcggcattggtccggcggggcgggttcggcattggttcagcatgaggaaacacgcgataatatccgccctgccgcctagtttggtgaaccatgggtattgagaacacgcataagctgattgtcaactgcctgccactcaacgaaggagaacggcgcgctttcgccaaggcggcccgcgatgtgccgcaggaattcgtaggcgacgaagcgcaccgcggcgacatggtctggtcggccgctgttcccgaggagcttcgttcccaagctaccgcagtcatcggcaactttccggtttcgcaggcttcccaatacacccgtcttgaatggttgcagaccttcagcgccggtgtggatgcgtacatccgcccgggtgtgctgcctcgcggcaccatggtcaccaatgcgagcggcgcgtatggccaaagcgtgtcggaacacatgttcgccaccatgtgggcattgatgaagaacctcaaccggtatgcctccaatcagcgtgatcatcagtggcaggatgaaggcccggtattgagcccggaaggtggcatcgcactgattatcggcgtcggcgacatcgggtcgcatttcgctcagcttgcccaatccgtaggtatgtgtaccttcggcgtgcgccgtcatgcggacgtgccggccaagggcattgaaaagatgtatggcttcgagcggctggaagcactgctgccattggcggacgtggtggcgatggcggtgccgcgctcgccgcagacccatcatctgctgaatgcggatcgtctggggcgtctgaaatccacagccatcgtgatcaatgccgggcgtggcgacgccatcgatcccgaggccttggccgacgccttgcacaatggacggctccacggtgccggattggacgtcactgagcctgagccgttgccggcggaaagtccgttgtgggatgagccgcattgcctgatcaccccgcatgtggccggcggcaatcatttggaaaagactttcgaacacatcatccgcatcgccctgaccaacgtttcccgctatgccaaacagcaggaactgttgaatctcgtgcgatactgattcgcctgtgtcgggtgtacatgaactcatgtacacggccggcgtgtcgcatcccgctgcgactgcggcatcgagatgatacctgcagaggcgtggttgatcaggggcccaatgaacgtggcccgaggtcagtctcagtctgatagttcgtagccgttggcgtctttatgccacggtgagccgggcttgctgcacagaatgatgatgccttcaacaaagccccagatggcggctgcgattgggccaagtccgagcagaatccagccgacaagcgtcagcagcagctgggccacggccttgccggtgttgccgagatagaagttgtgcacaccaagtccgccgaggaagatgcccaacaggccggcagccagcttggacttggacgattgccccaccggggcggcggcatacggagcggcggtgtattgcggctgcgcgtaggcgttcggctgctggtaggcctgtccatagccgggctgctggccgtagcccgctgcgggctgtgcgggctggccgtactgcggctggccgtactgaggctgagcgtatgcgccggcgggctggccgtattgcggttgctgctggccgtagcttccggcggcgggttgagcgtatgcggcgggctgtggggcgccatagccctgcggctgctgtgcggcatcttggccgtaagacggttgtgccggctgtgcgggctgtgccggctgcggaacactgtccgaaccgtacggttgttgttgattatcagtcatgcgggtcagtcccctctcaatcgggaacggcaataccttcttaccgtttctgcacaacatcatctcatgttttgcccaatagtaaaacctgccgcgctacgattgggccatgagaagtttcctgaccagctggttgattatgactatcgccgccgccgtcatggtcgcggtgactcccggcatgaccccggtgggggagcctccgattctcggcatcgccgcgttcgctttgttcatggcgctgattaatgcgtcaatcaagccgattgtgcatctgatcgcactgccgtttgcgattctgtctctcgggctggtcaccttgattatcaattggctgttcatgcgactcgccagctggctggcggtcagtctgttcggcgtgggcgtcttcgtacacggtttctggtggtcggtactggggtccttggtcctgaccattgttgcgggaatcgtcgggtccatcttggatcagtgacggtgctcgctgggcgaatatgagtaatggcggttgggatcgggctgattccaaccccccttactcatattaaaccaagggggtgagcgggggggacattactcccgccccaaacggacatgctccccatcttcgcgcccggggggacgggaaagcacgaaaagattgccgctgggctgcaccacttcggcgctcagcctcccggcgagcccggccgcggcgttccttgccggcagggccgaaccgccctgctgcgcttgatctcccggctgatgctggacgggctgcggcccagcatcgcgccgatcccgcgtatgctggcgccgttgcctacctcgatctggatgacctggcgttcctcttccgacaggtgcgaatacacttctcccataggtgcgacatcccttcggactggttatctggacaatctccaatctaacgggtgttgcactttcatttagacaacgggaggcgattactcttgtcgctggttgtcctgtcatctaaagatgacaggacaaccagcgattcttcaggtttcttcattgacgttgttttgttcctaccgagatgtgcataatggatccgcgtctgcgggagccacggcctgacgcggtcgatgggcgcgaagggccgcagtccggacaacgcagccgccgggggcttcggcaggcaagcaggagttcttccacaagcgaagcttccaaggtgtctcgatcgacgagttcgtcacgttgttggacgagtgcatggtctggtacagggacaagcgcatcaaactcgaatacggcatgagcatcatggacaaacgcatcggactcgggctcgtcgcctgaacgcgcgtgctatcgttgcgaacgaccatacagacaacgaagtccaacaaaacgtcacccccccccccgacgagcgttgcacttacaaattgaattcgggacaatggtaacaacagctacagttgaactatgcatgggttgaagagtgcgattgacaggggagcggacgcgtgggcacgttcgctgcctgggcgcgtgctcgaccggtatgtgtcgcggagcggccccctgctggcgaatggtctggcatatggtctgctgttcgccttttttgccggcgtctggattgcggtgagcgtgttcggccttatcatggtcggcaacattgattggcagcagatgctgattgacgcggtgcgtgaagtcattcccggtgtggccgactcgtttctgacgtcttccgcactaaacaccatgtcaagcacattgacgtggaccggtctggccacgttggccatattctggtggacggtgaccggctggatgaactcgctgcgccacgccgtacggtccatgttcgacgactgcggcgacgagctcaatatcgtcgtcgcaaggttacgcgatacgcttgccgccatcgccatcgcaatactgttcattctttcgaccgcggccggtacggtgtccggtggcatcgtacgccgactgctgcaatggggcggcatccccagcagttcgttgcccggcaccgtgcttttggagatgaccggtttctgcaccggcgtcgcgctgaacttcgccttgttcatgctgctgttgcgtgtggtcgcgcacatcaaagccggacgattcacgctgatcggcgcgtcgtcgggttccctgacggtttcggtgatgcagctgctcggcgcgcgactgctgaccggcgcctcccgcaatccgctgctcgcaccgttcgcggcgttgatcggcgcgctggtgtggttcaatctcgtcgcccaggtcatcatgctgtgcgccgccctcatcgcggagtgccgacgggaatgctgaacagccgcccagaccacacggtatggtggggcgcatggctgattacgggaacaactttgtgcaactgcataaccacacgcactattcgctgctcgatggtgcgtcgaagatccctgatttggccaagcgtgcggccgaacttggcatgcctgcggtcggcatcaccgaccatggcaacatgcatggcgcctacgagatgtacaccaactgcgtggccaatggcgtcaagcccatcatcggcatcgaagcttatgtgaccccggaaaccgcacgtcaagacaaatcccgcgtgcattggggcactgaagcccagcgccgcgacgacgtctccggtggtggtcttatcacccacttgaccatgtgggctgaaaacgacgaaggcctggtcaacctcatcaaagcttcgtccgtggccaacctcgaaggtcgcgtcatgcgttatccgcgtatggataaggaggtgctcgccacctattccaaaggcgtaatcgcatcctccggctgcccctcgggcatcatccagacccgtctgcgtctcggtcagttcgatgaggccctgcgcgccgctggcgaattccaggacatcttcggcaaagacaacttcttcatcgaactcatggatcacggtctgcccatcgaaactcaggtgaccggtgacctgctgaccatagccaagaaactcaacgcaccactgctggccactaacgattcccactacgtacacgccgaagatgcccaggcacaggacgccatgctctgcatcaactccggttcccgtcttgacgatccggaccgattcaaattcgacggcaccggctactacatcaaaaccgccgaagagatgcgcgaactgttcaaggaccatccggacgcctgcgacaacaccctcgccatcgccgaacgctgcaacgtgatgttcgacgaccacgaagacggcgcgttcatgccgaaattcccttgccccgaaggctgggatgagacctccctgttccttaaaaaagtcgaggaaggtctggagaagcgttacgacggcaacccgccgctcgacgtattgaagcaggccgactacgaatgtggtgtgatctgccagatgcagttctgcggatacttcctcgtggtcgccgactacattcagtgggccaaggaccacggcattatggtggggccgggccgtggttcggccgcaggcgccatggtcgcctattccatgggcattaccgagctcgatccgctcaagcatggcctgattttcgagaggttcctgaaccctgagcgagtgagccttcctgatatcgatgtcgacttcgaccctgaaggtcgtgcgcgagtcatcgaatactgcggcgaaaaatacggcaccgataaggtcgcccagtgcgtgatctatggcaccatcaaaaccaagcaggccctgaaagactccgcccgcatcatgggttatgaattctcagtcggtgaaaaaatcaccaaggcgctgcctccggcggccaccggcggcaaagacatcagtctgcatgacatcttcgaccctgccgccaaacgttatgccgaggccagggaattccgagaactctacgattccgacccggacaccaagcgcatcaccgaagaagccaagggtatcgaaggcctgatccgacagaccggtgtacatgcctgcgccaccatcatgggtagcgcacccatcaccgacacctcgccgttgctggaacgcaccgatggcaccatcaccaccaccttcgaataccacacgtgcgaaacgttggggctggtcaagatggacttccttggcctgtccaacttgacgatcatccacgacaccctgaagaacatcgaggccaacggcaaacccgccatcgactacaccaagattccgctcgatgacgccgaaacctacaaactcatgtcccgaggagacacgctcggcgtgttccagctcgattccgacggcatgcgttcactgctgaaaaccctgaagcccgataacttcaacgatatttccgcacttatcgccctgtaccgaccgggcccgatgagtatggattcgcacaccaactatgccaagcgcaaaaacggcctgcagaagatcacgccaattcaccctgagcttgaggagcctctgaagcaggtgcttgacgagacctatggtctgatcatctaccaggagcaggtgcagtccgccgcccgaatcctcgccggttattcactgggcaaggcagacgtgctgcgtcgagccatgggtaagaagaagcccgaagtgctggccaaggagaaggtgccgttcttcgccggtatgaaggagcacggatattccgaagaggcatcccaggccgtgtgggatattctggtgccgttctccggctacgctttcaacaaagcgcactccgccgcatacggtctgatctcctactggaccgcatatctgaagacgcactacccggtcgagttcatggccgccctgttgcaaggtgccgccaccaacaaagacaagaccgcactgtacttgggcgaggcccgccgcatgggcatccaggtgctctcgccggacgtcaacgaatcggtgtacgagtactcggcagtcggcgacgtcgtccgattcggtcttggtgccatccgtaacgtgggtgacaaggccgtggccgatatcatcgccgaacgcgaaggcccgcgcggcaagttcgtgaacttcatggacttcatccgccgcgtgcccctgaccgcgctgaaccggcgattggtcgaatcgttgatcaaggccggtgccttcgactcgattgacccgaaccgtcgcgcgctgttcaccgtgcacgaggccgccatcgactcggtggtgagtctgaagcgcaaacaggcggagggccagttcgatttgttctccgatgccgaggatgggggagcggaggccatgggcgacgcttccgtgaccgtacccgatcttgaggaatgggacaagaagaccaagcttaacttcgaacgcgaaatgttgggcctgtatgtgtctgaccatccgctctccggtatgcagtcgattctcgcgtccttgcgtgaaatgtccatcgcgcatctggttgatcgagccaaaacgatgggtgaaggacagcaggtcacgttggctggtttggtcaccaatgtggaccggcgcgtatccaagaagggcaacccctgggccatcgtgaccatcgaagacatggaaagctccgtccaatgcatgttcttcggcaaggtctatgaagcggccgccgccgaactcgccgtggacgccatcgtacagattcgtggccaagtggagttgcgcgacgaaaccgtttctctgagagccacggaaatgcagattccgaccttggaagccgaggatgaacgtccgttggtcatcacgctgccgccggtggcgttggagcgccaacgcatgatgcaactcggtcaggtgctcgctaatcatcctggttactgcgaagtacatcttgcggtgctggatgagaagggtaacgctcaggtgctcacgtttggcgatcgtttccgcgtcaagcgggatacttcgttgtttgctgagatcaagattctgtttggccccagctgcttgcctgccgcctgattggcgggtttcgcccctggcctctccctcacctggctttgctggggactccttcatcagagggagctaaggcatgtgccaccatacgatgtgcgcgactattgtggaacgtatgggcatggagatggcggatactggtaacaacgatgacgagcgacaatggattgccgcgatgctggaacggctgtctcattcgcagttccgcgccaaattcgctttgaccgacaaagaacgagcctatgcccgcaccaaaggcaaggcgaccatcgatcgtcatgcgcgagaaatgttgcgagaccgcataggcgcagccgaaccgaagaacgacggcaggcagacgccatggcgcggccatccggtattcaccgctcagcatgctaccgccacatgctgccgcggatgcatcgaaaaatggcatcatctgcccaaaggccgtgaactcaccgaagcggaggtaaaccgacttgccgatttggtcatggcatggattgagcgggaccttatcaatcatccggttcggtgaagcaccccgcatcctcagtatgcctgtatgccttcaatagttatgagccaacagccaacataggcctcgaaaaccgtagatgcaaggtattggcgaatgcggcagaacgccgaacgttgcctatggcgcgttcgtcaataatgcgacatgatgtctattcaagaagagttgatgaagtgtcaactctgccccaaggaggcggaatatgtactacagcagcggcaattatgaggctttcgcacgtccgaagaagccggccgacgtggacaacaagcatgcatacatcatcggtaccggactggcggcattgtctgcagcctgttatctggtgcgtgatggtcagatgcctggcgagaacatccacatccttgagaaggacccggtacccggcggcgcctgtgacggtcttgatattcccggccttggctatgtgatgcgtggcggccgcgaaatggacaatcatttcgaggtcatgtgggatctgttccgctcgattccctccatcgaaaccgaaggcgtcagcgtactcgacgagtactactggctcaacaaggaggacccgaactactcgctgtgccgcgccaccaagaatctcggcaaggacgcggggctcaagggcaagttcgggctgtccgacaaggcttcgatggaaatcatgaagctgttcttcaccccggacgaagacctgtatgacaagccgatcaccgatttcttcgatgatgaggtgctggactccaacttctggctgtactggcgcaccatgttcgccttcgaaaactggcactccgcgctggaaatgaagctgtacatcaagcgctacattcatcacatcggaggcctgccggacttttccgcgctgcgtttcacccgctacaaccagtacgagtcgatgattctgccgatggtcaagtatctggaatcgcacggcgtcgaattccgctacaacaccaaggtcgagaacgtggaattcgcgattggcgggggagccggccccaagcgcgagcacaccggcgtaggccaagacaccatccagaagattcaggccacctccggcttcttcaagcgcaaccctgccagcacgcccaccaagaagcttgccgtgcgcatcgacgtggaccacgagggtgataaatcctccatcgacctgaccgagaacgatctggtgttcatcaccaacggcggttgcgtggagaactccaccatgggttcccagaactcgcccgccgcatggaacccagacctgaagcccggtggcggctgggatatgtggaagcgtatcgccgaccaggacccgagctttggccatccggagaagttctgctccgatccgaatgccaccaagtggatgagcgccaccgtcaccaccctggacggcgagattccgccgtacatccagaagatctgcaagcgcgacccgttctccggcaaggtcgtcaccggcggcatcgtcaccgtgcaggactccaactggctcatgagttggaccctgaaccgccagcagcagttccgcgaccagcccaaggaccagctgtgcgtatgggtctacggcctgttcccggacaagcccggcaactatgtgaagaagccgatgaccgaatgcaccggtgaagagatttgcgaggagtggctttaccacatgggcgtgccgaccgacaagatcgaggcgctcgcaaagcaccacgccaacaccgtgccggtcatgatgccgtacatcaccgcgttcttcatgccgcgcgcggccggcgaccgcccggacgtggtgcccgatggtgccgtgaacttcgcattccttggccagttcgccgagaccccgcgcgacacgattttcaccaccgaatactcgatgcgcaccggtatggaagctgtctacacgttgctcggcgtggaccgcggcgtgcctgaagtgtggggtagcgtctatgacgtgcgcaacctgctcaacgccaccgtcaaattgcgtgacggtgcaccggtcaccgatatgaagctcaacttcattgaaaaggccgtggtcaagaaggtgctcaagaaactcgacggcaccgatattgccaccctgttacgcgaataccgcgtaatctgacatccatctggctcccctcgactggcacgcgaagcgtgactggggggagttgctcacaacggagtgttaagagaaagacaaaaacatgactgattctgatccccagttaatccgccacgccaccatcgacgatctggacgcgctggccgccatggaatccgaatgcttcccggccgccgaggccgccgaccgctcgtccctgcgcgcccgaatcgagacctatccggaatgtttctggctattgattgatggcgagatcgtcatggcgttcatcaacggtttcgcgaccgatcggcgcgacttgaccgatgacatgtacgaggatgccgcgcagcacaaccctcaaggtgactggcaaatgattttcggcgtggatactgcgccgaagtatcagcatcgcggttgcgccagtacactcatgaggaaagtcattgaagacactcgtgcagctggacgtaaaggcttggtgctcacctgcaaagatcggctggtcggattctatgcgcaatttgggtatgaggacgagggcatttcggagtccactcacggtgacgtggtctggcatcagatgcgcctgaccttctaatccccctttgcttccccctctttgatgctgaggcgtctaaaaaaacagtccggtggactgtttttttagacgaaggcgagacgatagtcgagccataaggacgagagctttttgcgggtgagccgtccgcgtgatcggactgagggaagttgaacgtggaataaattgttgcgacacgccggtgaacatctgatttcgttacgtgagcccataaaaagccggcgtatcctgatggtaacggcgtgattcaagctgatttcgacacgccgatggaacgacgtcgttgcaacgattctggcgtgttttttcgtgcccggtttgcgcgagtccgcgaatgcgtgtaagttatctccttgctgccgctcagcgagtggttctcctccggggagctgcgaggtgggtgagtggtggtggtttgagaactcaagagcgtgtttgtactacttctttatagtcaatgattgccagttcattcctcgcctgattgcctgtcgtggtggttgggtacccgggagggtttgatgaggggtggatgagtacatacgctggtacaaccacgagcgcatcaaacagtcgcttggttggatgagcccggtacaataccgtcaaagccaaggaatggctgcgtgattatctccaagaaaatgtccgcagcccccaactggatgctcgccatcgtcatcgctctggtcgtcggcctgatcgtcggcgtctggcagggcttctgggtcgccgtcatcggcatcccgggcttcattaccactctggccggcatgttgatcttccgtggtctcgccaccgtgatcgtcggcgaatccgtgccgattacctccctcgaattccgtggcattgcccgtaactacctgcccaacatccttggctggtggggtccgttcgacggtctgaccattgtgctcggcatcctgtgcattgtcggctttgcctggagccagctgcgcaagcgcgcccgtgtggccaaggtcggcctggtgcccgagccgatgagcctgaccgtcctcaagattgtgcttgtcgcggtcgtcatcgccttcgtcacctacctgctggcttcctccggtaacgctgatcagggtggtaccccgatcatgctggtgatcgtcggtgtgctggtcttcatctacaacttcatcctgaccaagaccgtgttcggtcgccacgtgtacgccgttggtggcaaccgcaaggccgccatcctctccggtatcaacacccgccgcgtggacttcctgctgttcgtccacatgggcttcctgtccgcagtggccgctgtctgcatgctctcccgtctggcttccgcaactgctcaggccggtatggagttcgagatggacgccatcgccgcctgcttcatcggtggcacggccgtcaccggtggtattggtaccatcccgggcgctgtgatcggtgcattcgtgatgggtgttatcaaccagggtctgtcgatcatgggtgttgacaccgccgtggtgaagaccatcaagggcctcgtgctcctgctggccgtcgccgtggacatcatgtccaagcgcaagaagagctgaccttcccctttctcctcctcgatgtgggattcgtgccggtgccgctggtgcggatcccacactgttatctgccgtcattcttgtaatcaaaggactttttccgccatgaaactcaccgcgcgctccacctcccgtatgtatgcattgacctgcttggcctgcgttatctggctctggcagtcactggtcgaggccaataacgatggctcgctgttcaattgggccactattgtcttctcgctgtgcttgctagtggtcatcggatggagtggttggaatgccgtcgccgggtggaacgccaaggagactgaggccgccacggcaggtgccaaggatgatgagggcagcactgatcggtagcgtatatacggctgttgttgccggggacatataggtcccggcaaatctgcagcgatatgtgcattgcaagccagggattccctggcttttttatgtcgaaacggaactcgacacgggcgcgcaggccgttgggtttgtctagagcctgcatatagttacttatggtaatgactattggtaactaattggaggttgggccagcgatgtgcgattcccgaaccgataccaagaccggcttgcttccggtgaatgaggtgcggagcctcctggatgtctgctggaaagcgaaggctatcaccgagctgatgccggcactgcccaaaggcctgaaaccgcgctacgtacacgtcattgatgccgtctggcatatcaacgaaacgaatgggcaggaaatcggcaccgcacgggtaagcgatgtcagcgcctttctcggcgtcactacgccgagcgttaccaaactcgttggcgagatggtggagcttggtctggtggtcaagcatatggatgccgccgatcggcgtgcggtgacgctcacgctcaccgagcgtggactagatatccgccgcgtttacgtagaggaataccatgcgcatcttagccagctattgggcgggctgaccgtggaacaatgcgaaaccactgtgcgcacattgaccgaagccctgcggcttatgcaggaagacgcgcagcatcgcaaaagcatgtgaatgaatggaggagagcaacgattatgactgattcagcaacacaactacctcacggcggcaaacaacccttttccggcaagctcgtcatcgcggtcgtctcgcttgcgattctgaccttcctcggcatcctgtcggaaacctcactgaacatcgcctactccacgctgatggaggagttctccatcggcgcttcggtggtgcagtggctcaccaccggctatctgctcttgctgtcagtatcgatttcgagctcgccgttcatggtgcgcaagttcgccaccaaaaccctgttcatcatggccgtcgtgatcttcgccgccggcacactgctgggcgcgctcgcggtcaacttcccgatgctgctcgccgcccgactggtcatgtcgctcggtaccggcatctccctgccgcttatcaccaacatccactggcacgaagaagcgtgattccaacatgcaacgccctattatgacttcgcggtcgtttttgcgcacgccgtctgaagcggctgggcccggcgacgaggcaactattcaggacctcgtggatacgttggaggccaaccgttcacggtgcgtgggcatggccgccaacatgatcggcgtgagcaagcgcatcatcgtcttcgtggacgaagatttcggtggccgtatcacggtgatgctcaaccccgtgatcgccgcttcggatggtgccttcgacacccaggaaggctgtttgtcgctgaccggtgaacgccgcacactgcgctgccgccgtatcgaggtcaactacgaggaccgtcggttccgcgcccgccacgccaccttcaccggctggaccgcgcagatcatccaacacgaagtcgatcactgcaacggcatcatcatctgattcattcggtgctcgttgcagcccaccccccccccgaggctggtcatcgcgattacgatgcaattacatcgcaaccgctatgaccagtttttttatgtgcactggtggggtgggtgttctcagcggtgttggggtgccatgcgctggccggttggcttcgctgaggggtgtgggtggtgtcatgttgccagcggttggccggttggcttcgctggaggttctctcagcgtcggtgatgtgccaaagagtggcgggctggcttcgctaaggagcgttaccgtcggtggagaaccagtgcgtgacctgctgccgacgctaagcgttcattaagcgtcgttagcggccaaaacttggacgtgtaacgatgctgggcggttttagcgtcgttgctgtgccaagttgtggtcctctgccgacgctgccagtgcagtagcgtcagcgttgggacaggtgttgggcctttgccgactctataagcgagggaaaatcattcgccggtgcctaagtgggtctattgccatgctgaatacatctgctgagtgtagctatgcgttcgaaggcgatttcgggacctttctcagtagcaaatatgcctaatgcgcggagttatacacttcaccgtgcacttatacacgccaaacgaagcagaaatcgactgctgacagtggacgacacgccagagacgatgtggataacccagagacggtggataacagctgcgcgatcagtggataacctgcaagaaagtgcggttatccaccgacggtagccactgttatgcacattccataccccttggaatcattgggttttccacttatccaccatctcgccatgcgggcttgcgggccaccgcacgaacgtcatacagtgtgcctcacggcgggcaacgtagcccgccgtccacatcacatgaagggggaaacaccatgagcaccgcaaccactactactgccgaaaatgccggtttgccagcaatgctggacaccaaagacgtagccgagatgttcaaacgctgcaatctcgccgtctatgccgaagcgagacgcatatattatcgcgaagtgaatctgaacccatgcaaaaagtatccgaagcaggtgctgcaaagggtcgaatggtggttctgggattggtttgcctatgactgcgccgtcagcggtattggactgaccggcaatgaatccgaagatttacgtatcgaattgcagtacggtccgggcgcaggtatctcgccattcctagccttggccgaattcatgtatgacaaggacgaacgtatcggcacacgcgagatacgtgattttcgcgaacttgatgacaccaatttcgcttcgatgttctggattcgcgatgccagcgcggtcaaaggtcgtctgacagttgaggacatcattcatggtggtgtctacgaggtggcggacgtacatgccgcctcgcaatacgatggtgcgcacggcggcatgatcgtcaatcgcatcgcacatgtgagaggcgtgtggcgatcctgttccatcccgatctatgaggcacgaaggcctgatgacccgcgaatcggtgattcgctggcccgttcattccgggaaaccggatataaaccggactttgccggtctggtgcggtttttctacgggagggccaaagacaccggtctcgactgggaagatgtggaagccgcgcgccaagccggtactttggacgcgctgatcaagaaggccagcaatcggtgaaggattcgcctaacgctgctgtccaagtcggcggccgcgatcacgaatgaagagtgacgcaaccaaacagaccgcgcacacaatggcgaccgtgcggaacgaagcccgcacgccaatggccgatgccgccgctttcggcactccggtgcgcatggccgccgcggtgtgcgtgttcatgatggtgaccagcagcacagccgcagacgtcatgatcgcgaagcccagtaaggcgagcggccggccaccgatacggtcatacatcttgcctgccaccgggttcaggatgcccatggcgatgccgctcggcatcatcaccagaccggacaccagtgcattaacgccaagatcattctgcaaatatgcccatcgcgtacaggaacagctggcgggtggtgaaggtctcgatgaggaacgcggtgatcgggatcatgatgccgttggtaagcatgaatccggtggtcagccattgcacggtgctgctgggcacgtcgaactcgtgcatcaacgtgggcagggcggagatcatcagcgtttggttgaggatggccacaaacgagccgatcatcagggtgatgaccatggcggtggtgttggcgggggtggtgctgttggagttggcggggtggtggagccggcctcagcggtggccggcgaggaattgcgtgacgtcaattatcaagtctcgtttccttggctgagttgtctttcttggcttgcccatactatctgtgccttgactgcattcgaaaaccattgcaatgactagcaacacgctgagacgcggcgtattaattcaatcatttgacaaacttagttcgttcgttttattattggtcctgcaatccgtaatatcgcctactgcaaaggagcgcccaaatgggtctgtgggatgttgacaagatcgagtacgtcggccgcgccaaaggaccgaaggaagacttcgccttccattactacgatgccgacaaggtcgttgccggcaagaagatgaaggattggctgcgcttcggcgttgcttggtggcacaccttcaaccaggaactggttgatccgttcggcaccggcaccgcgcaccgcccgtactacaagtacaccgatccgatggaccaggctctggccaaggtcgactacgccttcgagctgttccagaagctgggcgtcgagtacttctgcttccacgatcgtgacatcgcccccgaaggcgataccctgcgcgagaccaacgccaatctcgacaaggtcgttgacaagatcgacgagaatatgaagtccaccggtgtcaagctgctgtggaacacctcctccctgttcaccaacccgcgcttcgtgtccggcgccgccacttctccgttcgccgacatctacgcctacgccggtggccagctcaagaagagcttggagatcggcaagcgcctgggcgccgagaactacgtgttctggggtggccgcgaaggctacgagaacctgtggaacaccgagatgaagcgcgagaccgaccacatcgccaagttcttccacatgtgcgcagattacgccaaggaaatcggctttgaggcccagttcctgatcgagccgaagccgaaggagccgacgctgcaccagtacgacttcgatgccgccaccgccatcgagttcctgcgcaaccacgacctgaccgacgtcttcaagctgaacttggaaggcaaccacgccaacctggccggccacacctaccagcacgagatccgcgtggcccgcgagtccggcttcctcggttccctcgacgccaaccagggcgacaagctcatcggctgggatatggacgagttcccgaccgatctgtacgagaccgtcgccgtcatgtgggaagtcctgcaggccggctccatcggacctcacggtggtctgaacttcgacgccaagccgcgccgtacctccttctacgaggaggacctgttccgctcccacatcgccggcatggatgcctacgccgccggcctgctggttgccgacaagatgaaccaggacggcttcatccagaatcttcaggccgagcgctacagctcctacgactccggcatcggcaaggacatcgacgagggcaacgtcaccttggccgacctcgaagcctacagcctcgacaagccgcagtccgagctcatcgccgccaccaagtccgatcacctcgagtccgtcaaggccaccatcaacaactacatcattgatgccctggctgaggtcgagtgaccatcggtctgaccgattgaattcgctccatcgggcgtgtacacatcaattatgatgccagtgcgcccgatgggctgattcgatagtttcgccatgtgcggtgttgtgttatgcccgcatggcatctttccattccttctttctcctttctctccttccgctggaaaaccgcctgaggcaacgtcgccaagggcggttttctggttgtggcgggggtgggggggggctctttttaacaactcccctgccaccagccaagagggaaaatccttttttcgcttcttctttgaaaaaaaccccgccacgctcgtccaatggcccttgccgtcgccgtccgtcttcctcgcctccacgggcctggcgtcgatcaccggaggggtctcgcgggcgaacgtgaacacgaagcccgacagcctgcgtttcacgtactggcgctcgatcttcaggccaaggagaggcccacactcttcggcgatcgtcttcagcacgaccctgttcaggttggcggtggattttgccgtggaatcggatacgccaagcagtcggcagaactcatcgcggctgatcttccagattcccgagctgcggtactgcttggcgcgcctgtagaactccttggcgtacttgctcttgaggtcggcgaactcggccagctcgaagcgcgtgaactggctggtcaggtcgttgagcaggaaagcgaactcctcgttgaccccaaccgcgagagtcgcctcctgcgggtcggtgacgaacttcgtgaacagcgcgaactggatgatcttgcccgaatcctcgaacatgtagttcagcgccagcaggcgcgcgttcgtctgcacgatcttgtctgccagctgcttgttggtcaggttcttcctcaatcgcatgaggccgcgcagctcctcgaacgagaactccaccgtggccgtgcccttctccctcacccttgaggcgatcgccatgagcacgtccaggtgcacggcgtcgaacttcttcagcacgacgttgttgaactggttgctgaacttcacgatctcattggacatgactccatactagtacaaagtttatttatttactagttcgctccccttttgtactaagttcgctccccttttgtactaagttcgctccccttttgtactaagttcgctccccttttgtactaagtaccgtccgaaacccgttgggagagtagggctgcggagggcctaaaagaatgtaaaaagattttaaaagatttaaaaagggcgcacggcgccttttttcggacgtcagatcaggccatcggagggcgtctgggcggtcctgcgttcggggttgaccggctcgtatgagggcggctggtatccgtccggcccgtggttctcccatgggtcgtcgtcctcgccgtcccttttgcgccattcctcgctcagcgcctcgtagacgaggtcctggaggttccagttcatgccatcgctggtcctgacgttgtgttccagggccttggcgacggtggccctgaggtcctcgcggctcgtgtagttgtccatcacgtcggtggagcacatggcttccaccagggagccgagctgcacgaggcgggcgatgtgttccttggccctctcgtcgcctccctcgaagccggcggccgactcggccatcgcgccgacctcgatcaggcgcttggttcgggccttgcgttcgcgttccctgcgccgcgccttgaggtcgtcctcgcgggccttgagctgggcctgcctctcctgcagggacttgatctgctcatccaggctcttcaccatcgaaacggctccttacatggtctgcatcatccgtatggtgatatgattctaccagcaaggaaatccctaatcaaagattagggcgcacttacatgcaaccggaggttgcattttccgtaagcgcgccctccgggggccacgggccttgccctttggattcccacccttccgggggagcctcccggcaggcccagcgggtgctcgccgcacccctgggaaccccttgccgcagggccgccgccccgcaccccgccgccctggccgatcacgaaaggagccgaagccgatggcgatctaccatctgtccgtctccaacgtgagccgcgcgagcggttccagggccacggccacgctctcgtacatcaccggcaagcgggtgcatgacgagcggcgcggcgagacctacgactacgggcgcaaggagcgcgtgctgcgcgtcggcaccctgctgccggagggcgcgccggccgagttcgccgaccccgccgtgctgttcaacgcggtcgagctgcacgagaccggacggacggcgaggccggccaagaagatcgtggtggccctgccgcgcgagttcacccccaggcagcgcgtgcaggcgctggaggagtacatccgcgagaacctgaacgcggacggctacgcggccacctacgccatccacgaggacagggagggcaacaatccgcacgcgcacatcctcgtcgccaaccggcagatcgacccggccacgggcggctgggccagactcaagcagcgcatggagtacgtgctggacgagcggggagagcgggtgccgctgatcgaccccgagaccggcaggcagaagaccgacaagcggggccgcaggcagtggaagcgcacgagcgtgtccctgaacccgctcgaccggaaggccaagctcaaggccctgcgcgaatcctgggcgaagacctgtaacgcgcggctggacgagaccgcgagaatcgaccacaggagcctcgaggaccagggcagcgacctcgaacccaccatccacgagggctacgcggccagggccatcgaacgggccgggggcgtcagcgagaggtgcgaggccaaccgtgagatcaggcgcagcaacggcctgctgaccgccatccgcaccgaactcggccggatattcgaccgcctgggcgagctgttcgccgccaagatcaggcagctgcgccaacgccaggcgaggccggaaccggacagggagccgaactggcgctacttcgagggcgacgcgcgccgccagctcgaagccgacagggccgaccacacggcagcgatccgtggaaaactcatgggagccaaggccgacgtgaggaaccgcgaggagtggtggaggagccacggcaccgaggagtttgaggccgccaagcagatcatcgacgtggcgcgagccgcctcgcgcgaggccagggacgcgaacgtcttcaagcgcggcaggctgctgcggaacgccgaacaggtggccggggagcagtccgagaagctgcgcggggcggtgccatggctcgaagacaccgacatcccgagcgactgggaccaggccaacaggttccgcatgagggccaccaaggccatccacgaccacgacatgcagccgaggaccggcctcgtggacgaactggagaggcggctcgaacaggccgagcgggccgagggcgagaagccaagccccgaacaggtgaaggccctcgcactgcgcatggccgaacagcgtgaacgggcggcggaggacccgacgcaggaaacgccgccacaggccccgcaggaacccccgaagcccatcaggacgaaaaaggcgctcaccgacaggttcaagacacggcttgacgagcggctggccgaaaacgaacgcaaacaggccgaaaaacaggccgaacccgacatggaggagacatgggacctctccgaccccgccgacccgctcaacatcggcatgggctggggcacgggaggccacggactcggcctgtgagaacgccgggaacgcaaagggccggcatccgaagacaccggcccgaaatttagaaagacatccttaccagcgggtaacggatacgccgtcgacgccagagccgtctgccgtggcgatgcgcatccacggaccagctgcgacaggggtgtatgtaactccattgattgcgaaggtgatctgtcccgacttattgccggtcgtatagctgttgcgatacggccaggaccccgttgccgttccggtgcctgcaaactgcatgtcacccaaagcgttcccgccagcccagcatccagcattggaatcagcgcatccacgcgagacagttaccgaataatcttcagcctcgctcggcggcagcacgtccaccaattcgccgttgctggaatcaaagagaatcgttgtgccaggttcgccgacaatcatgtccccgcccgacggagtggtggtaagttcatagaacgactcgtcagtggtttcttgagcagatgccaccgggactgccgtcgacaggagcgccagcagagtcattggaaccactgccatcttcaaatgcttggtacgtaacatttttgcccccccctgattaggtatgccagacgtgcgtctgacaaggaaattatagctcttggaccttggattgaacagaccagtaatgcaaagggttggtgtttgaagacgccggccccgcatccgaagacgcggggccacggcccaatcaaaggggatggcgggtaacccatcccgccggcatcggccatccccgaaaagtcatgcatgcccgcctgatcgtaagggggaagttagcagcgcctccgccggcgtttccatcttagccgatacgattggcgtcgtcgatggacgtcttgtagcagggacgaaaaccgaccgcccggcatccgccgggcgacgctgccgcgccagtcgcggcgcggcccgaacgaaaggcgcagcacatgcgcatgggtaacaaggggccgcacggccggccctggatatggctgatggcggtcatcgtcatctgcctcgctcccgtgatggatcccatcgcggccgacatcaccgtgacggccctggccgtctgggcgatggcatccagccgccgttgacggcgcaacctgccgcgggtcggagcccgcggcaggccccttgttcagaaaagagtcggctcgataccaggctccatccgatcatcgggcatggcctgtgaatcatggctgcgtctggccacctcgaatggtgtcagaccatcgtgggccgccttatacgcatccagttcagccctggctcgttccgccgcaagttcaccgcgctcgatcttgatttgctgatggcggtcatcgccgtctgtctcgcaccggcggtgcatcccatcgccgcggacatcatcctcacggccctggccgtctgggcgatgagaaacagccgctaaacggcacccggcccgtccgagcgcaagcccggacgggctttcacataccatcacgcagcactcggccagtcggagacatacccctcggcaccggcgaatccatgaccgccgtgcgcgtcgaggaacgcctgagtatcagggtcgagcgccggtccctcgcccggcaccgacagatcgggcacgggcgtcttcgacacgtccctgagcgacttcctcgcctcatcggtcaccacggagccggacagctccacgcgcggagcgggagcgccgccgggtaccttctccgggtcaaattcaaattcgaacccgacaagggaagcgcggccacgtcccggcttcttcttcaggtacttgcgatgcaccttcagattcagcagaggccccaactcctcctcaatcggcttaagaacatacttgttgatttcgctcggccgatacgatttgggtacgtcgagcagtcggcggaagtcctcaaggctgaccttccacacaccggtttgtcggtactgcttgagcctcctgtagcactccttggcgtagctggagcgcagggccgtgaactcggccagctcgaagcgggtgaactgcgaggtgaggtcgttaagcaggaacgagaagcgcgagttcaccgatacggtgagtgtgcgtttggtcgggctggtgacgaagcctgcgaacagggcgaactggatgatgtcgtgctcttcgttctggaactcgaagttgagcgcgagcaggcgacggttcacattggcaatctgcttggcgaactcatcgttggtcatgttcctctgaagtccggccagccgcttcaattcttcgaacgtgaacgccacctcgtccgtgcccttgtcccgcacgcgagacgcgatggccatcagcaaatcaagatcgagcgcggtgaacttgcgcagcgcctgattgttgaactggttcgagtacttcacgatctcatcggacatgactgcattctaccataaaaacgagatttttatattttctaccctttattctcccaaaacctcgtttttattcctcaaaagcgtcctttattctcccaaaacctcccctaaataattcccaaaacctcccctttaatctcccattttctcccctttaatagtgcgtttcccctactgccgtaaggcctgcggggagtctaaaagagtacaaaagattctataaaaaggggctccgccccgatgaagagaagaaaccgactcagttccaaggctgctgctgccattgctgtggctgttggaatccgggctggtagccatagcccggctgctcctgtatctgaggctcttggggcaggtcacgaacctgttcccgcagctcacccgccgactcagcgctggggagcctcacgcccgcgtcagaggcccatgcgcgcagttcggcggcatgggccttgagcatgtccagcagcctttgccggttgccctcgtcgttccagacgccctcgtcgtagccaagcacgccctcgttggagaggatgccgcccagccggatgatcagatgggtgcgccgcttgcgcgccttggcgttctccctagccacgatgcgctgtttgcgcgccctgagctgcttcatccggcgctcgatgtcggccatctgctcctcgacgctcctggtcatcggttcctccctgcgttccgtcggttatcaatcaggacgctagaccccacggcagcacggcacggggcacggcgtctacacaccaaacctaaacccggaagaacggagccggtttggacatccaagccgcgagggcgaagcgttcatcaatgccgaacgtgccgcccccaggaccaaggccgacctgctcagggagatcaggcagcgcgcagacaggcgcacaggccagcaggaggccgaacagcggcagatcgacccatggcaggcgcaaccgccccagaggcgcggacacggccgctagaacagccttccggcgttccgcgcatgatgttcgcggttgcgcgcgtcaaacgcgcagaaacggcattccccggcctccacggtgccgtcgaagtggtcacgcgcggccgtcacggcgaacagctccgtggtcgtgaacacctcgccataccccgccacgctcgtccaatggcccttgccgtcgccgtccgtcttcctcgcctccacgggcctggcgtcgatcaccggaggggtctcgcgggcgaacgtgaacacgaagcccgacagcctgcgtttcgtggtggtggtttgagaactcaagagcgtgtttgtactacttctttatagtcaatgattgccagttcattcctcgcctgattgcctgtcgtggtggttgggtacccgggagggtttgatgaggggtgaggttttttgagggcgtccttccttaaggacgtgctcgtcaatttttgttttgagagtcatctattcggatgcttttcatgaagtttttttgtggagggttcgattctggctcaggatgaacgctggcggcgtgcttaacacatgcaagtcgaacgggatccatcaggctttgcttggtggtgagagtggcgaacgggtgagtaatgcgtgaccgacctgccccatacaccggaatagctcctggaaacgggtggtaatgccggatgctccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgagagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggtcgtagagatacggcttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctttctacggagaattcagtcggatgttcgtccgacggtgtgcgccccgcgcgtcgcatggtgcgatggcggcggggttgctggtgtggaagacgtcgttggctttgccctgccggtcgtgcggtgggtgcggggtggtatggatgcgcttttgggctcccggatcgccaccccaggctttttgcctggcgcgattcgatgcccgtcgtgcctgggggccggccgtgtgccggcgcgatggcgtggcggtgcgtggtggcttgagaactggatagtggacgcgagcaaaacaagagtttttgaatctttgttttgctgttgatttcgaatcgaactctattgttcgtttcgatcgttttgtgatcatttttagtgtgatgatttgtcgtctgggaatttgctagaggaatcttgcggccatgcactttcgtggtgtgtgttgcttgcaagggcgtatggtggatgccttggcagacaggaccgatgaaggacgtttgaggctgcgatatgcctcggggagccgccaacagggctttgatccgaggatttccgaatgggggaacccaccgaccgtcatgggtcggtaccggcttcggccggggggtacgcagggaagtgaaacatctcagtacctgcaggaaaggatattccgtgagtagtggcgagcgaaagcggatgatggccaaaccttgcgcgtgtgatacccgtcgggggttgcgcgcggggtgttgcgggatcgcgtgcgccggctccgacgggccggccggcagttgcagaaaaccatgtgtcaggggaaccgggttgaataccgggccgcagagggtgagggccccgtacctgaacgcgcatggtctgccgatcgcgtctcccaagtagcacgggtcccgtggaaccccgtgcgaatccgcccagaccgttgggtaagcctgaatattcctgtctgaccgatagcgaacgagtaccgtgagggaaaggtgaaaagtaccccgggaggggagtgaaacagtctctgaaaccgtgcgcctacaatccgtcggagcccttttgtggggtgacggcgtgcctatcgaaaaatgagtctgcgagtcagtggcatgtggcgagcataacccgtgtggggtatgcgtagcgaaggcgagtcttaaaaggcgtttgagtcgcgtgtcctggacccgaagcgggatgatctagccctgagcaggttgaagcgcgggtaagaccgcgtggaggaccgaacccacctgggttgaaaaccggggggatgacttggggctaggggtgaaaggccaatcaaattccgtgatagctggttctctccgaaatgcatttgggtgcagcgtcgggtcattacgtcccgggggtagagctactggatgcttgcgggcccgtatcgggtaccaacagcaaccaaactccgaataccggtgacgcgtatcccggcagtgagtcggcgggggataagcttcgtcgtcgaaagggaaacagcccagaccgtcgtctaaggtcccgaagcgtgtgctaagtgggaaaggatgtggagtcgcatagacagccaggaggttggctcagaagcagccacccttgaaagagtgcgtaacagctcactggtctagtggttccgcgccgacaatgtagcggggctcaagcacaccaccgaagacgcggcagtattttgtactgggtaggagagcgtcccatgaggggcgaagcggccgtgtgaacgcgccgtggacttcatgggagtgagaatgcagacatgagtagcgagagacgggtgaagatcccgtccgctggatgaccaagggttccagggccacgttcatcgtccctgggtgagtcgggtcctaaggcgaggccgacaggcgtagtcgaatggatgaacgggtcgatattcccgtaccggctttcagccgccaaaaccgaggcttggagtactaacctccgggtccgggcttactgctccttcgggggcgggatgccctggcctgttgggaccgatccttgtagtaggtcagcgcaggagtgacgcagaagggtagccggccgcggaggtggtcttccgtggtcaagcacgcagggcgtgggacaggcaaatccgtcccgcatgggtccgaggtgcgatgatgggggccttatggcccgatatccggtgatcccggctgccgagaaaagcttcggcgtcaggctcaaagccgcccgtaccccaaaccgacactggtggtcaggtagagaataccaaagcgatcgagcgaatcctggtcaaggaactcggcaaatcactcccgttccttcggtttaagggagacccccgatggtgaacacacttgctgtgggagcttttgggggtggcacagaccagggggtagcgactgtttaccaaaaacacaggtgcatgcgaaggcgcaagccgctgtatatgcactgacgcctgcccggtgccggaaggttaagaggatccgtcagccttcgggtgaagcggtgaattcaagccccggtaaacggcggtggtaactataaccatcctaaggtagcgaaattccttgtcgggtaagttccgacctgcacgaatggcgtaacgacttccccactgtctcgaccaggagctcggcgaaattgcagtacgagtaaagatgctcgttaagcgcagaaggacgaaaagaccccgggacctttactataccttggtattggcattcggtgtggattgtgtagcataggcgggaggccgagaggcgcggtcgccagatcgcgcggagccgtaaggtgaaataccgctctgttcgcattggatgtctaacctcgaacagtcatcctgttcagggacagtgcctggcgggtagtttaactggggcggttgcctcccaaagagtaacggaggcgcccaaaggtccgctcagcccggttggcaatcgggtggcgagtgcaagtgcacaagcgggcttgactgcgaggacgacggtccgagcagggacgaaagtcgggactagtgatccggtgccggtgtacggacgcggcatcgctcaacggataaaaggtaccccggggataacaggctgatcattcccaagagtccatatcgacgggatggtttggcacctcgatgtcggctcgtcgcatcctggggctggagcaggtcccaagggttcggctgttcgccgattaaagcggcacgcgagctgggttcagaacgtcgtgagacagtttggtctctatcctctgcgctcgttggaatgctgaggaggcctgcccatagtacgagaggacctgggtggacgaacctctggtatgccggttgtcacgccagtggcacggccggttggctacgttcggaagggataaccgctgaaagcatctaagcgggaagcctgctccaagataagcattccgtggaaccttcgagttcctgtagtccccatgcagaacacgtggtcgataggccggacgtggaagccccgcgaggggtggagccgaccggtactaacggacgaaaggcaacaccaacattccaacccctggcggttggaccgcatcttcctcctgcaaacgacaccagacggcaatgagcattgtctggccacaagacgaaacatcgacatatccgcgtccgctgtccggttcccaggccgccacaggccggcagaccccagcgtctgaccgtataagagaagatttgcggcggccatggcccaggtgagacgcccggtcccattccgaacccggaagctaaggcctggcacggcgatggtactgcacccgacagggtgtgggagagtagcacgccgccgcaaccctcccatatggcgatacgccatcgcgggccgttacacggtattgatacattgttcacgattcatacaaaccaccatgtgcaacccacacaacaccgcagagaaagggaacgcaaatgaacctgctcgccaagctgggcatgggcgagaggacccgacgcaatttcgtggccatcctgctcgtggccgccggcggctccatcatctatgggctgccctacttccactacgattactacgaggcctacgcgcaggcctaccacctcaccaacacgcagatcggcgtgttcggcagcatcttcggcgtgttcggcatgatctcctacctgttcggcggctacttggccgaccgggtcagcatccgcctgctgctgtcgctgtcgctgatcggcaccggactcggcggcttcatccatctgctgccgctgaacttccccgagctcgtggccctgtactcgttctggggcttcacctcgctgttcgcgttttggccgtgctgcgtcaaggcggtgcgcgtcctgtccagccccgaggacaagggcaagtccttcggctggttcgagggcgcgcgcggcgtggcctccgcgatcatgaccccgctggccgtcatcgccttccgcttcggcatgaacgcggacggcaagcacgacatcgccggcatgcggcaggtcatcgtcttctactcggtcatcaccgtgttctccggcctgctcgtcctgtggaagatgcgcgacgacggctcgaagatcgacaaaagcgaacaggtcacgttcaaggacatcggcaccgtactgcggatgccggccatctggatcatcggcctggtcacgttctgcaactacgtgttcacgctgtccgtctactacttcacaccctacggcacgtcgctgctgggcatgtccgtgaccgccggcgcggtgctcgccgccgccaagcgctacgtgacgcccgtgtcgaacgtgggcggcggctatctggccgacaaattcggcacgagccgcctgctgctcatctccttcctggtcatggccatcggcaccgcggcgatcctgctcctgccgttgaacgactcctcgacgatcgtgttcgtgatcgtgttcctcatcatctacttcttctacaacgtgaactacccgctgacctgggccatgatggacgagggcgcgatccccgagcgcgtgtcgggcacggccgccggcatcatctccaccatcggctacctgcccgaggtgttcgtctccctgctcgccggcgccctgatcgacgggcatccgggcgtcgccggctaccgcatgttcttcggcttcctcatcgccatgctgctgctgggcgccgtgttcgtcgtcgtgtggcagcggttcctccggaagcacggtctgggcaagggctccgccgcgaagaccgaagcacaggccggagcgcagcccgctgcgaaggatgccgcggcatgatcccctcccgcctgagcgccccgacgcgcccggtccacgacgtgcgctcgtgcatcgtcgaacgcgtgtgggtcgaaacgcccgtggatacggacggcgacggtatggccgacctgatcgccgtgtacatccgccgcccgctggcgtgcgacgacggtctggtggtgccggccatctacgtggccgacccgtacatgctggggtgcgacgacgacggctacgcgccgcatcccaccgacgtcgagctgggcggcgcgcagtccgccggcaccggagcgggtgatacgacggcaccggccggccgaggagccgaagccgactcccccacatggccggaccccgaccctgatccccgcgcgcgattcggcgcggagcagccgagcccggccatggcgcggggccgcttccgcaccccgcgcggcaccggccccgcgcaccgcctcgccccggacgagatgcccgagctggagtgcatcagcgactactacgcgttctacaactcgtgcggctacgccaccgtgttcgccggcggccttggcacgcgcggctcacaggggttcaacgactgcggctcccccgaggagaccgccgcgttcgccgccgtgatcgactggctcaacgggcgcgcccgcgcgtttacgaatcccgccgacggcatcgaggtgcgcgccgactgggccagcggcaaggtcgccatgaccggcaaaagctacctgggcacaatgtgcgtggcgcttgccgccgcgggcgttgacgggctggagacgatcctgccggtcgcagggatcagcgactggtatcggtactaccgctgcaatggactggcgtgccccgcgctcggatggcagggcgacgacatcgacctgctggcggccttctgcttcagccgggaacgcgacggtctcgatgccggcgcccggcggcgctatcaggtccatctcgacgcgatccgcgcccatatggaccgcgagggcggcgcatacaaccggtggtggcatgaacgcaactatctggcccacctgccggaacatccttgccccgcgttcatcatgcaggggctcaacgacatgaacgtcaagccgtcgcaggccgtgcgcctgcgggatgccctgcacgggcgaggcacgcgctcctgcctggtgctgcaccgtggcgaccactgctacacgcatgatctcgaaggcaatccggtgaacgggtacgcgcaccgatggctcgaccattacttggtcgaccgcagcaccgatatcgcggacatcccttcggtgctgatccaggacgacctcgatcccggcgtatggcgtgaggagccatcgttccccgcgccggatgcgcgcccgctgccggagttcgcgcgtgcggaccgcacgcagcgcgatgcatgcggcgtcatcgccgacgacgtggatgccaccgcgttccgccgcgacgccccggaagactcgatcggcccgtggcgcgacgagctgatcctcgccgaccccgagccgcgccactgcctgcgcttcgacaccgccccgctgactgcgaccacgcgattcggcggcacgccggtcgtgcggttcgcggcgagcttcgacgcgccggccgcgatcctgagcgtcatgctggtcgacatcggatcgcaccgccgcctcaccacggctcaggtgagcaccggcagcctggtctgcgggctcgacggcccgaccattcccacgaagcgcttcgcggtggagcgggagacttcggcataccgcatcctctcgcgcggctggatggacgcgcgcaacgccgaggcgccgtgggccagacgccgtctggaaccggacgcgtggcaccgctacgccatcgccatggagccattcgaccagaccgtcacagcgggcgaccgcctgcgactcatcatcttcggcaccgacccggaggccacgacgaagccccgcgggcaacggctgatcacgatcaacacggcatccgtcacgctcgagctcggatgagccgccgacccgggcaagattcggcggtccgggtttcgaccacacccaagcagggatcagaaaggaagtaacgccatgcgactgggacgcataacggcggcgttggccgcagtggccgcggtgctggcgctggcgtccggctgcggcggcgcgcgcaccggcgcgacgggcgccgacgccacgatatcggtctattccaccgagccccgttccgcgctgacgccgggcggggccggcgacgccggcgggttctgcgtgctgtccacgcttctcgccgggctggtcgtctacgacgagcagggcaagcccgtcaacgaggtcgcctcgtccatcacgccgaacgacgattccaccgtgttcacggtcacgctcggccacggctggaccttcaccgatggcacgccggtgacggcgcggtccttcacacgcgcgtggagctatgcggcgaatcccgcgaacgcgcagatcaacgccagctatttcgcgaacatccaaggctacggcgacctgcagcgatccacggacggcacggagcagctgtccgggctcgtcgtcaccggcgacgaatccttcgagatccatctgagcgcgcccgattcgatactgccccagaaactcggcacggtcccgttcctgccgctgcccgactcgttctacgacgatcccgacgcgtatgcgagcaagccggtcggcaacggcgcctaccgcttctcgtcgtggacgcacggccaggatctcacggtgacccgcaacgacggctaccatggcgcgatgcccgcacgcaacggcggcatcgacttccgcttctacacgtccacggacgccgcgttcatggacgtgatcgccggcaatctcgacctgctcgacgaggtgccggcctcgaagtacgcggtgtacgccagcaccgacggcatccgctcctacacggtgccaggcgccgaaacccaagggctgaacatccccgagcggctcgcccatttcggcggcgacgaaggacggctgcgccgccatgcgatctccatggcgatcgaccgcgacctgatctgctccaagatcttccatggcaccagacagccggccgtggatttctccgcaccgacgatcaccggatacagcgaccagctcgccaacgcgcggcacctcgcccataatgccgcgcaggccaaggagctctgggcacaggccgacgcgatctccccgtggagcggcacgctgaggctgtcgtacagcgccgattccaacgatcaggcatgggtcgaggccgtggcgaaccagatcgcgaacacgctgggcatcagcgcccaggccgagccgtggacctcacgcaaggagctgcgcaccgccgccgtcgacgggacgatcgactcgccgtacggcagcgaatggcctccggactatccgcatatcgagaactatctgacgcagcgcttcgcctcgaacggcgggtacaacgaattcggctacgcgagccggcaggtcgacgatctgctggctcgcgccgcagcaagtacggacgaggatcaggccgtcgcacgctatcaggaggcggaggagatcctgctcgacgacctgccgcagattcccctgtggtacgccaatgtggccgcggtgtcgtcgatggcgctgacgcatgcggcgttcacgtacagcaactatccactgtacgcggcgctggagaagtagcgggaaccccacccgccccatgagtacatacgctggtacaaccacgagcgcatcaaacagtcgcttggttggatgagcccggtacaataccgtcaaagccaaggaatggctgcgtgattatctccaagaaaatgtccgcagccccctacccgcacgttccctgattatctcggctgaatatgtatcacaacagggactcagcgcaattgacgatgaattgctccgactggccgacaggaaagcgctcatcgaagtttatgtccgtttgccggcgactgctgcggtggcaaccagaacacgaatagaacggaatattaatcggctgcgtgctattgggtgcattgtccggaccgtcgaatcgtgttccgattttgccataatcgatgacggattgatttggtttggaggcatccctttacttggcaatccaaggagtgacgactgtgcacttcgattcaaagatacgaaaatcggcgagaatctagcagatggactgaaacgacggtcgtcctgagtcaatattcagttaagataatcgcgcagtacgagggcgtgattgatgtgcgggtccttggcggcatagagcagggtcacgtcgggatgctccgcgcagatgtggcgcagattgtccacggcggcattggcgtcgagctcggcgatgtaacgcatgcggaattccgcgaatttggcggggtcatggccgaaccatttgcgcaggaggggagagggagcgacgtccttcagccacaggtccaacgccgcacgctctttcgtcatgccgcgaggccacaggcgatccaccagcacccgatacccgtccgacgcagtcggctcttcatatatacgtttgattgcaatacccatacaccccatgattggtgtgcgcttgccggaagtcaaggggagacgcgatccatctacccgttcgatttctgggtgttctgtctgaggccttgtgctatgacagctagcgattcagcagcttttggtgatatcgtccaaccggaccgccttgcccctgtcgaaggtgttcatagtgagatcgacgggtttggtcttgatgaacgctgacagcgcggtgtgcggcgggttgtcgatcaagtgggtgatggggggcaatcgccttctcgacgctgacgcccacaatggcgtaaatggcacgcgccagcagcttcatcagtggcgaatcgaaactgttcaatgcctcattgctgcgcacggcccaagggttgaacaacacatagtggatgcggcctccggtctgctgttggttttccgcgaagagcactcccagcagatcgttcagacgactcgtacagatagtcgcgcaatgctagaacgtgattgatgtgcacccttcattgacggtctctcaattgatctcctgcgattcatgccgtataaggaagttctcgaccaaggcgatcatcgtgtccttccccgcaggtgcggacagcgcaatcatcagcgtcatcgccgccaaggcgttaccctccacaagcaggggagtcatcgtcgcccagtatactgttgccgttcaggaaatacacgaacagtgcggcggcacaacgtttattgccgtcggagaacgggtgatccttgacaacttgatacagcaggttcgcggctttctcctgggtggaacggtacagttcttcgcctccgaacgtctggtagagtcctgcgacgattccttggaacgaaccgttgcgttccctcccgaacagatcggattgcgtgtagaacggcatcgaccggatgaacagcatcgcgtcctcataggtcaagacccactgggactcgtcgcccttgggtatagggacattgcctgtgtcatagtcgttaagcagcacaagactcggcaaatatcgttccaagatctctgcggtgccagcaatttccggttcggtggacctcgatagcaccttgacgacggcgtgaagtgcgtcaagccgcttgcgattgatgatataaccatcaacgagatgctgcttcagaactgagttggcccatcgccgggaatagatgccttccttggatttgacgcggtatccgaccgacaggatcatatccaagttgtaatgctcgacttggtatgtcttaccgtcagatgcagttgtcgcaaattctgcgacaactgaaaatccattgagctcttccctcaatgcattgccgatatgcttgccgattgttttgatatcgcggccaaacagcaatgccaattgctgtctgttaagccacaccgtgtcctcgtccaccttcacatcgaggtgcacggtgtggtccgcgctctcgtacaaagcaatctgctgcttcagttcctcgccagtcatgagattacctctctttttcggctgtctgtaaatcatgtcgttggcgtcgccaaattatgcatccagtttatcaggacagtcgaacatttgttcgattactgtatctctcatctttgtatgactttcccgacgacgtattggctatgacggaggtaatgggcacggggataatgctgatgatgggcatttccatcatgcaaaaacctatgccccgtattgaaaaaagctattggaccaagccgttgggcttaggccatgataattgggccattgcgcggcttatccgttcgacggatgttccggatttgcgatggcgttgaattgcaattatcaaatgaaagagcaaattgtatgagcgaaaacaatgatgccaaacacgtgctgttggtgttgatcagtcactccgatttgggaggtgtgagacctactggcttttatgttgatgaggccgcacatccttggcaggtgttcagacgaatgggcttcactgtgggccttgcatccatcgctggtggcgtaccgccgcaggctggccgtcatcccggtgaccctgtgcaagagcaatttctgcatgatgcggatatatcacgccagctagtgaatacgcgcgccttggctcaagtaaacgcgaaccgatatgatgcggtgctattcgttggcggtcacggtgtgatgtgggatttccccaacaattctgtggtgaacgccgtcggccggaacatctgggagcgcggcggcattgtgccatgggcctgcggcattggtggatatgacgttgtcggatggcagttatctgattgccggcaagcaggtcaccggattcaccaacggcgaagagcaaaatctcgggcgttatccgtggctgcggcgggcgaatagaagggagattgagatagaggcaggggagatgccgggtgcatcgccggcatcacgcctccgtgaaatactcgttttcgtccgcaagccggccgcctttgatgaacaggaatcgctcgcacaactcctgcagctggagatgagcatggcgatgctgcggtcggaagcccactgtctgagcacggcgatgagctggagcacgccgtccgggtcgaggtccacgaacggttcgccgagaatcaggaactccggatcattgaccagcgcgatggaccaacgcaagacgctgtttcatgctgaacgagaaaccggcgggcctgcggtcgcggtacggccaaagtcccacaagttcaagcaccgggcggattgggaggcgcgagcggtgggtcggacgattacagtgtgagccgaatacgttcatgaatcatcgaatcacaaggcgaggcggaccgcaagtattcgagagtcgccagttcggtcgatttcaatgacaatggtgtggacgattacgcggatatggggctgcggacattttcttggagataatcacgcagccattccttggctttgacggtattgtaccgggctcatccaaccaagcgactgtttgatgcgctcgtggttgtaccagcgtatgtactcattgtgttttagcaagttggcgtccgctttgtgagcggtgtttttccgcagtgtaggcagcgggttttccgcagggtgtgcggtatcggccgctgcctgtctgcgttgtgttggttatttggtcatgagggcgtgttcgcttcggtaggagcggccctcgaatctgatgagccgtccgtggtggacggtgcggtcgatgagggcggcggccatgttcttgtcgccgagcacgcgtccccatccgctgaattcgatgttggtggtgtagatgatgctccttgtctcgtaggaatcggaaatgatctggaagaggagcctgctgccctcctcgtctatgggcaggtagccgaactcgtcgatgatgagaagtcgggccttgccgatgctcgcgagttcccggtcgagccggttctcctgctgggcgcggcgcagacgcatgagcagtccggtcgcggtgaagaagcgcaccgggacgccccgctcgcaggcgagccgtccgatcgcgatggccaggtggctcttgccggtgccgacgggcccgtagagcacgaggtcctcgcatccggcgacgaagtcgaggttctcgagctgcgcgcgcccccagtcggcgggcatcttcaggttggtccagtcatagccgtcgagggtcttgtcggcggggaagccggcctgtttgagcaggcgcaggcgtttggatcgctcgcgcgagtcgagttcggccgtgaaccatcgttcgatgaagtcgagctggttgggcgtggcctcggcgagcgtgccggcgagcacgctgcgtgtcagggtcaggctgcggctcatcttcaggatgcgttcgcttttctcggtcgtggacgcgcgcctgcgtcgggtctccgggatcaccggatcgggtctgacgctcaccgttcttcccctccgtcgtccgtgccggtgatgaaccggtcgtagccgctcaggtcgggctcctcgatcccgccggggtattcccactcgccgtcgcgcatgcgcaacgcgatcggggtgagcgagtccgcgtgcaggcccatgtccctgttcgagcgcaggatctcgccgcacgcctgcatcgcgggatcgaacccggccgcccggcacgcgtccccgatcgctttgaggctctccctcaacgtcttttcgtccatggaatcaagccacgcgcgtatatcgtcgggcacgtccgggcggatcgagctttcccgccacgcgcggggtttgaccgcgagccggggaagcacgagcgcgggatcctccacattgcgcgaccgtccgtactgtctgggatactccgcgaagagctcgccggtggcgggcgaggtgagcgtgaccgtgtcccaccggatcgcggccagcaccttggaacgcgccgaatcggggccggcgaggtaccggttcgagtcgatgtcgaccagcccgtacttgtcggccgtccggctttcccagcgaaccgggtcgaacgccgtggacggcaacggcatcaacgcggccctctcctcgtcgaacacctcggccacgggcacgtccagcaacctcgggcaatacgagtccctggcgagcccgtcgcaccgctccagcaggagacggctcaactgcccatacgattccgcgcgcatgggcggcaccatgagattgcgccgcaaaaacccgaccgcgttctccacgctgcccttctcgttgcccgaatacgggttgcagaaccggacctcgagccggtaatgcgccacgaacgcggagaacaccccggtcaacgcgacctcgcccttcgcgttgcgccggccggcaccggtcgcgttgtccatcacgatcacgggaggaacacccccgatatgctcgaacacgagcatcaggccatggcacagacactccgcgttctcgcccggcaacgccacgcacaaccgcatgttcgaatacggcaacgagaccaccaggcaatgcacgtccgccatctcgccagcgatccgggcccgggccacgccgaaatcgacctgcatgctgcccgccgcccactcgagccgcacgtacccctcgcgatccggcacgccgcggttcgcctcgcgccaccggtgcacgtaacgcatcgtggtcgaatactcgccgtcgtaatccgtctccgccagcagacggtcgtgcacgcgcctgatcgtgtgccgctgcttcctgggcagcagacgatcggcctccagccactcgtccaccagatgcgcgtacgggtcgatcttcgacccgtacctgcgatccgccttcggcttgggcgagcaatcctccatatccgcgtacttcgcgaccgtcccgcgatccacgtgaagacgccgcgctatctgcgcgcgcgacattccctgccggtcgagtctcctgatatcttgcacaatgggcatcggtatcgccatgttcctttccttcccgagcgccggccggcggcaaccggccgaatcaaaaccgattggcaactcgggaatatacaggcggcggcaccgatgcctatcacatcaccgggaaacgatgacgacaccggggaaaaccatcagcccacactacggaaaaacactgccgaacctgtcgaacaaacattgaagcaaaacatcatgaccaaataaccaacacaacgcagacaggcagcggccgataccgcacaccctgcggaaaacccgctgcctacactgcggaaaaacaccgctcacaaagcggacgccaacttgctaaaacacacaccgggaaccgggcctggcgcatgagccttgcccgtttggaggcctccctgttggccagttccgtggcgagcatgcggtcgatggcgtccagttggcggggcgtggcccattcgagcgtttcgtcgatggtggcctgcgagatgaacaggctcctcgcccgctcgcgcagcgggccggggtcggtccgtccgttcttctggttcactcgtcctccttggtgtaggcgatgtcgtattcgctcaggtccacggggtcgtcgtaggccacgggtcccaggcccgaggcgtggcgtgccgcggccagacataccccggcccggtccgtgcctccggtggattcgaggatctcgagcatgccggccacggccgcccgccagccgctctcgccgtcggcgtgcagcagggcacgcaggctgtcgcgccgcgtggcctcgtcctgcgcgtcgatccattcgcgaagcgggtcgggcatcgcgtcgcgcacccggctgttgcgccaggccgccggccggtcgcacaacagcccgagctggctcgacgggtcgccgctgtcggtcggcttgtccccgtaggatctcggatgcgtgatcacgcgtttgccttcggcatcgaggatctccacctccagggccctcaggccgacgatcatctcatggccggcgtgttcgggtccggccgcgtaccggtggcggccctggacggtgatgttgccgtatttgtcggccttcatcctcgtccacgtgaccacgtcgaacggcttggcgggcaggggcagcagcgcctttcggtcctcgtcgaacaggccggtctggctctcgcccttcctgtagtggtccttgtcccccagttcgaggcagcggccgggcaggcgcaggttgaagctgtcgaggttccatacgccgggcaccggcacgaacagcctgcggcgcacggccccgacccgggcctcgacgccgcccttctcgtgtcccgagtacgggttgcagaacgtgtactcgaacccgtagtgcgcctggaacgcctggaacaggcgggtcaggcggatcccgtcgaaccatttgcgtccgacgccggcggcgttgtcatacacgatgcgttcgggcaccccgcccagccattcgaataggttcctgagggcctggcacgtgcactccgcgttctccccgggcatcagctggctcggcccgatgttcgagtacgggaaatccaacacgaaatgccgcattcgcgtcacgacgccccggtagcgcacgtcgacctggccgaagtccgcctggcattcgcccggatgccacgacaggtccaggaaaccggcctcccgctccgccgcggcctcgcgcctgagccgcgccacggtccgggtcaccgtcgacaacgacaccccggccccgtactcgtcgcgcaaccgctcatggatgcgggtcgcggtatgccgctgcttgcgccaggtctcccggtcctcggcgagcatgccctcgatcacgggcagccactcgtcgatcaccgaaccacgacgtcgcctcacgggcggcctggccgataggtcgtcgaccctcagatacttgcgcacggtcggctcgctgaccctctcgctgcgcgctatcgaggcgatggactcaccgttcctgcgacgcgaacggatagactgtatttggggcatgctgatcattgcctttccggacctttcccgaatggaactagaagcaccatcaggctaaggcccacgggtggtcggcatgcctttccgcctaaacccgaaaaatcttcgtgactaaaacctcaacttcctattgaacaaaaacaatcgcgtgggtcctgcgtatgccggccaggccgatcgcgtccgccaggtcatcccgcccgagccatctgaacaacgggcgcaggtccgacgcggcgtgccgcatcgacgactccgaccagcgtgaaccgaggtggtgacgttttcttggactccctgaccgggaggagaaccccctcatggcgaagtacagcagggagcagcgcgacagggccgtggacctgtacatcaaatacgaacgctgcgccgccgacgtgatccgcgagctcggctatcccagcaagggcgtgttgctgtcgtggtacgcggaccggctcgaggaggagcgcaccggcgttccctccgggcgcggggaacgctacaggcggtacacggacgggcagaaacgggccgcggtggaccattacctcgaatacggcagacggctcagccgcaccatgcggatgctcggctatccgaaaagcaaggaactgctcatggcgtggatcgacgagctcgcgcccggccaacgcaagttgaggcacggtccggtccccgaggagctgaaacgcgaggcggtggtcgcggtcgcgtccggacggctgaaatcgcgtgaggcggcagccgaactgggcgtgcaggacgcgactgtgcgagaatggaaacggcagatgctcgcgaaatccgaggaggcgactgtgtccggatccgggaaaagaaggaccgtcgtggaatccaaggagccgtccgtcaagccgaccgtggctccgaacgcgtcggacgcggccggtccggcggatgcgttggcgtcgatggagaggaaagtggcggagctccaggcccgtctggacgagttggacgccgatgtcgaacggcaacgacgggagaagagggaactcgacatcgagatcgcgatccggaagggcgcgttggagctgttgggaaaagagccgggcgcagacccggaaaacctgaccaaccgagagaagacactcctcgtcaagaccgttagcgagacgctgggcgtgacggccaggagcctcttgcccgtggtcggcatcgcgcgcagcacgtaccattaccagctcaagtccatgaaacgtcctgacaaagacgcgccgctgctggagctcgtgcgcgaggcgttcgagaacagcgaacgccgctacgggtacaagcggatccacctggagctgaaaggcatgggcgtcagggtatcggccaaacggatcatgcggctgatgacctcacatggcctggtgcccctgttcaagagcgcgaagcggtacagctcgtacaagggcgagctcaccaaggcgccgaagaacctggtgaaccgcgatttccacgccgagcggccgaacatgctgtgggtcacggacctcacggaattctcgatccccgcggggaaggcctacctgtcgcccgtgatcgactgctacgacggcatgccggtcgcctggacgatcggcacgagcccgaacgccgagctggccaacggcatgctcaccgacgcctgctccacgctcaaggacggagagaagccgatcatccacagtgaccgcggctgccactaccggtggccggaatggatccgcatctgcatggacaacaacctgacgcgttcgatgagcgcgaaaggctgttctccggacaacgcggccgcggaggggttcttcggccgtctcaagcaggagttcttccacaagcgcagcttcgcgggcgtctcgatggacgggttcatcaacatgctcaacgactacatggtctggtaccgggacaggcggatcaagacggagttcggcatgagcatcatggatcgtcgacgcgagctcggtcttgtggcatgattggtggtgatggaatcaacgacgagtccaacaaaacggcaccagccccggggctgcggacgttttcttggagaccgaacggaaggattttcgtatgttcagtcttgaggaacgagagcgtgcggtggagttgtatttcaccacgccgatgacgacggcccaggtggtggagcatctgggttatccgaccaggcagtgtctggagcgttggctggcgatggattcccggtatgctggccatatggccaaacccatcatcccactggagaccaggcgaagggcagtcgagctggtgctgggcggcatgcagcagaagcaggccgccaaacagctcggcgtgagcgtcggcgcggtgcatggctgggtcagggcgtaccgcaagggcggcatggccgcgttgcagcccaaaaacaggaactccgcgcagggcaataagcccgcggactcccgccgccggccgtccgcagccgatgatgatgacgcggaggctttgcgccgcagggtcgaggaactggagctggagaacgcgttgatgcgggaggtggtggaggtcgtaaaaaaagaccccggcgccgacctgcggcgcctgtcgaacagggagaagaccctgttgatcgaccggttgaggccggcgtattcgctcagctcgatgacatgcttgctcgccatcgcgcccagcagctaccactaccaccacgcccggctcggcgttgacaagtacgccggactcagggcagaggtggccggggcgttcgccgattccaagggcaggtacgggtaccgcaggatcaaggcggtgctcaagaccggcgtatcggagaaggtggtccgcaggatcatggcggaggaagggctcgtggcgcacgtgcccaagcgacgcaggtatagttcctacgagggcgagacgacgccggctcccgccaatctcgtcgaccgggacttcacggccgagcgtccgaacgagaagtggctgacggacatcaccgagatcaaggccagggacgggaaggtgtacctctcgccgatgatcgactgcttcgatggcaagatcgtcgcatacaccgccggcttcagccccaacgcggagctggccaaccggatgctggagaaagcggcctcgacgctgccggggaacgcgcgtcccctggtgcattccgaccgtggatgccattaccggtggcccggatggctcgggctcatggaacgcttcgggctgacgcgctccatgagcgcgaagggctgttcgccggacaacgcggccgcggagggattcttcggcaggatgaagaccgaggcggtctaccccgagaagtgggaggaacacacccgcaacgaggtgctcgccttggtcgatgagtacatactattcgcacctgtcggaagaggaacgccaggtcatccagatcgaggtaggcaacggcgccagcatacgcgggatcggcgcgatgctgggccgcagcccgtccagcatcagccgggagatcaagcgcaacacatggttcccgtccaacgagaacgagtcgtaccgcccgtaccggccgaaaagactgaaggcggggccatggaccggccgctactacatcgccgggcccgagcagcgcaaggccgaccgcaggagatccaagccacgaaagccctaccggctgtcgcacgaccgcctgtgggcgcaggtggccgaatggctgggccgcggctggtcgccgctgcccgtcagcggcaggccgcgcgtcctgtggccggacgatgcgctcatgcgcgtgtgcccggagaccatctaccgatgggtctactccagcaggccgcttcgggaacgctgggcgcggtgcctgccgcgagggcacaggcggcgccgcaggcacggcggcaggaggacgtcgcgcttcccgatccccggccgagtgcccatctccgaacgcccgccggaggccgacggcaggagcgcgttcggccattgggaggccgacagcgtcatcggagtgggatgcaacctgcacaccgaggtggagaggaggaccaggttcctcatggcccgcgtcgttccggacaagaccgccggcgagagcgtcggggcgcagctggacatgttctcgccgctgccggccggcgcgcgcgtcagcgtcacgcacgacaacggcaccgagttcgcccaccacgaaaggctgcgcgacgggctgggcatggccacgtacttcgccgacccgtactccagccggcggcggggaagcaacgagaaccgcaacggcatgatccgccggtatctgcccaaacgctgcgagatacggatggacatggcaaaggaggtcagggagatcgtcgacgagatcaacaaccgccccatgcgcgtgctcggctaccgcacgcccgccgaggcgttcgccgacgaactgttagaattacaggaccaacaagggtgttgcacttctaaatagacatcgggtttaggcagttgcatgcattttccttatttttccggttgcgcggaggtgttcctgccgaacatgagggcctcactgacgcggcggctctggccggtgaactcgaggagccgcccgtggtgcacgatgcggtcgatgatcgctgcggcgagtttgtcgtccgcgaagaccgtgccccatttactgaactcgatgttcgtggtgaatatgatgctccgtctttcgtagctgcccgcgatgatctggtagagcaggcgcgccccgtcgatgtcgaagggtacgtagccgaactcgtccagtatgatcaggtcggcacggccgatgtcccggagcatcgtctcgagcgtgccgtcgcgtttggccttgcccagctggaggacgagctcggcggtctgatggaaccgcacgcccagccccatgtcgatcgccttcatgcccagcccgatcgcgagatgtgtctttccgcgcccggtcttgccgtagaacaccaggtcctgcgcgcgcgggatgaaaccgagccctaggagctcatcgagcatgtagccgtcggggagcctgacgttcgtgaagtcgtagccgtcgagacccttgacgacggggaaccgggcgcggcgcaggagcctgtcgtgcttcgcgcgttccctgttcgccagttccgtgtcgagcaggcggtggacggcgtcgacctggcggggcgtggcccagccggcgaattcgtcgatgctcgccttggagatgaacagcttgcgggccttctcgtagagcccttcgtccgtcttcgtgttcatcgcccgccttcctgcacgccgacgtccgcggtgaacgcgatgtcgtattcactcagatccggcctgtcatcgtcgtattcgatacccgccacgccctcggcgagcctggccgcgagcagtgtgacaccggcgcggtccgccccgccggtcgattcgaggatggaaagcatcgcctcgaccgcgttcgcccacccggattccctgtcaacgcgtttgagggtctgcagcgctgcggtttcgtggccagctccaggcaccggtccggcagcccggcgttaaagttctccaggctccatacgctcggccggggcacgaacagcttgcgccgcaccatgccgaccttggactccaccgcgcccttctcatgaccggaatacgggttgcagaacgaacaatcgaacccgtaatgcgcctggaaggcctggaacaggtgcgtcaggcgcggctcgcgctccccgtaccccttatggcccacgccggcggcgttatcgaacacgatccgctccggcacaccgcccagccactcgaacaggttgcgcaacgccaggcacgtgcactcagcgttctcgcccggcatcaactgcaccagaccgacgttcgaatacgggaaatcaagcacgaaatgatgcatccgctgcaccacgccgcgcaacagcacgtcgacctcgccgaaatcggcctgcgcctcgcctggatgccataccagatccatgaacgcctcatcacgctccgccgcgaactcacgcctgagccgcgccaccgcccgcgtcaccgtggacagggagacctccgcgccatgctcgtccctcaaccgctcccagatcctggtcgcggtatgccgctgcttgcgccagttcgcgcgatcctccgcgagccactgctcgatcacgggcagatacgggtcgatcaccgacgcgcgcggctttctcaccgacggcacggccgacagatcctccttcgcgaggtacttacgcaccgtcggctcgctgacatgtgttttccgcgcgatcgacgcgacggattccccgttccgccgcaaacgacggatagactgtacttggggcatgctgatcataatcctttccggtcctttctggcggagatacaagcaccatccagttaagaccattccgtggtcggcatgctctgcctaaacccgaaaaatcatcgtgactaaacccgcaacaactaattgaacacaaacaggacgcgggtggcgccatgcctgcccatggacgccttgaagcggatgtactcctccaattcgccggcgagcgggccgacgaatccgtgttccgtgggtctcatgacgatccgccttccggcacgggcagcacgcacgcgagcattcccccgcggtgcgtggccatgtagacgcgtgtggaatcggggtcggcgtggccaagcaccgcgctgatcgtcggcaacggcgtggccgcctccagcatcctcgtcgccgcgttgcgccgcaacagcctggaaccgccccggcgtccgagcccggcgtgccgcatgacacggctgatcgcctcgtacaccgatgaatgaccccgaagcgcgacatggggcgccttgtaccgcacgaacacacggtcgtcgtcggtggcgggcctttcgtccaacagccaggacgccagcctcgcggccagcggtcccgtcatcggcacggtcaacggattgcccgtctttcgctgcaccagacctatgctcatggaatcccaatccacgtcggcgatcctcagaccgatcacatcgcatgccctcagcccgcacgtcagcgacagcagggtgatcgccgcgtccctcgacggcaccgaccgcgaggcgcacgcctccagcaagcggcggtgctcgtcgtcgggcaacgttcccgcgatcgcgtgtgtttttagtcaagtcggtgtttcgtgtttcgtcactaatttttttcggtttcgaggtggtgacgttttcttggactccctgaccgggaggagaaccccctcatggcgaagtacagcagggagcagcgcgacagggccgtggacctgtacatcaaatacgaacgctgcgccgccgacgttaccgggacaggcggatcaagacggagttcggcatgagcatcatggatcgtcgacgcgagctcggtcttgtggcatgattggtggtgatggaatcaacgacgagtccaacaaaacggcaccagccccttttcggcatgaggagtgccggccggtggtttgttttactggttgtccgtcttgccgaacatgagggcttggctgacgcgtcggctggggccggtgaattcgatgaggcgtccgtggtggacgatgcggtcgatgatcgcggcggcgagtttgtcgtcggcgaagatcgtcccccatttgctgaactcgatgttcgtggtgaagatgatgctgcgacgttcgtagctgccggcgatgatctggtagaggagacgggccccgtcgatgtcgaagggcacgtagccgaactcgtcgaggatgatcaggtcggcacgggcgaggtccctgagcaggctgtcgagggcgccgtcgcgtttggccttgccgagctggagcacgagctccgcggtctgccggaacctcacgctcctgccttgctcgatggcgagcatgcccagggcggtggccaggtgggtctttccgcgtcccgtcttgccgtagaacacgaggtcctgcgccttggccgcgaaatcgaggccggtcagctgctccttggtgtatccgtcgggcaggcgcacgttcgcgaagtcgtagccgtcgaggcttttgggcaccgggtgttttgcttcaatgtttgttcgacaggttcggcagtgtttttccgtagtgtgggctgatggttttccccggtgtcgtcatcgtttcccggtgatgtgataggcatcggtgccgccgcctgtatagccaaccggctgaggctggacttcccggataatggggatatgcacgcgagcgtcgagacgatctaccaggccatctacctgcaggccaggggcgaactcaagcaggagctgaaacgcgccatgaggcaggggcgaaccgcccgcagaccccaaggcggccaaggccgcaaaccccgtttccgcgaacccatggccatgatctcggagcgacccccggagatcgaggaccgggcggtcccgggccactgggagggcgatctcatcaccggcagccgcaacaaaagcgccatcggcacgctcgtcgagcgcaccaccaggttcacgatcctgctgcacctgcccgacgggcacgacgccgaacacgtccagcaggccatcatcgacaagatgcagcacctgcccaaactcctgcgcaacagcctgacctgggaccagggagcggaactcgccctgcacaaacggatcggcgcctcgctggacatggccgtctacttctgcgacccgcactccccgtggcagcgcggcaccaacgagaacaccaacgggctcctgcgccagtacttccccaaaggcaccgacctatccgtctacccggaggactacctcgacgcggtcgccgaggaactcaacgaccggccacgcaaaaccctcgggttcatgaaaccaagcgagaagatcatcgaactgctcgacgccgcgtgataacctcaacaaccgacaacgtgaccatggaaggccgctcaaaccccaggtgttgcaaccaccactagaatctgccgatcgcgtgggtcctgcgtatgccggccaggccgatcgcgtccgccaggtcatcccgcccgagccatctgaacaacgggcgcaggtccgacgcggcgtgccgcatcgacgactccgaccagcgtgaacgcagcccggccaggaaccccagcacatgcgagccatccgaaccatccaacgacacgaccccatgagattccagccacgtgaggaacaagcccgccatccgacggtaatgccccaccgtcgccgaagccagtcccgaaccggcgagatacgcctcccaacgctccatgaccacggccaaacccggaaccaccggctccgcaagcctgctcctgcgccacttgcccaggtccaccgaaccggaccgcagatacgagtcgcacaaacgcgccagcctgccgtaatcgaaccaccgctgcctgctgaaaccgcccgtccgctcactgaaggtcgacgcggcgaaccccgcgcccaacccacgcgtgtacaccgcatccgggcctccggcgtaccgttccaacgccctgatggacttgcggtactggcctatggtggattccatataaccggccccgtaaagcgcgcggaccacctcgcccgcgacatggccaaccgtcgtctcacccatggcaaactccttcgttcgaatcaaatgggacaagacgaacataacccggaacgttaagccgggaaaccacatgggacacggccagccaccaagaccccgaaccgttccccggcttaacaacaaacccggcttaatcaggaatgaactggcaatcattgactataaagaagtagtacaaacacgctcttgagttctcaaaccaccaccactcacccacctcgcagctccccggaggagaaccactcgctgagcggcagcaaggaaataacttacacgcattcacggactcgcgcaaaccgggcgcacgaagataagcccaaatcgttgaaacgacaggcttcgctcggcgtgtcgaaatcgacgtttcgcacgtctatatcttcagtctagaactagatatcgtcgaaaattggattgaaaattttggtcgatgggcgtgtcgcgaattacctcttacggcgcatgtggtgcaccgccaattatcggaatcatcattgatccagtacaccgataagaaccattatgttcggattactatatgctcgccagtcgtgcgccaatcaaccgcctggtagcgatgcagttgtcgtattgcttgccttggcacgaccaacgactgaatggcatcagcacattcagagtcgccgattcaatccatgcgtcgtagcacagatcagtcgtggtctcacgggtatgggggctcgggcgtcgggctcccacggtcgcggacgcgccgcgtcgttcggcctcgccgtcggggctggccgggaatggtcccggacgtgggtctcatgagtgcgagaagccccgggtgtttttgtgggggtgtgtgggtttgggtcgtgagtgtttcgggtatgcgaaagccccttggggcgtgtggcctggccgcgagcagtgtgacaccggcgcggtccgccccgccggtcgattcgaggatggaaagcatcgcctcgaccgcgttcgcccacccggattccctgtcaacgcgtttgagggtctgcagcgcctcgttgcgtgtctgtctgtcctgccgatccagccattcccgcaacgggtccggcaacgcgtcacgtacccggctgttgggccaggacgcgggcttgttgcacagcagcgccaactgcatggacgggtcctcgctgttcgtgctggcctggccgtacgcccgaggatgggtcgccagatgcttgcccgacgagtcgaggacctcgacctcgagcgcgcggaggcccacgatcacccctctgcccgcgttcgcccggtccgcggaataacgatgccgtccctcgagcgtgaccacgccgtaccggtcggccttcatatgccgccacgtgaccacgtcgaaacgcttcccgggcaacggcagcagcgccgcacggtcctcggagaacaggccacgttcctccgtgtccttgcggtaatgcggtttcgtggccagctccaggcaccggtccggcagcccggcgttaaagttctccaggctccatacgctcggccggggcacgaacagcttgcgccgcaccatgccgaccttggactccaccgcgccggttttgccggatgcggccggtaccgggccctcgaatacgagcccgccatgcccccggccttcatgatccggttgacgcggcggcgcgacatgacgatgccctcatgccccggggcgtgcttgatcttcctgcccccatagatcttgccgctgtcgcgccacacgcgtcccacatcctcctcatgggggtcggcccgttcggtctcggggtgtccgagcatccagcagtaggtcgacttggcaacgcccaggatcctgcactgcgccgatatcgggcagcggccggcgtcggaccgtatggcctctgctttcgtgcgaataccggcgccgcttgttctgaaacatccacctccatctccaactggcggttgcgccccctcaacgcgatcagctcgttccgctccggcgtgcggttgtcggccgccctggtcgaaccgctgttgcggacccccgcacccaccggtgcagggtggaacgcgagatgtcgcactccgtcctgatctcgcgcgcgggcttgccgttctcgtacaattgcacgatccggcgtttgaactcctcctcataatgacgtggacgaccaggatcggccatgaccatcaactccttcgttgcccggcccctcaataaaccatccaatacattggagccaatcctgctccaccacctgggccgtcgtcatcggcgtggtgaaatacaactccaccgcacgctctcgttcctcaagactgaacatacgaaaatccttccgttcggtctccaagaaaacgtccgcagcccctaacgcccgaattcttgcgcaaaagcggttcggcccgttgccgggaggacaacttcagtcggttgattgcatgatgccgtcgagccgggacatgtccaggtagcggcgtgcgctccattggttggcggtgacgtagcggatcctggcgcagacgagcatgagcgcgctcctgccgtccgggaagctgccgaccactgtttgtgttcaattagttgttgcgggtttagtcacgatgatttttcgggtttaggcagagcatgccgaccacggaatggtcttaactggatggtgcttgtatctccgccagaaaggaccggaaaggcttctgcccattcagccgtaaccagttctaaataacgtcttttaatatcacgtttaaaagaactggttacgataatcttacgtttagccatgtacttcttccgacatagctttaatcgcttcttctaccgtttcgtactcggtgtactcgccattttcaatctcttttaaagattgaagtaacttggctgctgctttaggagttaaagcaggttctcgtgcatagtcaaaagacaaaggaatcgctttagttttaacgatttgattcaagaacagtttgaatgcttgaggcatagtcaaaccatagtcttccaaaataggggtaacttgttcttttaactctgcttctaagcgcatattgaaattgactgcggacatgattcccttgcgcttgatctcccggctgatgctggacgggctgcggcccagcatcgcgccgatcccgcgtatgctggcgccgttgcctacctcgatctggatgacctggcgttcctcttccgacaggtgcgaatatacttctcccataggtgcgacatcccttcggactggttttctaggcaatttccaatctaacgggtgttgcactttcatttagacaacggggccaaccggctgaggctggacttcccggataatggggatatgcacgcgagcgtcgagacgatctaccaggccatctacctgcaggccaggggcgaactcaagcaggagctgaaacgcgccatgaggctcgtgcaccacgggcggctcctcgagttcaccggccagagccgccgcgtcagtgaggccctcatgttcggcaggaacacctccgcgcaaccggaaaaataaggaaaatgcatgcaactgcctaaacccgaaaaaaatacatgactaaaccgaggtggtgacgttttcttggactccctgaccgggaggagaaccccctcatggcgaagtacagcagggagcagcgcgacagggccgtggacctgtacatcaaatacgaacgctgcgccgcgcgcggtggagtccaaggtcggcatggtgcggcgcaagctgttcgtgccccggccgagcgtatggagcctggagaactttaacgccgggctgccggaccggtgcctggagctggccacgaaaccgcactgccgcaaggacacggaggaacgtggcctgttctccgaggaccgtgcggcgctgctgccgttgcccgggaagcgtttcgacgtggtcacgtggcggcatatgaaggccgaccggtacggcgtggtcacggcctggccgcgagcagtgtgacaccggcgcggtccgccccgccggtcgattcgaggatggaaagcatcgcctcgaccgcgttcgcccacccggattccctgtcaacgcgtttgagggtctgcagcgcctcgttgcgtgtctgtctgtcctgccgatccagccattcccgcaacgggtccggcaacgcgtcacgtacccggctgttgggccaggacgcgggcttgttgcacagcagcgccaactgcatggacgggtcgagaaccacgagcggcaacccccgggattcgcgtcgatcctatgggcgatccatcgctccacgacgccccgctccagacgcacggccccgtgttcgaggcaatgccggtcgaacgagcgcaggacctggacgcgggtggcgccatgcctgcccatggacgccttgaagcggatgtactcctccaattcgccggcgagcgggccgacgaatccgtgttccgtgggtctcatgacgatccgccttccggcacgggcgcccgtgccggaaggcggatcgtcatgagacccacggaacacggattcgtcggcccgctcgccggcgaattggaggagtacatccgcttcaaggcgtccatgggcaggcatggcgccacccgcgtccgggtcctgcgctcgttcgaccggcattgcctcgaacacggggccgtgcgtctggagcggggcgtcgtggagcgatggatcgcccataggatcgacgcgaatcccgggggttgccgctcgtggttctcggcggtttggggcgtttgggccggtccgcggccttctgctgggcgcggtaaggctcgtaaccgccggactcgggattcctgttgcgctcgacctcgcggctgaccgtgccggggtcgcggcccagcagacgggcgatggcgcggatcgaatcgcccagacgcagacggtccgcgatctggatgcgctcctcctggctcaggtagcgcggatggagggtcttgggtttgtccatggtggaacgataccagtccaccagcacgaacacacggtcgtcgtcggtggcgggcctttcgtccaacagccaggacgccagcctcgcggccagcggtcccgtcatcggcacggtcaacggattgcccgtctttcgctgcaccagacctatactcatggaatcccaatccacgtcggcgatcctcagaccgatcacatcgcatgccctcagcccgcacgtcagcgacagcagggtgatcgccgcgtccctcgacggcaccgaccgcgaggcgcacgcctacgtcggcggcgcagcgttcgtatttgatgtacaggtccacggccctgtcgcgctgctccctgctgtacttcgccatgagggggttctcctcccggtcagggagtccaagaaaacgtcaccacctcggtttaggcagttgcatgcattttccttatttttccggttgcgcggaggtgttcctgccgaacatgagggcctcactgacgcggcggctctggccggtgaactcgaggagccgcccgtggtgcacgagcatatgcacgcccatgaactgccgaccccccacgtaggccgggttggcggcgatgtgcgtgtgcgggggcgtagccatcgaattcgcggccgaggatgttcggggccggatcgtcgttcggttttgtgtgttttagcaagttggcgtccgctttgtgagcggtgtttttccgcagtgtaggcagcgggttttccgcagggtgtgcggtatcggccgctgcctgtctgcgttgtgttggttatttggtcatgtatacaggcggcggcaccgatgcctatcacatcaccgggaaacgatgacgacaccggggaaaaccatcagcccacactacggaaaaacactgccgaacctgtcgaacaaacattgaagcaaaacacggttttgccggatgcggccggtaccgggccctcgaatacgagcccgccatgcccccggccttcatgatccggttgacgcggcggcgcgacatgacgatgccctcatgccccggggcgtgcttgatcgcctcatggcgcgtttcagctcctgcttgagttcgcccctggcctgcaggtagatggcctggtagatcgtctcgacgctcgcgtgcatatccccattatccgggaagtccagcctcagccggttggctatctgctccgggctccaatgcctgcgcaacccggcggcgatctcgtcccacagtcgcgtgccctcggccgccttgcgcggtttggggcgtttgagccggtccgcggccttctgctgggcgcggatgccctcagcccgcacgtcagcgacagcagggtgatcgccgcgtccctcgacggcaccgaccgcgaggcgcacgcctccagcaagcggcggtgctcgtcgtcgggcaacgttcccgcgatcgcgtgggtcctgcgtatgccggccaggccgatcgcgtccgccaggtcatcccgcccgagccatctgaacaacgggcgcaggtccgacgcggcgtgccgcatcgacgactccgaccagcgtgaacgatcaagcacgccccggggcatgagggcatcgtcatgtcgcgccgccgcgtcaaccggatcatgaaggccgggggcatggcgggctcgtattcgagggcccggtaccggccgcatccggcaaaaccgaacgacgatccggccccgaacatcctcggccgcgaattcgatggctacgcccccgcacacgcacatcgccgccaacccggcctacgtggggggtcggcagttcatgggcgtgcatatgc

(The sequence listing continues in the following parts.)

What is claimed is:

1. A synbiotic composition comprising:
a probiotic species selected from the group consisting of *B. pseudocatenulatum*, *B. longum* subsp. *longum*, and any combination thereof, wherein the *B. longum* subsp. *longum* has a nucleotide sequence having at least 99% sequence identity to SEQ ID NO. 5; and
a prebiotic comprising an amount of xylooligosaccharide.

2. The synbiotic composition of claim 1, wherein the probiotic species is *B. longum* subsp. *longum*.

3. The synbiotic composition of claim 1, further comprising at least one enzyme.

4. The synbiotic composition of claim 1, wherein the composition is in a form selected from the group consisting of liquids, solids, tablets, pills, capsules, solids in a liquid medium, powders, lozenges, straws, sachets, cachets, solutions, elixirs, suspensions, emulsions, solutions, syrups, aerosols, gelatin capsules, sterile packaged powders, or combined with or introduced into a food product.

5. The synbiotic composition of claim 1, wherein the prebiotic further comprises at least one component selected from the group consisting of soluble starch, yeast extract, oligosaccharides, polysaccharides, and other prebiotics that contain fructose, xylose, soya, galactose, glucose and/or mannose.

6. The synbiotic composition of claim 1, wherein the prebiotic further comprises at least one component selected from the group consisting of polydextrose, polydextrose powder, lactulose, lactosucrose, raffinose, gluco-oligosaccharide, inulin, fructo-oligosaccharide, isomalto-oligosaccharide, soybean oligosaccharides, lactosucrose, xylo-oligosaccharide, chito-oligosaccharide, manno-oligosaccharide, aribino-oligosaccharide, siallyl-oligosaccharide, fuco-oligosaccharide, galacto-oligosaccharide, and gentio-oligosaccharides.

7. The synbiotic composition of claim 1, further comprising one or more additional active ingredients, excipients, dissolution agents, surfactants, antioxidants, antiseptics, preservatives, penetrants, osmoprotectants, cryoprotectants, and combinations thereof.

8. The synbiotic composition of claim 1, wherein the probiotic is lyophilized.

9. The synbiotic composition of claim 1, wherein said *B. longum* subsp. *longum* probiotic or *B. pseudocatenulatum* probiotic has a nucleotide sequence that includes at least 50 contiguous nucleotides having at least 95% sequence identity with a contiguous nucleotide sequence selected from the group consisting of SEQ ID NOs 5 or 6 or any one of SEQ ID NOs 15-99.

10. A method of improving gut health comprising a step of orally administering a therapeutically effective amount of the composition of claim 1 to a subject in need thereof.

11. The method of claim 10, wherein improving gut health is determined by assessing a gastrointestinal characteristic or parameter.

12. The method of claim 10, wherein the prebiotic and probiotic are administered within 6 hours of one another.

13. The method of claim 10, wherein gut health is improved by at least 10% in comparison to a subject or group of subjects that has not had an administration of the composition of claim 1 or is in comparison to the same subject before and after administration of the composition of claim 1.

14. The method of claim 10, wherein the composition is administered in a form selected from the group consisting of liquids, solids, tablets, pills, capsules, solids in a liquid medium, powders, lozenges, straws, sachets, cachets, solutions, elixirs, suspensions, emulsions, solutions, syrups, aerosols, gelatin capsules, sterile packaged powders, or combined with or introduced into a food product.

15. A method of modulating gastrointestinal microbiota in a subject comprising a steps of orally administering a therapeutically effective amount of the composition of claim 1 to a subject in need thereof.

16. The method of claim 15, wherein modulating gastrointestinal microbiota is determined by comparing the microbiota populations in the subject before and after administration of the composition of claim 1.

17. A method of increasing butyrate levels in the gut comprising a step of orally administering the composition of claim 1 to a subject in need thereof.

* * * * *